United States Patent 7,341,835 (METHODS OF ANALYSIS OF ALTERNATIVE SPLICING IN MOUSE) - sequence listing, part 25

SEQ ID NO: 957630 - DNA, 25 bp, Mus musculus
gtctcctgctcagattttgatccga

SEQ ID NO: 957631 - DNA, 25 bp, Mus musculus
gtctcctgtgccaaaaaacattgcc

SEQ ID NO: 957632 - DNA, 25 bp, Mus musculus
gtctcctgtgcctaaaaacattgcc

SEQ ID NO: 957633 - DNA, 25 bp, Mus musculus
gtctccttcgagctgtttgcagaca

SEQ ID NO: 957634 - DNA, 25 bp, Mus musculus
gtctccttcgaggtgtttgcagaca

SEQ ID NO: 957635 - DNA, 25 bp, Mus musculus
gtctcgaacgtgccacggtcaggga

SEQ ID NO: 957636 - DNA, 25 bp, Mus musculus
gtctcgaacgtgcctcggtcaggga

SEQ ID NO: 957637 - DNA, 25 bp, Mus musculus
gtctcgaagagacagacgacaaagc

SEQ ID NO: 957638 - DNA, 25 bp, Mus musculus
gtctcgaagagagagacgacaaagc

SEQ ID NO: 957639 - DNA, 25 bp, Mus musculus
gtctcgaagtgacgtagagctcaca

SEQ ID NO: 957640 - DNA, 25 bp, Mus musculus
gtctcgaagtgaggtagagctcaca

SEQ ID NO: 957641 - DNA, 25 bp, Mus musculus
gtctcgatccagctcaggttcccac

SEQ ID NO: 957642 - DNA, 25 bp, Mus musculus
gtctcgatccaggtcaggttcccac

SEQ ID NO: 957643 - DNA, 25 bp, Mus musculus
gtctcggaagagcatccaccgggac

SEQ ID NO: 957644 - DNA, 25 bp, Mus musculus
gtctcggaagtgcatccaccgggac

SEQ ID NO: 957645 - DNA, 25 bp, Mus musculus
gtctctaaacagcttttagaacagt

SEQ ID NO: 957646 - DNA, 25 bp, Mus musculus
gtctctaaacaggttttagaacagt

SEQ ID NO: 957647 - DNA, 25 bp, Mus musculus
gtctctagggctgacccagatattg

SEQ ID NO: 957648 - DNA, 25 bp, Mus musculus
gtctctaggggtgacccagatattg

SEQ ID NO: 957649 - DNA, 25 bp, Mus musculus
gtctctatcaaacgttgccgaggct

SEQ ID NO: 957650 - DNA, 25 bp, Mus musculus
gtctctatcaaaggttgccgaggct

SEQ ID NO: 957651 - DNA, 25 bp, Mus musculus
gtctctcaacattacgtcccatttg

SEQ ID NO: 957652 - DNA, 25 bp, Mus musculus
gtctctcaacattaggtcccatttg

SEQ ID NO: 957653 - DNA, 25 bp, Mus musculus
gtctctcaggaccacgtagattcca

SEQ ID NO: 957654 - DNA, 25 bp, Mus musculus
gtctctcaggaccaggtagattcca

SEQ ID NO: 957655 - DNA, 25 bp, Mus musculus
gtctctccatcacgtttctttcttg

SEQ ID NO: 957656 - DNA, 25 bp, Mus musculus
gtctctccatcaggtttctttcttg

SEQ ID NO: 957657 - DNA, 25 bp, Mus musculus
gtctctgaagagaaccttgacctcc

SEQ ID NO: 957658 - DNA, 25 bp, Mus musculus
gtctctgaagagtaccttgacctcc

SEQ ID NO: 957659 - DNA, 25 bp, Mus musculus
gtctctgacactcctcctacagtga

SEQ ID NO: 957660 - DNA, 25 bp, Mus musculus
gtctctgacagtcctcctacagtga

SEQ ID NO: 957661 - DNA, 25 bp, Mus musculus
gtctctgcagagtctgcgagaaatc

SEQ ID NO: 957662 - DNA, 25 bp, Mus musculus
gtctctgcagtgtctgcgagaaatc

SEQ ID NO: 957663 - DNA, 25 bp, Mus musculus
gtctctgcatcatgccatgtgagcc

SEQ ID NO: 957664 - DNA, 25 bp, Mus musculus
gtctctgcatcatggcatgtgagcc

SEQ ID NO: 957665 - DNA, 25 bp, Mus musculus
gtctctgccatgctgaactccctgg

SEQ ID NO: 957666 - DNA, 25 bp, Mus musculus
gtctctgccatggtgaactccctgg

SEQ ID NO: 957667 - DNA, 25 bp, Mus musculus
gtctctggagaaagcggcattgatg

SEQ ID NO: 957668 - DNA, 25 bp, Mus musculus
gtctctggagaaaggggcattgatg

SEQ ID NO: 957669 - DNA, 25 bp, Mus musculus
gtctctggctatctccttcctgatg

SEQ ID NO: 957670 - DNA, 25 bp, Mus musculus
gtctctggctttctccttcctgatg

SEQ ID NO: 957671 - DNA, 25 bp, Mus musculus
gtctctgggaagctgcggttcccat

SEQ ID NO: 957672 - DNA, 25 bp, Mus musculus
gtctctgggaaggtgcggttcccat

SEQ ID NO: 957673 - DNA, 25 bp, Mus musculus
gtctctgtccttatgcctttatcat

SEQ ID NO: 957674 - DNA, 25 bp, Mus musculus
gtctctgtccttctcttatctcctc

SEQ ID NO: 957675 - DNA, 25 bp, Mus musculus
gtctctgtccttgtcttatctcctc

SEQ ID NO: 957676 - DNA, 25 bp, Mus musculus
gtctctgtccttttgcctttatcat

SEQ ID NO: 957677 - DNA, 25 bp, Mus musculus
gtctctgtggacacagaagccatgg

SEQ ID NO: 957678 - DNA, 25 bp, Mus musculus
gtctctgtggatcagggccgggcct

SEQ ID NO: 957679 - DNA, 25 bp, Mus musculus
gtctctgtggatgagggccgggcct

SEQ ID NO: 957680 - DNA, 25 bp, Mus musculus
gtctctgtggctctttctcatcatt

SEQ ID NO: 957681 - DNA, 25 bp, Mus musculus
gtctctgtgggtctttctcatcatt

SEQ ID NO: 957682 - DNA, 25 bp, Mus musculus
gtctctgtggtcacagaagccatgg

SEQ ID NO: 957683 - DNA, 25 bp, Mus musculus
gtctctgttttacaggagcaaacct

SEQ ID NO: 957684 - DNA, 25 bp, Mus musculus
gtctctgttttagaggagcaaacct

SEQ ID NO: 957685 - DNA, 25 bp, Mus musculus
gtctcttaagaatataaaagacaat

SEQ ID NO: 957686 - DNA, 25 bp, Mus musculus
gtctcttaagtatataaaagacaat

SEQ ID NO: 957687 - DNA, 25 bp, Mus musculus
gtctcttcatgccacattcagaaag

SEQ ID NO: 957688 - DNA, 25 bp, Mus musculus
gtctcttcatgccagattcagaaag

SEQ ID NO: 957689 - DNA, 25 bp, Mus musculus
gtctcttcctctcacgataaggatg

SEQ ID NO: 957690 - DNA, 25 bp, Mus musculus
gtctcttcctctgacgataaggatg

SEQ ID NO: 957691 - DNA, 25 bp, Mus musculus
gtctcttccttacacatgatgaaga

SEQ ID NO: 957692 - DNA, 25 bp, Mus musculus
gtctcttccttagacatgatgaaga

SEQ ID NO: 957693 - DNA, 25 bp, Mus musculus
gtctcttggtgcagcgtttgtggta

SEQ ID NO: 957694 - DNA, 25 bp, Mus musculus
gtctcttggtgcagggtttgtggta

SEQ ID NO: 957695 - DNA, 25 bp, Mus musculus
gtctctttgaaacgagaaggaatga

SEQ ID NO: 957696 - DNA, 25 bp, Mus musculus
gtctctttgaaaggagaaggaatga

SEQ ID NO: 957697 - DNA, 25 bp, Mus musculus
gtctgacacaccaattaccaaggac

SEQ ID NO: 957698 - DNA, 25 bp, Mus musculus
gtctgacacagcaattaccaaggac

SEQ ID NO: 957699 - DNA, 25 bp, Mus musculus
gtctgagaaatgcacgaatctccgg

SEQ ID NO: 957700 - DNA, 25 bp, Mus musculus
gtctgagaaatgcaggaatctccgg

SEQ ID NO: 957701 - DNA, 25 bp, Mus musculus
gtctgagaatgactcgtgggtgagc

SEQ ID NO: 957702 - DNA, 25 bp, Mus musculus
gtctgagaatgactggtgggtgagc

SEQ ID NO: 957703 - DNA, 25 bp, Mus musculus
gtctgagacccgctacgtgtcagaa

SEQ ID NO: 957704 - DNA, 25 bp, Mus musculus
gtctgagacccggtacgtgtcagaa

SEQ ID NO: 957705 - DNA, 25 bp, Mus musculus
gtctgagaggaacccttctctgagg

SEQ ID NO: 957706 - DNA, 25 bp, Mus musculus
gtctgagaggaacttttatctgtgc

SEQ ID NO: 957707 - DNA, 25 bp, Mus musculus
gtctgagaggaagccttctctgagg

SEQ ID NO: 957708 - DNA, 25 bp, Mus musculus
gtctgagaggaagttttatctgtgc

SEQ ID NO: 957709 - DNA, 25 bp, Mus musculus
gtctgagcagactcagtgtgtggtc

SEQ ID NO: 957710 - DNA, 25 bp, Mus musculus
gtctgagcagactctgtgtgtggtc

SEQ ID NO: 957711 - DNA, 25 bp, Mus musculus
gtctgaggaagacagttcccatatc

SEQ ID NO: 957712 - DNA, 25 bp, Mus musculus
gtctgaggaagagagttcccatatc

SEQ ID NO: 957713 - DNA, 25 bp, Mus musculus
gtctgaggcgcgccccagcactatg

SEQ ID NO: 957714 - DNA, 25 bp, Mus musculus
gtctgaggcgcggcccagcactatg

SEQ ID NO: 957715 - DNA, 25 bp, Mus musculus
gtctgatggcccagcagcagaagac

SEQ ID NO: 957716 - DNA, 25 bp, Mus musculus
gtctgatggcgcagcagcagaagac

SEQ ID NO: 957717 - DNA, 25 bp, Mus musculus
gtctgattaaacaaattggagaaaa

SEQ ID NO: 957718 - DNA, 25 bp, Mus musculus
gtctgattaatcaaattggagaaaa

SEQ ID NO: 957719 - DNA, 25 bp, Mus musculus
gtctgatttaaacgtcatccactgg

SEQ ID NO: 957720 - DNA, 25 bp, Mus musculus
gtctgatttaaaggtcatccactgg

SEQ ID NO: 957721 - DNA, 25 bp, Mus musculus
gtctgcaagactgtgttctcttggc

SEQ ID NO: 957722 - DNA, 25 bp, Mus musculus
gtctgcaagagtgtgttctcttggc

SEQ ID NO: 957723 - DNA, 25 bp, Mus musculus
gtctgcagagcaatctgggacccgc

SEQ ID NO: 957724 - DNA, 25 bp, Mus musculus
gtctgcagaggaatctgggacccgc

SEQ ID NO: 957725 - DNA, 25 bp, Mus musculus
gtctgcagcatgagggcgtctctgg

SEQ ID NO: 957726 - DNA, 25 bp, Mus musculus
gtctgcagcatgtgggcgtctctgg

SEQ ID NO: 957727 - DNA, 25 bp, Mus musculus
gtctgcagccgtctctttgtgaaga

SEQ ID NO: 957728 - DNA, 25 bp, Mus musculus
gtctgcagccgtctgtttgtgaaga

SEQ ID NO: 957729 - DNA, 25 bp, Mus musculus
gtctgcagtaggcgctgctgaataa

SEQ ID NO: 957730 - DNA, 25 bp, Mus musculus
gtctgcagtaggggctgctgaataa

SEQ ID NO: 957731 - DNA, 25 bp, Mus musculus
gtctgcatctctcacctccggatcc

SEQ ID NO: 957732 - DNA, 25 bp, Mus musculus
gtctgcatctctgacctccggatcc

SEQ ID NO: 957733 - DNA, 25 bp, Mus musculus
gtctgcatgtggcctggccaggata

SEQ ID NO: 957734 - DNA, 25 bp, Mus musculus
gtctgcatgtgggctggccaggata

SEQ ID NO: 957735 - DNA, 25 bp, Mus musculus
gtctgcattgaatgtaactgtaacc

SEQ ID NO: 957736 - DNA, 25 bp, Mus musculus
gtctgcattgtatgtaactgtaacc

SEQ ID NO: 957737 - DNA, 25 bp, Mus musculus
gtctgccaagcactttattgaccta

SEQ ID NO: 957738 - DNA, 25 bp, Mus musculus
gtctgccaaggactttattgaccta

SEQ ID NO: 957739 - DNA, 25 bp, Mus musculus
gtctgcccagcagccctatccggat

SEQ ID NO: 957740 - DNA, 25 bp, Mus musculus
gtctgcccagccctatccggatgtt

SEQ ID NO: 957741 - DNA, 25 bp, Mus musculus
gtctgcccaggagccctatccggat

SEQ ID NO: 957742 - DNA, 25 bp, Mus musculus
gtctgcccaggcctatccggatgtt

SEQ ID NO: 957743 - DNA, 25 bp, Mus musculus
gtctgcctcaaacctcattggctaa

SEQ ID NO: 957744 - DNA, 25 bp, Mus musculus
gtctgcctcaaagctcattggctaa

SEQ ID NO: 957745 - DNA, 25 bp, Mus musculus
gtctgcgactctgacagcagagggg

SEQ ID NO: 957746 - DNA, 25 bp, Mus musculus
gtctgcgactctgagagcagagggg

SEQ ID NO: 957747 - DNA, 25 bp, Mus musculus
gtctgcgccaggatccgcctctgat

SEQ ID NO: 957748 - DNA, 25 bp, Mus musculus
gtctgcgccaggttccgcctctgat

SEQ ID NO: 957749 - DNA, 25 bp, Mus musculus
gtctgctctgggcgaggcggctgga

SEQ ID NO: 957750 - DNA, 25 bp, Mus musculus
gtctgctctgggggaggcggctgga

SEQ ID NO: 957751 - DNA, 25 bp, Mus musculus
gtctgctgggatgcgttgctggctg

SEQ ID NO: 957752 - DNA, 25 bp, Mus musculus
gtctgctgggttgcgttgctggctg

SEQ ID NO: 957753 - DNA, 25 bp, Mus musculus
gtctggaatcactgcgttatcattg

SEQ ID NO: 957754 - DNA, 25 bp, Mus musculus
gtctggaatcactgggttatcattg

SEQ ID NO: 957755 - DNA, 25 bp, Mus musculus
gtctggaccacgagagtctcgggaa

SEQ ID NO: 957756 - DNA, 25 bp, Mus musculus
gtctggaccacgagtgtctcgggaa

SEQ ID NO: 957757 - DNA, 25 bp, Mus musculus
gtctggaggactgacgtggtgaaaa

SEQ ID NO: 957758 - DNA, 25 bp, Mus musculus
gtctggaggactgaggtggtgaaaa

SEQ ID NO: 957759 - DNA, 25 bp, Mus musculus
gtctggcaccccaccagcaggatga

SEQ ID NO: 957760 - DNA, 25 bp, Mus musculus
gtctggcacccctccagcaggatga

SEQ ID NO: 957761 - DNA, 25 bp, Mus musculus
gtctggcaccgcgaagtcagtacac

SEQ ID NO: 957762 - DNA, 25 bp, Mus musculus
gtctggcaccgcgatgtcagtacac

SEQ ID NO: 957763 - DNA, 25 bp, Mus musculus
gtctggggatcacgattattactac

SEQ ID NO: 957764 - DNA, 25 bp, Mus musculus
gtctggggatcaggattattactac

SEQ ID NO: 957765 - DNA, 25 bp, Mus musculus
gtctggggccagctcatcgccacca

SEQ ID NO: 957766 - DNA, 25 bp, Mus musculus
gtctggggccaggtcatcgccacca

SEQ ID NO: 957767 - DNA, 25 bp, Mus musculus
gtctggtaacagcacttaccagctc

SEQ ID NO: 957768 - DNA, 25 bp, Mus musculus
gtctggtaacagcagttaccagctc

SEQ ID NO: 957769 - DNA, 25 bp, Mus musculus
gtctggtaagcggcccatcctgatg

SEQ ID NO: 957770 - DNA, 25 bp, Mus musculus
gtctggtaaggggcccatcctgatg

SEQ ID NO: 957771 - DNA, 25 bp, Mus musculus
gtctggtacctgatcatcaatgctg

SEQ ID NO: 957772 - DNA, 25 bp, Mus musculus
gtctggtacctgttcatcaatgctg

SEQ ID NO: 957773 - DNA, 25 bp, Mus musculus
gtctggtcgttccgagttttaatgt

SEQ ID NO: 957774 - DNA, 25 bp, Mus musculus
gtctggtcgttcggagttttaatgt

SEQ ID NO: 957775 - DNA, 25 bp, Mus musculus
gtctgtagtgatcctgcatgccatg

SEQ ID NO: 957776 - DNA, 25 bp, Mus musculus
gtctgtagtgatgctgcatgccatg

SEQ ID NO: 957777 - DNA, 25 bp, Mus musculus
gtctgtcctgagcacgtgaaactgg

SEQ ID NO: 957778 - DNA, 25 bp, Mus musculus
gtctgtcctgagcaggtgaaactgg

SEQ ID NO: 957779 - DNA, 25 bp, Mus musculus
gtctgtgaagagccacaatcatgtc

SEQ ID NO: 957780 - DNA, 25 bp, Mus musculus
gtctgtgaagcagaagtttgagatg

SEQ ID NO: 957781 - DNA, 25 bp, Mus musculus
gtctgtgaaggagaagtttgagatg

SEQ ID NO: 957782 - DNA, 25 bp, Mus musculus
gtctgtgaagtgccacaatcatgtc

SEQ ID NO: 957783 - DNA, 25 bp, Mus musculus
gtctgtgagccatggcatgggcatt

SEQ ID NO: 957784 - DNA, 25 bp, Mus musculus
gtctgtgagcgatggcatgggcatt

SEQ ID NO: 957785 - DNA, 25 bp, Mus musculus
gtctgtgcggatgcgaggggaagct

SEQ ID NO: 957786 - DNA, 25 bp, Mus musculus
gtctgtgcggttgcgaggggaagct

SEQ ID NO: 957787 - DNA, 25 bp, Mus musculus
gtctgtggaaaggaagtgtacccag

SEQ ID NO: 957788 - DNA, 25 bp, Mus musculus
gtctgtggaaaggatgtgtacccag

SEQ ID NO: 957789 - DNA, 25 bp, Mus musculus
gtctgtggcaagcgcgattccagca

SEQ ID NO: 957790 - DNA, 25 bp, Mus musculus
gtctgtggcaagggcgattccagca

SEQ ID NO: 957791 - DNA, 25 bp, Mus musculus
gtctgttatgacctcactgacagca

SEQ ID NO: 957792 - DNA, 25 bp, Mus musculus
gtctgttatgtcctcactgacagca

SEQ ID NO: 957793 - DNA, 25 bp, Mus musculus
gtcttaaggaagcccaagattgtat

SEQ ID NO: 957794 - DNA, 25 bp, Mus musculus
gtcttaaggaaggccaagattgtat

SEQ ID NO: 957795 - DNA, 25 bp, Mus musculus
gtcttacagcagattcgctcagcac

SEQ ID NO: 957796 - DNA, 25 bp, Mus musculus
gtcttacagcagtttcgctcagcac

SEQ ID NO: 957797 - DNA, 25 bp, Mus musculus
gtcttagcagaacacgtgtttggat

SEQ ID NO: 957798 - DNA, 25 bp, Mus musculus
gtcttagcagaacaggtgtttggat

SEQ ID NO: 957799 - DNA, 25 bp, Mus musculus
gtcttcaaagacatgaatgttgtgt

SEQ ID NO: 957800 - DNA, 25 bp, Mus musculus
gtcttcaaagacttgaatgttgtgt

SEQ ID NO: 957801 - DNA, 25 bp, Mus musculus
gtcttcaacattgacgatcataaag

SEQ ID NO: 957802 - DNA, 25 bp, Mus musculus
gtcttcaacattgaggatcataaag

SEQ ID NO: 957803 - DNA, 25 bp, Mus musculus
gtcttcaccacactgataatatgca

SEQ ID NO: 957804 - DNA, 25 bp, Mus musculus
gtcttcaccacagtgataatatgca

SEQ ID NO: 957805 - DNA, 25 bp, Mus musculus
gtcttcagagcacgtacggatgctg

SEQ ID NO: 957806 - DNA, 25 bp, Mus musculus
gtcttcagagcaggtacggatgctg

SEQ ID NO: 957807 - DNA, 25 bp, Mus musculus
gtcttcagcgccatgggagccgcct

SEQ ID NO: 957808 - DNA, 25 bp, Mus musculus
gtcttcagcggcatgggagccgcct

SEQ ID NO: 957809 - DNA, 25 bp, Mus musculus
gtcttcagtcagcattttacagttt

SEQ ID NO: 957810 - DNA, 25 bp, Mus musculus
gtcttcagtcaggattttacagttt

SEQ ID NO: 957811 - DNA, 25 bp, Mus musculus
gtcttcatgttcgtcattgtgctgt

SEQ ID NO: 957812 - DNA, 25 bp, Mus musculus
gtcttcatgttcgtgattgtgctgt

SEQ ID NO: 957813 - DNA, 25 bp, Mus musculus
gtcttcattcagcttttggcaagcc

SEQ ID NO: 957814 - DNA, 25 bp, Mus musculus
gtcttcattcaggttttggcaagcc

SEQ ID NO: 957815 - DNA, 25 bp, Mus musculus
gtcttccaaaaggctcaaagacttg

SEQ ID NO: 957816 - DNA, 25 bp, Mus musculus
gtcttccaaatggctcaaagacttg

SEQ ID NO: 957817 - DNA, 25 bp, Mus musculus
gtcttccaggactaaagcgcagcag

SEQ ID NO: 957818 - DNA, 25 bp, Mus musculus
gtcttccaggactatagcgcagcag

SEQ ID NO: 957819 - DNA, 25 bp, Mus musculus
gtcttccagtcacagaacaccttct

SEQ ID NO: 957820 - DNA, 25 bp, Mus musculus
gtcttccagtcagagaacaccttct

SEQ ID NO: 957821 - DNA, 25 bp, Mus musculus
gtcttccctagacatggctttcctg

SEQ ID NO: 957822 - DNA, 25 bp, Mus musculus
gtcttccctagagatggctttcctg

SEQ ID NO: 957823 - DNA, 25 bp, Mus musculus
gtcttccgtacacgatggacgtgga

SEQ ID NO: 957824 - DNA, 25 bp, Mus musculus
gtcttccgtacaggatggacgtgga

SEQ ID NO: 957825 - DNA, 25 bp, Mus musculus
gtcttcctatcaaacaagattaaat

SEQ ID NO: 957826 - DNA, 25 bp, Mus musculus
gtcttcctatcacagagtgactcag

SEQ ID NO: 957827 - DNA, 25 bp, Mus musculus
gtcttcctatcacggctcagttctg

SEQ ID NO: 957828 - DNA, 25 bp, Mus musculus
gtcttcctatcagagagtgactcag

SEQ ID NO: 957829 - DNA, 25 bp, Mus musculus
gtcttcctatcagggctcagttctg

SEQ ID NO: 957830 - DNA, 25 bp, Mus musculus
gtcttcctatcatacaagattaaat

SEQ ID NO: 957831 - DNA, 25 bp, Mus musculus
gtcttcctggataacctgtggagca

SEQ ID NO: 957832 - DNA, 25 bp, Mus musculus
gtcttcctggttaacctgtggagca

SEQ ID NO: 957833 - DNA, 25 bp, Mus musculus
gtcttcgatgagacaactctcaata

SEQ ID NO: 957834 - DNA, 25 bp, Mus musculus
gtcttcgatgagtcaactctcaata

SEQ ID NO: 957835 - DNA, 25 bp, Mus musculus
gtcttcgtcaagcgcacactgagag

SEQ ID NO: 957836 - DNA, 25 bp, Mus musculus
gtcttcgtcaagggcacactgagag

SEQ ID NO: 957837 - DNA, 25 bp, Mus musculus
gtcttcgtggagattgatgagaata

SEQ ID NO: 957838 - DNA, 25 bp, Mus musculus
gtcttcgtggagtttgatgagaata

SEQ ID NO: 957839 - DNA, 25 bp, Mus musculus
gtcttcgtgggacatgcagcagggc

SEQ ID NO: 957840 - DNA, 25 bp, Mus musculus
gtcttcgtgggagatgcagcagggc

SEQ ID NO: 957841 - DNA, 25 bp, Mus musculus
gtcttctatgcccaatatctctgta

SEQ ID NO: 957842 - DNA, 25 bp, Mus musculus
gtcttctatggccaatatctctgta

SEQ ID NO: 957843 - DNA, 25 bp, Mus musculus
gtcttctctgcaaacccaggctgtg

SEQ ID NO: 957844 - DNA, 25 bp, Mus musculus
gtcttctctggaaacccaggctgtg

SEQ ID NO: 957845 - DNA, 25 bp, Mus musculus
gtcttctgcaaccacatcttcatta

SEQ ID NO: 957846 - DNA, 25 bp, Mus musculus
gtcttctgcaaccagatcttcatta

SEQ ID NO: 957847 - DNA, 25 bp, Mus musculus
gtcttcttatctctgttgaactctt

SEQ ID NO: 957848 - DNA, 25 bp, Mus musculus
gtcttcttatctgtgttgaactctt

SEQ ID NO: 957849 - DNA, 25 bp, Mus musculus
gtcttgaaggcccacgcggatatct

SEQ ID NO: 957850 - DNA, 25 bp, Mus musculus
gtcttgaaggcccaggcggatatct

SEQ ID NO: 957851 - DNA, 25 bp, Mus musculus
gtcttgattgttgaagatataattg

SEQ ID NO: 957852 - DNA, 25 bp, Mus musculus
gtcttgattgttgatgatataattg

SEQ ID NO: 957853 - DNA, 25 bp, Mus musculus
gtcttgcaggagccacgcatattca

SEQ ID NO: 957854 - DNA, 25 bp, Mus musculus
gtcttgcaggaggcacgcatattca

SEQ ID NO: 957855 - DNA, 25 bp, Mus musculus
gtcttgcctgcaaggaagcggtgcg

SEQ ID NO: 957856 - DNA, 25 bp, Mus musculus
gtcttgcctgcatggaagcggtgcg

SEQ ID NO: 957857 - DNA, 25 bp, Mus musculus
gtcttgcctttgctcacctagagag

SEQ ID NO: 957858 - DNA, 25 bp, Mus musculus
gtcttgcctttggtcacctagagag

SEQ ID NO: 957859 - DNA, 25 bp, Mus musculus
gtcttgcgtgagtgcagttggctgg

SEQ ID NO: 957860 - DNA, 25 bp, Mus musculus
gtcttgcgtgtgtgcagttggctgg

SEQ ID NO: 957861 - DNA, 25 bp, Mus musculus
gtcttgctagcaccaatcatctggg

SEQ ID NO: 957862 - DNA, 25 bp, Mus musculus
gtcttgctagcagcaatcatctggg

SEQ ID NO: 957863 - DNA, 25 bp, Mus musculus
gtcttggaagagagcacatccttta

SEQ ID NO: 957864 - DNA, 25 bp, Mus musculus
gtcttggaagagtgcacatccttta

SEQ ID NO: 957865 - DNA, 25 bp, Mus musculus
gtcttggctccacctttagttgccc

SEQ ID NO: 957866 - DNA, 25 bp, Mus musculus
gtcttggctccagctttagttgccc

SEQ ID NO: 957867 - DNA, 25 bp, Mus musculus
gtcttgggcctgcgcccatacccac

SEQ ID NO: 957868 - DNA, 25 bp, Mus musculus
gtcttgggcctgggcccatacccac

SEQ ID NO: 957869 - DNA, 25 bp, Mus musculus
gtcttgtttaagattgacgagtatg

SEQ ID NO: 957870 - DNA, 25 bp, Mus musculus
gtcttgtttaagtttgacgagtatg

SEQ ID NO: 957871 - DNA, 25 bp, Mus musculus
gtcttgtttgctatcatctctttca

SEQ ID NO: 957872 - DNA, 25 bp, Mus musculus
gtcttgtttgctatgatctctttca

SEQ ID NO: 957873 - DNA, 25 bp, Mus musculus
gtctttaagaacaacgacaacatcc

SEQ ID NO: 957874 - DNA, 25 bp, Mus musculus
gtctttaagaacaactactgaaagt

SEQ ID NO: 957875 - DNA, 25 bp, Mus musculus
gtctttaagaacaaggacaacatcc

SEQ ID NO: 957876 - DNA, 25 bp, Mus musculus
gtctttaagaacaagtactgaaagt

SEQ ID NO: 957877 - DNA, 25 bp, Mus musculus
gtctttaaggactctaatagatgct

SEQ ID NO: 957878 - DNA, 25 bp, Mus musculus
gtctttaaggaggtgctgatcggcg

SEQ ID NO: 957879 - DNA, 25 bp, Mus musculus
gtctttaaggtctctaatagatgct

SEQ ID NO: 957880 - DNA, 25 bp, Mus musculus
gtctttaaggtggtgctgatcggcg

SEQ ID NO: 957881 - DNA, 25 bp, Mus musculus
gtctttacagaatgtaggccatgga

SEQ ID NO: 957882 - DNA, 25 bp, Mus musculus
gtctttacagtatgtaggccatgga

SEQ ID NO: 957883 - DNA, 25 bp, Mus musculus
gtctttagaaagaaccatgtctgct

SEQ ID NO: 957884 - DNA, 25 bp, Mus musculus
gtctttagaaagaagcatgtctgct

SEQ ID NO: 957885 - DNA, 25 bp, Mus musculus
gtctttcaagtcaacaccttgtcgc

SEQ ID NO: 957886 - DNA, 25 bp, Mus musculus
gtctttcaagtcaagaccttgtcgc

SEQ ID NO: 957887 - DNA, 25 bp, Mus musculus
gtctttgaaaaactgcccactaggt

SEQ ID NO: 957888 - DNA, 25 bp, Mus musculus
gtctttgaaaaagtgcccactaggt

SEQ ID NO: 957889 - DNA, 25 bp, Mus musculus
gtctttgaatacgtccacactgatt

SEQ ID NO: 957890 - DNA, 25 bp, Mus musculus
gtctttgaatacgtgcacactgatt

SEQ ID NO: 957891 - DNA, 25 bp, Mus musculus
gtctttgacaagcatgggaatggct

SEQ ID NO: 957892 - DNA, 25 bp, Mus musculus
gtctttgacaaggatgggaatggct

SEQ ID NO: 957893 - DNA, 25 bp, Mus musculus
gtctttgagcagctcagattgctga

SEQ ID NO: 957894 - DNA, 25 bp, Mus musculus
gtctttgagcaggtcagattgctga

SEQ ID NO: 957895 - DNA, 25 bp, Mus musculus
gtctttgattcactagagtcttgca

SEQ ID NO: 957896 - DNA, 25 bp, Mus musculus
gtctttgattcacttgagtcttgca

SEQ ID NO: 957897 - DNA, 25 bp, Mus musculus
gtctttgcgattctaccaagacttc

SEQ ID NO: 957898 - DNA, 25 bp, Mus musculus
gtctttgcgattgtaccaagacttc

SEQ ID NO: 957899 - DNA, 25 bp, Mus musculus
gtctttgcggccgtgctggtcacca

SEQ ID NO: 957900 - DNA, 25 bp, Mus musculus
gtctttgcggctgcctggctgagga

SEQ ID NO: 957901 - DNA, 25 bp, Mus musculus
gtctttgcgggcgtgctggtcacca

SEQ ID NO: 957902 - DNA, 25 bp, Mus musculus
gtctttgcgggtgcctggctgagga

SEQ ID NO: 957903 - DNA, 25 bp, Mus musculus
gtctttgctgacaaccggtttgctc

SEQ ID NO: 957904 - DNA, 25 bp, Mus musculus
gtctttgctgacaagcggtttgctc

SEQ ID NO: 957905 - DNA, 25 bp, Mus musculus
gtctttgctgagcaccggtactatg

SEQ ID NO: 957906 - DNA, 25 bp, Mus musculus
gtctttgctgagcagcggtactatg

SEQ ID NO: 957907 - DNA, 25 bp, Mus musculus
gtctttggagagctcaaagagaagc

SEQ ID NO: 957908 - DNA, 25 bp, Mus musculus
gtctttggagaggtcaaagagaagc

SEQ ID NO: 957909 - DNA, 25 bp, Mus musculus
gtctttggagcgtggaagagcagag

SEQ ID NO: 957910 - DNA, 25 bp, Mus musculus
gtctttggagggtggaagagcagag

SEQ ID NO: 957911 - DNA, 25 bp, Mus musculus
gtgaaaaacaatcggttgatcagag

SEQ ID NO: 957912 - DNA, 25 bp, Mus musculus
gtgaaaaacaatgggttgatcagag

SEQ ID NO: 957913 - DNA, 25 bp, Mus musculus
gtgaaaaaggttcacgtgttcttag

SEQ ID NO: 957914 - DNA, 25 bp, Mus musculus
gtgaaaaaggttcaggtgttcttag

SEQ ID NO: 957915 - DNA, 25 bp, Mus musculus
gtgaaaacctccttgtttctggggc

SEQ ID NO: 957916 - DNA, 25 bp, Mus musculus
gtgaaaacctgcttgtttctggggc

SEQ ID NO: 957917 - DNA, 25 bp, Mus musculus
gtgaaacaagagaacatcctgatct

SEQ ID NO: 957918 - DNA, 25 bp, Mus musculus
gtgaaacaagagaagatcctgatct

SEQ ID NO: 957919 - DNA, 25 bp, Mus musculus
gtgaaacccgagatcaatgctcgcc

SEQ ID NO: 957920 - DNA, 25 bp, Mus musculus
gtgaaacccgagttcaatgctcgcc

SEQ ID NO: 957921 - DNA, 25 bp, Mus musculus
gtgaaactcttacgtgtgtgtgccg

SEQ ID NO: 957922 - DNA, 25 bp, Mus musculus
gtgaaactcttaggtgtgtgtgccg

SEQ ID NO: 957923 - DNA, 25 bp, Mus musculus
gtgaaacttgatgattttggtgtaa

SEQ ID NO: 957924 - DNA, 25 bp, Mus musculus
gtgaaacttgttgattttggtgtaa

SEQ ID NO: 957925 - DNA, 25 bp, Mus musculus
gtgaaagaaaagagggtgcctgaga

SEQ ID NO: 957926 - DNA, 25 bp, Mus musculus
gtgaaagaaaagtgggtgcctgaga

SEQ ID NO: 957927 - DNA, 25 bp, Mus musculus
gtgaaagcttcacctctttccgggt

SEQ ID NO: 957928 - DNA, 25 bp, Mus musculus
gtgaaagcttcagctctttccgggt

SEQ ID NO: 957929 - DNA, 25 bp, Mus musculus
gtgaaaggtgtgctcgtgcgatgca

SEQ ID NO: 957930 - DNA, 25 bp, Mus musculus
gtgaaaggtgtgctggtgcgatgca

SEQ ID NO: 957931 - DNA, 25 bp, Mus musculus
gtgaaatgtccacgttgctacaaga

SEQ ID NO: 957932 - DNA, 25 bp, Mus musculus
gtgaaatgtccaggttgctacaaga

SEQ ID NO: 957933 - DNA, 25 bp, Mus musculus
gtgaaattaaagcgtacacttgatg

SEQ ID NO: 957934 - DNA, 25 bp, Mus musculus
gtgaaattaaagggtacacttgatg

SEQ ID NO: 957935 - DNA, 25 bp, Mus musculus
gtgaaattgccacgttctacaaact

SEQ ID NO: 957936 - DNA, 25 bp, Mus musculus
gtgaaattgccaggttctacaaact

SEQ ID NO: 957937 - DNA, 25 bp, Mus musculus
gtgaaattgtgaaacaggtcctgta

SEQ ID NO: 957938 - DNA, 25 bp, Mus musculus
gtgaaattgtgaaagaggtcctgta

SEQ ID NO: 957939 - DNA, 25 bp, Mus musculus
gtgaacaaagagaattccaaggctg

SEQ ID NO: 957940 - DNA, 25 bp, Mus musculus
gtgaacaaagctgaactctctgtga

SEQ ID NO: 957941 - DNA, 25 bp, Mus musculus
gtgaacaaaggtgaactctctgtga

SEQ ID NO: 957942 - DNA, 25 bp, Mus musculus
gtgaacaaagtgaattccaaggctg

SEQ ID NO: 957943 - DNA, 25 bp, Mus musculus
gtgaacaagctgcggcaccagaaga

SEQ ID NO: 957944 - DNA, 25 bp, Mus musculus
gtgaacaagctggggcaccagaaga

SEQ ID NO: 957945 - DNA, 25 bp, Mus musculus
gtgaacacagaaatcccttcactcc

SEQ ID NO: 957946 - DNA, 25 bp, Mus musculus
gtgaacacagcgggcttccgaagtc

SEQ ID NO: 957947 - DNA, 25 bp, Mus musculus
gtgaacacagggggcttccgaagtc

SEQ ID NO: 957948 - DNA, 25 bp, Mus musculus
gtgaacacagtaatcccttcactcc

SEQ ID NO: 957949 - DNA, 25 bp, Mus musculus
gtgaacactgagcgctgcatggaga

SEQ ID NO: 957950 - DNA, 25 bp, Mus musculus
gtgaacactgagggctgcatggaga

SEQ ID NO: 957951 - DNA, 25 bp, Mus musculus
gtgaacactgccaacgtggagcctg

SEQ ID NO: 957952 - DNA, 25 bp, Mus musculus
gtgaacactgccaaggtggagcctg

SEQ ID NO: 957953 - DNA, 25 bp, Mus musculus
gtgaacagttaaaagcatgctagtg

SEQ ID NO: 957954 - DNA, 25 bp, Mus musculus
gtgaacagttcaaattccatcaagc

SEQ ID NO: 957955 - DNA, 25 bp, Mus musculus
gtgaacagttgaaattccatcaagc

SEQ ID NO: 957956 - DNA, 25 bp, Mus musculus
gtgaacagtttaaagcatgctagtg

SEQ ID NO: 957957 - DNA, 25 bp, Mus musculus
gtgaacatcatgcacgccaagtgga

SEQ ID NO: 957958 - DNA, 25 bp, Mus musculus
gtgaacatcatgcaggccaagtgga

SEQ ID NO: 957959 - DNA, 25 bp, Mus musculus
gtgaaccataaaaacattattagct

SEQ ID NO: 957960 - DNA, 25 bp, Mus musculus
gtgaaccataaaaagattattagct

SEQ ID NO: 957961 - DNA, 25 bp, Mus musculus
gtgaacccaagacacttctctaccc

SEQ ID NO: 957962 - DNA, 25 bp, Mus musculus
gtgaacccaagagacttctctaccc

SEQ ID NO: 957963 - DNA, 25 bp, Mus musculus
gtgaacctcacacatgaaacaggag

SEQ ID NO: 957964 - DNA, 25 bp, Mus musculus
gtgaacctcacagatgaaacaggag

SEQ ID NO: 957965 - DNA, 25 bp, Mus musculus
gtgaacctgaaacgcaaaggacatg

SEQ ID NO: 957966 - DNA, 25 bp, Mus musculus
gtgaacctgaaaggcaaaggacatg

SEQ ID NO: 957967 - DNA, 25 bp, Mus musculus
gtgaacctgcaacttgcttgtatgc

SEQ ID NO: 957968 - DNA, 25 bp, Mus musculus
gtgaacctgcaagttgcttgtatgc

SEQ ID NO: 957969 - DNA, 25 bp, Mus musculus
gtgaacgctcagcacactccgttgg

SEQ ID NO: 957970 - DNA, 25 bp, Mus musculus
gtgaacgctcagcagactccgttgg

SEQ ID NO: 957971 - DNA, 25 bp, Mus musculus
gtgaacgtcacacgcatatatcgag

SEQ ID NO: 957972 - DNA, 25 bp, Mus musculus
gtgaacgtcacaggcatatatcgag

SEQ ID NO: 957973 - DNA, 25 bp, Mus musculus
gtgaactcagagtgaccacatctga

SEQ ID NO: 957974 - DNA, 25 bp, Mus musculus
gtgaactcagtgtgaccacatctga

SEQ ID NO: 957975 - DNA, 25 bp, Mus musculus
gtgaactctcagatagtcaccacag

SEQ ID NO: 957976 - DNA, 25 bp, Mus musculus
gtgaactctcagttagtcaccacag

SEQ ID NO: 957977 - DNA, 25 bp, Mus musculus
gtgaactgcattcacgacaggggtc

SEQ ID NO: 957978 - DNA, 25 bp, Mus musculus
gtgaactgcattcaggacaggggtc

SEQ ID NO: 957979 - DNA, 25 bp, Mus musculus
gtgaactgttcacacgcctccttgg

SEQ ID NO: 957980 - DNA, 25 bp, Mus musculus
gtgaactgttcagacgcctccttgg

SEQ ID NO: 957981 - DNA, 25 bp, Mus musculus
gtgaagaaagccccacgcctactct

SEQ ID NO: 957982 - DNA, 25 bp, Mus musculus
gtgaagaaaggcccacgcctactct

SEQ ID NO: 957983 - DNA, 25 bp, Mus musculus
gtgaagaaccagcgccagtgcgggt

SEQ ID NO: 957984 - DNA, 25 bp, Mus musculus
gtgaagaaccagggccagtgcgggt

SEQ ID NO: 957985 - DNA, 25 bp, Mus musculus
gtgaagaagtggcgtgccgccatgc

SEQ ID NO: 957986 - DNA, 25 bp, Mus musculus
gtgaagaagtggggtgccgccatgc

SEQ ID NO: 957987 - DNA, 25 bp, Mus musculus
gtgaagagccagcttgggcctggat

SEQ ID NO: 957988 - DNA, 25 bp, Mus musculus
gtgaagagccaggttgggcctggat

SEQ ID NO: 957989 - DNA, 25 bp, Mus musculus
gtgaagatccagaacccaggtgttg

SEQ ID NO: 957990 - DNA, 25 bp, Mus musculus
gtgaagatccagtacccaggtgttg

SEQ ID NO: 957991 - DNA, 25 bp, Mus musculus
gtgaagatggagagcttccctatgg

SEQ ID NO: 957992 - DNA, 25 bp, Mus musculus
gtgaagatggagtgcttccctatgg

SEQ ID NO: 957993 - DNA, 25 bp, Mus musculus
gtgaagattcagccttgttccccct

SEQ ID NO: 957994 - DNA, 25 bp, Mus musculus
gtgaagattcaggcttgttccccct

SEQ ID NO: 957995 - DNA, 25 bp, Mus musculus
gtgaagccagccaaagttataaata

SEQ ID NO: 957996 - DNA, 25 bp, Mus musculus
gtgaagccaggcaaagttataaata

SEQ ID NO: 957997 - DNA, 25 bp, Mus musculus
gtgaagcccaagcctccagaacccg

SEQ ID NO: 957998 - DNA, 25 bp, Mus musculus
gtgaagcccaaggctccagaacccg

SEQ ID NO: 957999 - DNA, 25 bp, Mus musculus
gtgaagcccgacctcacatgccttc

SEQ ID NO: 958000 - DNA, 25 bp, Mus musculus
gtgaagcccgacctgacatgccttc

SEQ ID NO: 958001 - DNA, 25 bp, Mus musculus
gtgaagcccgccaacaaggaacgcg

SEQ ID NO: 958002 - DNA, 25 bp, Mus musculus
gtgaagcccggcaacaaggaacgcg

SEQ ID NO: 958003 - DNA, 25 bp, Mus musculus
gtgaagcctgctcgtcctacagtgg

SEQ ID NO: 958004 - DNA, 25 bp, Mus musculus
gtgaagcctgctggtcctacagtgg

SEQ ID NO: 958005 - DNA, 25 bp, Mus musculus
gtgaagcgagctcacagagagtgca

SEQ ID NO: 958006 - DNA, 25 bp, Mus musculus
gtgaagcgaggtcacagagagtgca

SEQ ID NO: 958007 - DNA, 25 bp, Mus musculus
gtgaagctcgcaaacgctggcaaaa

SEQ ID NO: 958008 - DNA, 25 bp, Mus musculus
gtgaagctcgcaaaggctggcaaaa

SEQ ID NO: 958009 - DNA, 25 bp, Mus musculus
gtgaagctgaaaaaccctgtagatt

SEQ ID NO: 958010 - DNA, 25 bp, Mus musculus
gtgaagctgaaaaagcctgtagatt

SEQ ID NO: 958011 - DNA, 25 bp, Mus musculus
gtgaagcttcagatctgggacactg

SEQ ID NO: 958012 - DNA, 25 bp, Mus musculus
gtgaagcttcagttctgggacactg

SEQ ID NO: 958013 - DNA, 25 bp, Mus musculus
gtgaaggaagccaagatctcagagt

SEQ ID NO: 958014 - DNA, 25 bp, Mus musculus
gtgaaggaaggcaagatctcagagt

SEQ ID NO: 958015 - DNA, 25 bp, Mus musculus
gtgaaggacaagcaccccgagctcc

SEQ ID NO: 958016 - DNA, 25 bp, Mus musculus
gtgaaggacaaggaccccgagctcc

SEQ ID NO: 958017 - DNA, 25 bp, Mus musculus
gtgaaggcaaggctagtgacagtga

SEQ ID NO: 958018 - DNA, 25 bp, Mus musculus
gtgaaggcaagggtagtgacagtga

SEQ ID NO: 958019 - DNA, 25 bp, Mus musculus
gtgaaggccgggaactgactcgtgt

SEQ ID NO: 958020 - DNA, 25 bp, Mus musculus
gtgaaggccgggaagtgactcgtgt

SEQ ID NO: 958021 - DNA, 25 bp, Mus musculus
gtgaaggctcatcacgtgaaaaatc

SEQ ID NO: 958022 - DNA, 25 bp, Mus musculus
gtgaaggctcatcaggtgaaaaatc

SEQ ID NO: 958023 - DNA, 25 bp, Mus musculus
gtgaaggtcatgagatcagcccttg

SEQ ID NO: 958024 - DNA, 25 bp, Mus musculus
gtgaaggtcatgtgatcagcccttg

SEQ ID NO: 958025 - DNA, 25 bp, Mus musculus
gtgaaggtgttcaaagtcaccaggg

SEQ ID NO: 958026 - DNA, 25 bp, Mus musculus
gtgaaggtgttcaatgtcaccaggg

SEQ ID NO: 958027 - DNA, 25 bp, Mus musculus
gtgaagtcattcaattctggaacaa

SEQ ID NO: 958028 - DNA, 25 bp, Mus musculus
gtgaagtcattctattctggaacaa

SEQ ID NO: 958029 - DNA, 25 bp, Mus musculus
gtgaagtccaagctggaggcattcc

SEQ ID NO: 958030 - DNA, 25 bp, Mus musculus
gtgaagtccaaggtggaggcattcc

SEQ ID NO: 958031 - DNA, 25 bp, Mus musculus
gtgaagtgctctcgtcctcctcctc

SEQ ID NO: 958032 - DNA, 25 bp, Mus musculus
gtgaagtgctctggtcctcctcctc

SEQ ID NO: 958033 - DNA, 25 bp, Mus musculus
gtgaagtttattcacattgatatct

SEQ ID NO: 958034 - DNA, 25 bp, Mus musculus
gtgaagtttattcagattgatatct

SEQ ID NO: 958035 - DNA, 25 bp, Mus musculus
gtgaatacagcgacagtgatgaaaa

SEQ ID NO: 958036 - DNA, 25 bp, Mus musculus
gtgaatacagggacagtgatgaaaa

SEQ ID NO: 958037 - DNA, 25 bp, Mus musculus
gtgaatatagcaaggaagagagagt

SEQ ID NO: 958038 - DNA, 25 bp, Mus musculus
gtgaatataggaaggaagagagagt

SEQ ID NO: 958039 - DNA, 25 bp, Mus musculus
gtgaatatctctgttgtgaattcca

SEQ ID NO: 958040 - DNA, 25 bp, Mus musculus
gtgaatatctgtgttgtgaattcca

SEQ ID NO: 958041 - DNA, 25 bp, Mus musculus
gtgaatcagagaccctgccatatcc

SEQ ID NO: 958042 - DNA, 25 bp, Mus musculus
gtgaatcagagagcctgccatatcc

SEQ ID NO: 958043 - DNA, 25 bp, Mus musculus
gtgaatcatagtagtgacccaaatc

SEQ ID NO: 958044 - DNA, 25 bp, Mus musculus
gtgaatcatagttgtgacccaaatc

SEQ ID NO: 958045 - DNA, 25 bp, Mus musculus
gtgaatccagctttgatctgtggat

SEQ ID NO: 958046 - DNA, 25 bp, Mus musculus
gtgaatccaggtttgatctgtggat

SEQ ID NO: 958047 - DNA, 25 bp, Mus musculus
gtgaatccatcgctacaagcaataa

SEQ ID NO: 958048 - DNA, 25 bp, Mus musculus
gtgaatccatcggtacaagcaataa

SEQ ID NO: 958049 - DNA, 25 bp, Mus musculus
gtgaatcctcagctgcagagtccag

SEQ ID NO: 958050 - DNA, 25 bp, Mus musculus
gtgaatcctcaggtgcagagtccag

SEQ ID NO: 958051 - DNA, 25 bp, Mus musculus
gtgaatcctcttcgttcagacaatg

SEQ ID NO: 958052 - DNA, 25 bp, Mus musculus
gtgaatcctcttggttcagacaatg

SEQ ID NO: 958053 - DNA, 25 bp, Mus musculus
gtgaatctgtatcccatgctgagag

SEQ ID NO: 958054 - DNA, 25 bp, Mus musculus
gtgaatctgtttcccatgctgagag

SEQ ID NO: 958055 - DNA, 25 bp, Mus musculus
gtgaatgcacagacgtggacgaatg

SEQ ID NO: 958056 - DNA, 25 bp, Mus musculus
gtgaatgcacagtcgtggacgaatg

SEQ ID NO: 958057 - DNA, 25 bp, Mus musculus
gtgaatgccaagccttacaatggaa

SEQ ID NO: 958058 - DNA, 25 bp, Mus musculus
gtgaatgccaaggcttacaatggaa

SEQ ID NO: 958059 - DNA, 25 bp, Mus musculus
gtgaatgtcacacatgccatctcat

SEQ ID NO: 958060 - DNA, 25 bp, Mus musculus
gtgaatgtcacagatgccatctcat

SEQ ID NO: 958061 - DNA, 25 bp, Mus musculus
gtgaatttagccagtgtcttgagct

SEQ ID NO: 958062 - DNA, 25 bp, Mus musculus
gtgaatttagcctgtgtcttgagct

SEQ ID NO: 958063 - DNA, 25 bp, Mus musculus
gtgacaaaagatataaacaggatgg

SEQ ID NO: 958064 - DNA, 25 bp, Mus musculus
gtgacaaaagatttaaacaggatgg

SEQ ID NO: 958065 - DNA, 25 bp, Mus musculus
gtgacaaaatagcaatgatcgagat

SEQ ID NO: 958066 - DNA, 25 bp, Mus musculus
gtgacaaaataggaatgatcgagat

SEQ ID NO: 958067 - DNA, 25 bp, Mus musculus
gtgacaaatgtgaacgccgaggtgg

SEQ ID NO: 958068 - DNA, 25 bp, Mus musculus
gtgacaaatgtgaaggccgaggtgg

SEQ ID NO: 958069 - DNA, 25 bp, Mus musculus
gtgacaaggaacagctgcaggcagg

SEQ ID NO: 958070 - DNA, 25 bp, Mus musculus
gtgacaaggaactgctgcaggcagg

SEQ ID NO: 958071 - DNA, 25 bp, Mus musculus
gtgacaagggagaattcggtggctt

SEQ ID NO: 958072 - DNA, 25 bp, Mus musculus
gtgacaagggagcgaaaattgaatg

SEQ ID NO: 958073 - DNA, 25 bp, Mus musculus
gtgacaagggagggaaaattgaatg

SEQ ID NO: 958074 - DNA, 25 bp, Mus musculus
gtgacaagggagtattcggtggctt

SEQ ID NO: 958075 - DNA, 25 bp, Mus musculus
gtgacaaggtctgcttacagacaca

SEQ ID NO: 958076 - DNA, 25 bp, Mus musculus
gtgacaaggtgtgcttacagacaca

SEQ ID NO: 958077 - DNA, 25 bp, Mus musculus
gtgacaatatctcgcaaaaaggata

SEQ ID NO: 958078 - DNA, 25 bp, Mus musculus
gtgacaatatctggcaaaaaggata

SEQ ID NO: 958079 - DNA, 25 bp, Mus musculus
gtgacaatccccagtaaggagactc

SEQ ID NO: 958080 - DNA, 25 bp, Mus musculus
gtgacaatcccctgtaaggagactc

SEQ ID NO: 958081 - DNA, 25 bp, Mus musculus
gtgacaatgtcccacatccagatca

SEQ ID NO: 958082 - DNA, 25 bp, Mus musculus
gtgacaatgtcccagatccagatca

SEQ ID NO: 958083 - DNA, 25 bp, Mus musculus
gtgacaattaagattgatcctgaat

SEQ ID NO: 958084 - DNA, 25 bp, Mus musculus
gtgacaattaagtttgatcctgaat

SEQ ID NO: 958085 - DNA, 25 bp, Mus musculus
gtgacaccagcacacatagactgcc

SEQ ID NO: 958086 - DNA, 25 bp, Mus musculus
gtgacaccagcagacatagactgcc

SEQ ID NO: 958087 - DNA, 25 bp, Mus musculus
gtgacaccctttcagttgaaacttc

SEQ ID NO: 958088 - DNA, 25 bp, Mus musculus
gtgacaccctttgagttgaaacttc

SEQ ID NO: 958089 - DNA, 25 bp, Mus musculus
gtgacacctaagctgaaggcgataa

SEQ ID NO: 958090 - DNA, 25 bp, Mus musculus
gtgacacctaaggtgaaggcgataa

SEQ ID NO: 958091 - DNA, 25 bp, Mus musculus
gtgacagatcagcagtccttcaata

SEQ ID NO: 958092 - DNA, 25 bp, Mus musculus
gtgacagatcaggagtccttcaata

SEQ ID NO: 958093 - DNA, 25 bp, Mus musculus
gtgacagtcgcacataatgagaagg

SEQ ID NO: 958094 - DNA, 25 bp, Mus musculus
gtgacagtcgcagataatgagaagg

SEQ ID NO: 958095 - DNA, 25 bp, Mus musculus
gtgacatacgatcaggactaccagg

SEQ ID NO: 958096 - DNA, 25 bp, Mus musculus
gtgacatacgatgaggactaccagg

SEQ ID NO: 958097 - DNA, 25 bp, Mus musculus
gtgacatactggcgtgagcatgcca

SEQ ID NO: 958098 - DNA, 25 bp, Mus musculus
gtgacatactggggtgagcatgcca

SEQ ID NO: 958099 - DNA, 25 bp, Mus musculus
gtgacatcaaccgacgagtacttgg

SEQ ID NO: 958100 - DNA, 25 bp, Mus musculus
gtgacatcaaccgaggagtacttgg

SEQ ID NO: 958101 - DNA, 25 bp, Mus musculus
gtgacatcacagcacgtgcaggctt

SEQ ID NO: 958102 - DNA, 25 bp, Mus musculus
gtgacatcacagcaggtgcaggctt

SEQ ID NO: 958103 - DNA, 25 bp, Mus musculus
gtgacatcacagctggtgaatgagc

SEQ ID NO: 958104 - DNA, 25 bp, Mus musculus
gtgacatcacaggtggtgaatgagc

SEQ ID NO: 958105 - DNA, 25 bp, Mus musculus
gtgacatcctagacaacaacgggac

SEQ ID NO: 958106 - DNA, 25 bp, Mus musculus
gtgacatcctagtcaacaacgggac

SEQ ID NO: 958107 - DNA, 25 bp, Mus musculus
gtgacatctgtacgatagcccagag

SEQ ID NO: 958108 - DNA, 25 bp, Mus musculus
gtgacatctgtaggatagcccagag

SEQ ID NO: 958109 - DNA, 25 bp, Mus musculus
gtgacatggatgcctcccgtcattt

SEQ ID NO: 958110 - DNA, 25 bp, Mus musculus
gtgacatggatggctcccgtcattt

SEQ ID NO: 958111 - DNA, 25 bp, Mus musculus
gtgacattccacaacattgtgaaat

SEQ ID NO: 958112 - DNA, 25 bp, Mus musculus
gtgacattccacaagattgtgaaat

SEQ ID NO: 958113 - DNA, 25 bp, Mus musculus
gtgaccaagaccaggatggggatgg

SEQ ID NO: 958114 - DNA, 25 bp, Mus musculus
gtgaccaagacctggatggggatgg

SEQ ID NO: 958115 - DNA, 25 bp, Mus musculus
gtgaccaccacactgctccgatgtc

SEQ ID NO: 958116 - DNA, 25 bp, Mus musculus
gtgaccaccacagtgctccgatgtc

SEQ ID NO: 958117 - DNA, 25 bp, Mus musculus
gtgaccaccatgagaacaagtactt

SEQ ID NO: 958118 - DNA, 25 bp, Mus musculus
gtgaccaccatgtgaacaagtactt

SEQ ID NO: 958119 - DNA, 25 bp, Mus musculus
gtgaccagcctacaccactgggaat

SEQ ID NO: 958120 - DNA, 25 bp, Mus musculus
gtgaccagcctacagcactgggaat

SEQ ID NO: 958121 - DNA, 25 bp, Mus musculus
gtgaccatagagccgcaaacagggc

SEQ ID NO: 958122 - DNA, 25 bp, Mus musculus
gtgaccatagaggcgcaaacagggc

SEQ ID NO: 958123 - DNA, 25 bp, Mus musculus
gtgaccatggaagcgtatttgatag

SEQ ID NO: 958124 - DNA, 25 bp, Mus musculus
gtgaccatggatccaccagtgagtg

SEQ ID NO: 958125 - DNA, 25 bp, Mus musculus
gtgaccatggatcctccagtgagtg

SEQ ID NO: 958126 - DNA, 25 bp, Mus musculus
gtgaccatggtagcgtatttgatag

SEQ ID NO: 958127 - DNA, 25 bp, Mus musculus
gtgaccattgagcaagaactatgtc

SEQ ID NO: 958128 - DNA, 25 bp, Mus musculus
gtgaccattgagcttatctggctgt

SEQ ID NO: 958129 - DNA, 25 bp, Mus musculus
gtgaccattgaggaagaactatgtc

SEQ ID NO: 958130 - DNA, 25 bp, Mus musculus
gtgaccattgaggttatctggctgt

SEQ ID NO: 958131 - DNA, 25 bp, Mus musculus
gtgaccccctggcaggacactactg

SEQ ID NO: 958132 - DNA, 25 bp, Mus musculus
gtgaccccctgggaggacactactg

SEQ ID NO: 958133 - DNA, 25 bp, Mus musculus
gtgacccctgcagacgtcaccaagc

SEQ ID NO: 958134 - DNA, 25 bp, Mus musculus
gtgacccctgcagaggtcaccaagc

SEQ ID NO: 958135 - DNA, 25 bp, Mus musculus
gtgacccgcaagcatcactgccgag

SEQ ID NO: 958136 - DNA, 25 bp, Mus musculus
gtgacccgcaaggatcactgccgag

SEQ ID NO: 958137 - DNA, 25 bp, Mus musculus
gtgaccctcctgcagcaactggtga

SEQ ID NO: 958138 - DNA, 25 bp, Mus musculus
gtgaccctcctggagcaactggtga

SEQ ID NO: 958139 - DNA, 25 bp, Mus musculus
gtgaccctgcctactgatgacactc

SEQ ID NO: 958140 - DNA, 25 bp, Mus musculus
gtgaccctgccttctgatgacactc

SEQ ID NO: 958141 - DNA, 25 bp, Mus musculus
gtgacctgcttgcttcaactggaga

SEQ ID NO: 958142 - DNA, 25 bp, Mus musculus
gtgacctgcttggttcaactggaga

SEQ ID NO: 958143 - DNA, 25 bp, Mus musculus
gtgacctgggatggattcatgggtg

SEQ ID NO: 958144 - DNA, 25 bp, Mus musculus
gtgacctgggttggattcatgggtg

SEQ ID NO: 958145 - DNA, 25 bp, Mus musculus
gtgaccttcgcgaggatgcaaccgc

SEQ ID NO: 958146 - DNA, 25 bp, Mus musculus
gtgaccttcgggaggatgcaaccgc

SEQ ID NO: 958147 - DNA, 25 bp, Mus musculus
gtgaccttgtacagcgaccctcatg

SEQ ID NO: 958148 - DNA, 25 bp, Mus musculus
gtgaccttgtacagggaccctcatg

SEQ ID NO: 958149 - DNA, 25 bp, Mus musculus
gtgacgaaagctctgtcacctaaag

SEQ ID NO: 958150 - DNA, 25 bp, Mus musculus
gtgacgaaaggtctgtcacctaaag

SEQ ID NO: 958151 - DNA, 25 bp, Mus musculus
gtgacgagtcctatcgtgaaggctg

SEQ ID NO: 958152 - DNA, 25 bp, Mus musculus
gtgacgagtcctatggtgaaggctg

SEQ ID NO: 958153 - DNA, 25 bp, Mus musculus
gtgacgcaaaagcccaaatcatgga

SEQ ID NO: 958154 - DNA, 25 bp, Mus musculus
gtgacgcaaaaggccaaatcatgga

SEQ ID NO: 958155 - DNA, 25 bp, Mus musculus
gtgacgcgacagaaaccgcccagaa

SEQ ID NO: 958156 - DNA, 25 bp, Mus musculus
gtgacgcgacagcacaccacatgta

SEQ ID NO: 958157 - DNA, 25 bp, Mus musculus
gtgacgcgacaggacaccacatgta

SEQ ID NO: 958158 - DNA, 25 bp, Mus musculus
gtgacgcgacagtaaccgcccagaa

SEQ ID NO: 958159 - DNA, 25 bp, Mus musculus
gtgacggaggctgacatcactggag

SEQ ID NO: 958160 - DNA, 25 bp, Mus musculus
gtgacggaggctgagatcactggag

SEQ ID NO: 958161 - DNA, 25 bp, Mus musculus
gtgacggccacattcattttcctcg

SEQ ID NO: 958162 - DNA, 25 bp, Mus musculus
gtgacggccacattcccctgtcagc

SEQ ID NO: 958163 - DNA, 25 bp, Mus musculus
gtgacggccacattgattttcctcg

SEQ ID NO: 958164 - DNA, 25 bp, Mus musculus
gtgacggccacattgccctgtcagc

SEQ ID NO: 958165 - DNA, 25 bp, Mus musculus
gtgacggtgacaggaggatggagat

SEQ ID NO: 958166 - DNA, 25 bp, Mus musculus
gtgacggtgagaggaggatggagat

SEQ ID NO: 958167 - DNA, 25 bp, Mus musculus
gtgactacctgacgctttttggcac

SEQ ID NO: 958168 - DNA, 25 bp, Mus musculus
gtgactacctgaggctttttggcac

SEQ ID NO: 958169 - DNA, 25 bp, Mus musculus
gtgactactacacgaaacttctgcg

SEQ ID NO: 958170 - DNA, 25 bp, Mus musculus
gtgactactacaggaaacttctgcg

SEQ ID NO: 958171 - DNA, 25 bp, Mus musculus
gtgactatagctgtggattttgcta

SEQ ID NO: 958172 - DNA, 25 bp, Mus musculus
gtgactataggtgtggattttgcta

SEQ ID NO: 958173 - DNA, 25 bp, Mus musculus
gtgactcaagctcgtgtggccagca

SEQ ID NO: 958174 - DNA, 25 bp, Mus musculus
gtgactcaaggtcgtgtggccagca

SEQ ID NO: 958175 - DNA, 25 bp, Mus musculus
gtgactcagacaatcatgaaggcac

SEQ ID NO: 958176 - DNA, 25 bp, Mus musculus
gtgactcagacaatgatgaaggcac

SEQ ID NO: 958177 - DNA, 25 bp, Mus musculus
gtgactccaggacgagcgacagttt

SEQ ID NO: 958178 - DNA, 25 bp, Mus musculus
gtgactccaggacgcttccagcttg

SEQ ID NO: 958179 - DNA, 25 bp, Mus musculus
gtgactccaggaggagcgacagttt

SEQ ID NO: 958180 - DNA, 25 bp, Mus musculus
gtgactccaggaggcttccagcttg

SEQ ID NO: 958181 - DNA, 25 bp, Mus musculus
gtgactcgaagtcacaaacgtggta

SEQ ID NO: 958182 - DNA, 25 bp, Mus musculus
gtgactcgaagtcagaaacgtggta

SEQ ID NO: 958183 - DNA, 25 bp, Mus musculus
gtgactctaaatctgcatttaagcg

SEQ ID NO: 958184 - DNA, 25 bp, Mus musculus
gtgactctaattctgcatttaagcg

SEQ ID NO: 958185 - DNA, 25 bp, Mus musculus
gtgactgaaaaacttccaccaggtg

SEQ ID NO: 958186 - DNA, 25 bp, Mus musculus
gtgactgaaaaagttccaccaggtg

SEQ ID NO: 958187 - DNA, 25 bp, Mus musculus
gtgactgcatcgatcagttttcctg

SEQ ID NO: 958188 - DNA, 25 bp, Mus musculus
gtgactgcatcgcgaagatcagttt

SEQ ID NO: 958189 - DNA, 25 bp, Mus musculus
gtgactgcatcgggaagatcagttt

SEQ ID NO: 958190 - DNA, 25 bp, Mus musculus
gtgactgcatcgttcagttttcctg

SEQ ID NO: 958191 - DNA, 25 bp, Mus musculus
gtgactgcggcgcaaccatgaaggt

SEQ ID NO: 958192 - DNA, 25 bp, Mus musculus
gtgactgcggcggaaccatgaaggt

SEQ ID NO: 958193 - DNA, 25 bp, Mus musculus
gtgactgctcgtcacaatcaggtgg

SEQ ID NO: 958194 - DNA, 25 bp, Mus musculus
gtgactgctcgtcagaatcaggtgg

SEQ ID NO: 958195 - DNA, 25 bp, Mus musculus
gtgactggagcattctgtacccaga

SEQ ID NO: 958196 - DNA, 25 bp, Mus musculus
gtgactggaggattctgtacccaga

SEQ ID NO: 958197 - DNA, 25 bp, Mus musculus
gtgactggcctgcgaggggagcaca

SEQ ID NO: 958198 - DNA, 25 bp, Mus musculus
gtgactggcctgggaggggagcaca

SEQ ID NO: 958199 - DNA, 25 bp, Mus musculus
gtgactgggataaacgattccagca

SEQ ID NO: 958200 - DNA, 25 bp, Mus musculus
gtgactgggataaaggattccagca

SEQ ID NO: 958201 - DNA, 25 bp, Mus musculus
gtgactggtgtcaaccctgagggat

SEQ ID NO: 958202 - DNA, 25 bp, Mus musculus
gtgactggtgtcaacctcccagact

SEQ ID NO: 958203 - DNA, 25 bp, Mus musculus
gtgactggtgtcaagcctgagggat

SEQ ID NO: 958204 - DNA, 25 bp, Mus musculus
gtgactggtgtcaagctcccagact

SEQ ID NO: 958205 - DNA, 25 bp, Mus musculus
gtgactgtgttacatgctcctgaag

SEQ ID NO: 958206 - DNA, 25 bp, Mus musculus
gtgactgtgttacttgaacccacag

SEQ ID NO: 958207 - DNA, 25 bp, Mus musculus
gtgactgtgttagatgctcctgaag

SEQ ID NO: 958208 - DNA, 25 bp, Mus musculus
gtgactgtgttagttgaacccacag

SEQ ID NO: 958209 - DNA, 25 bp, Mus musculus
gtgactgtgttctacactcaagaat

SEQ ID NO: 958210 - DNA, 25 bp, Mus musculus
gtgactgtgttctagactcaagaat

SEQ ID NO: 958211 - DNA, 25 bp, Mus musculus
gtgactgtttcactaatgctgcaac

SEQ ID NO: 958212 - DNA, 25 bp, Mus musculus
gtgactgtttcagtaatgctgcaac

SEQ ID NO: 958213 - DNA, 25 bp, Mus musculus
gtgacttacattcttgaaccagagc

SEQ ID NO: 958214 - DNA, 25 bp, Mus musculus
gtgacttacattgttgaaccagagc

SEQ ID NO: 958215 - DNA, 25 bp, Mus musculus
gtgacttccgtgctgggattttcct

SEQ ID NO: 958216 - DNA, 25 bp, Mus musculus
gtgacttccgtggtgggattttcct

SEQ ID NO: 958217 - DNA, 25 bp, Mus musculus
gtgactttcctccacattgttggtg

SEQ ID NO: 958218 - DNA, 25 bp, Mus musculus
gtgactttcctccagattgttggtg

SEQ ID NO: 958219 - DNA, 25 bp, Mus musculus
gtgagaaaaatttacaatatgacat

SEQ ID NO: 958220 - DNA, 25 bp, Mus musculus
gtgagaaaaatttagaatatgacat

SEQ ID NO: 958221 - DNA, 25 bp, Mus musculus
gtgagaaccagaccatcgtgctgga

SEQ ID NO: 958222 - DNA, 25 bp, Mus musculus
gtgagaaccagacggacagcatcgt

SEQ ID NO: 958223 - DNA, 25 bp, Mus musculus
gtgagaaccagagcatcgtgctgga

SEQ ID NO: 958224 - DNA, 25 bp, Mus musculus
gtgagaaccagagggacagcatcgt

SEQ ID NO: 958225 - DNA, 25 bp, Mus musculus
gtgagaaccgagaaatggcaaaatg

SEQ ID NO: 958226 - DNA, 25 bp, Mus musculus
gtgagaaccgagtaatggcaaaatg

SEQ ID NO: 958227 - DNA, 25 bp, Mus musculus
gtgagaacgtcacgaggctgtcgcg

SEQ ID NO: 958228 - DNA, 25 bp, Mus musculus
gtgagaacgtcaggaggctgtcgcg

SEQ ID NO: 958229 - DNA, 25 bp, Mus musculus
gtgagacagcagcacatagccacca

SEQ ID NO: 958230 - DNA, 25 bp, Mus musculus
gtgagacagcaggacatagccacca

SEQ ID NO: 958231 - DNA, 25 bp, Mus musculus
gtgagaccagctgacaaagtcatcc

SEQ ID NO: 958232 - DNA, 25 bp, Mus musculus
gtgagaccaggtgacaaagtcatcc

SEQ ID NO: 958233 - DNA, 25 bp, Mus musculus
gtgagacctgccggctccacatccc

SEQ ID NO: 958234 - DNA, 25 bp, Mus musculus
gtgagacctggcggctccacatccc

SEQ ID NO: 958235 - DNA, 25 bp, Mus musculus
gtgagagatctgaagcagataaaga

SEQ ID NO: 958236 - DNA, 25 bp, Mus musculus
gtgagagatctgtagcagataaaga

SEQ ID NO: 958237 - DNA, 25 bp, Mus musculus
gtgagagccagacgcactgagagta

SEQ ID NO: 958238 - DNA, 25 bp, Mus musculus
gtgagagccagaggcactgagagta

SEQ ID NO: 958239 - DNA, 25 bp, Mus musculus
gtgagagcttcccgcaggagatggc

SEQ ID NO: 958240 - DNA, 25 bp, Mus musculus
gtgagagcttcccggaggagatggc

SEQ ID NO: 958241 - DNA, 25 bp, Mus musculus
gtgagagttgacggcgtccaacacg

SEQ ID NO: 958242 - DNA, 25 bp, Mus musculus
gtgagagttgagtcctacctgctcc

SEQ ID NO: 958243 - DNA, 25 bp, Mus musculus
gtgagagttgtcggcgtccaacacg

SEQ ID NO: 958244 - DNA, 25 bp, Mus musculus
gtgagagttgtgtcctacctgctcc

SEQ ID NO: 958245 - DNA, 25 bp, Mus musculus
gtgagatgtatcctcgacgctgccc

SEQ ID NO: 958246 - DNA, 25 bp, Mus musculus
gtgagatgtatcctggacgctgccc

SEQ ID NO: 958247 - DNA, 25 bp, Mus musculus
gtgagattgccacattctataagct

SEQ ID NO: 958248 - DNA, 25 bp, Mus musculus
gtgagattgccagattctataagct

SEQ ID NO: 958249 - DNA, 25 bp, Mus musculus
gtgagatttttgaggacagcacatg

SEQ ID NO: 958250 - DNA, 25 bp, Mus musculus
gtgagatttttgtggacagcacatg

SEQ ID NO: 958251 - DNA, 25 bp, Mus musculus
gtgagcacagctccgtcttccagca

SEQ ID NO: 958252 - DNA, 25 bp, Mus musculus
gtgagcacaggtccgtcttccagca

SEQ ID NO: 958253 - DNA, 25 bp, Mus musculus
gtgagcaccaagcacccttctctcc

SEQ ID NO: 958254 - DNA, 25 bp, Mus musculus
gtgagcaccaagcagccttctctcc

SEQ ID NO: 958255 - DNA, 25 bp, Mus musculus
gtgagcacggatgaaaatttttcct

SEQ ID NO: 958256 - DNA, 25 bp, Mus musculus
gtgagcacggttgaaaatttttcct

SEQ ID NO: 958257 - DNA, 25 bp, Mus musculus
gtgagcactgctgtcgtcagccatg

SEQ ID NO: 958258 - DNA, 25 bp, Mus musculus
gtgagcactggtgtcgtcagccatg

SEQ ID NO: 958259 - DNA, 25 bp, Mus musculus
gtgagcagctctgtcctgtattttc

SEQ ID NO: 958260 - DNA, 25 bp, Mus musculus
gtgagcagctctgtcgtttgggctc

SEQ ID NO: 958261 - DNA, 25 bp, Mus musculus
gtgagcagctctgtgctgtattttc

SEQ ID NO: 958262 - DNA, 25 bp, Mus musculus
gtgagcagctctgtggtttgggctc

SEQ ID NO: 958263 - DNA, 25 bp, Mus musculus
gtgagcaggctggacgtctttgcaa

SEQ ID NO: 958264 - DNA, 25 bp, Mus musculus
gtgagcaggctggaggtctttgcaa

SEQ ID NO: 958265 - DNA, 25 bp, Mus musculus
gtgagcagtacacggattgtgcaga

SEQ ID NO: 958266 - DNA, 25 bp, Mus musculus
gtgagcagtacagggattgtgcaga

SEQ ID NO: 958267 - DNA, 25 bp, Mus musculus
gtgagccattagactaggacccatg

SEQ ID NO: 958268 - DNA, 25 bp, Mus musculus
gtgagccatttgactaggacccatg

SEQ ID NO: 958269 - DNA, 25 bp, Mus musculus
gtgagcccagactcgtcccagctgt

SEQ ID NO: 958270 - DNA, 25 bp, Mus musculus
gtgagcccagtctcgtcccagctgt

SEQ ID NO: 958271 - DNA, 25 bp, Mus musculus
gtgagcccgcaactccgaaagcagc

SEQ ID NO: 958272 - DNA, 25 bp, Mus musculus
gtgagcccgcaactgcgaaagcagc

SEQ ID NO: 958273 - DNA, 25 bp, Mus musculus
gtgagccttctacacctcaccccta

SEQ ID NO: 958274 - DNA, 25 bp, Mus musculus
gtgagccttctagacctcaccccta

SEQ ID NO: 958275 - DNA, 25 bp, Mus musculus
gtgagcgactgcatcgtcaacgtgt

SEQ ID NO: 958276 - DNA, 25 bp, Mus musculus
gtgagcgactgcttcgtcaacgtgt

SEQ ID NO: 958277 - DNA, 25 bp, Mus musculus
gtgagcggagatatcgaaggagatg

SEQ ID NO: 958278 - DNA, 25 bp, Mus musculus
gtgagcggagatatggaaggagatg

SEQ ID NO: 958279 - DNA, 25 bp, Mus musculus
gtgagcgtgcagaacccgggaacct

SEQ ID NO: 958280 - DNA, 25 bp, Mus musculus
gtgagcgtgcagtacccgggaacct

SEQ ID NO: 958281 - DNA, 25 bp, Mus musculus
gtgagctacagcatcgaagccaaag

SEQ ID NO: 958282 - DNA, 25 bp, Mus musculus
gtgagctacagcatggaagccaaag

SEQ ID NO: 958283 - DNA, 25 bp, Mus musculus
gtgagctccgagtcctctgctgctt

SEQ ID NO: 958284 - DNA, 25 bp, Mus musculus
gtgagctccgtgtcctctgctgctt

SEQ ID NO: 958285 - DNA, 25 bp, Mus musculus
gtgagctttgagcatttcatcaaag

SEQ ID NO: 958286 - DNA, 25 bp, Mus musculus
gtgagctttgaggatttcatcaaag

SEQ ID NO: 958287 - DNA, 25 bp, Mus musculus
gtgaggaaacagatgcaatacctgg

SEQ ID NO: 958288 - DNA, 25 bp, Mus musculus
gtgaggaaacagttgcaatacctgg

SEQ ID NO: 958289 - DNA, 25 bp, Mus musculus
gtgaggacagccttttgattgcagg

SEQ ID NO: 958290 - DNA, 25 bp, Mus musculus
gtgaggacaggcttttgattgcagg

SEQ ID NO: 958291 - DNA, 25 bp, Mus musculus
gtgaggactatgccaggttcaccgg

SEQ ID NO: 958292 - DNA, 25 bp, Mus musculus
gtgaggactatggcaggttcaccgg

SEQ ID NO: 958293 - DNA, 25 bp, Mus musculus
gtgaggactgctcctgagcctgtgg

SEQ ID NO: 958294 - DNA, 25 bp, Mus musculus
gtgaggactggtcctgagcctgtgg

SEQ ID NO: 958295 - DNA, 25 bp, Mus musculus
gtgaggagaatgacccagaaatcct

SEQ ID NO: 958296 - DNA, 25 bp, Mus musculus
gtgaggagaatgtcccagaaatcct

SEQ ID NO: 958297 - DNA, 25 bp, Mus musculus
gtgaggaggaggacgatgtggacct

SEQ ID NO: 958298 - DNA, 25 bp, Mus musculus
gtgaggaggaggtcgatgtggacct

SEQ ID NO: 958299 - DNA, 25 bp, Mus musculus
gtgaggaggatgagcatggtgggca

SEQ ID NO: 958300 - DNA, 25 bp, Mus musculus
gtgaggaggatgagcattttgattg

SEQ ID NO: 958301 - DNA, 25 bp, Mus musculus
gtgaggaggatgaggatggtgggca

SEQ ID NO: 958302 - DNA, 25 bp, Mus musculus
gtgaggaggatgaggattttgattg

SEQ ID NO: 958303 - DNA, 25 bp, Mus musculus
gtgaggcaggtgcagggagctctcc

SEQ ID NO: 958304 - DNA, 25 bp, Mus musculus
gtgaggcaggtggagggagctctcc

SEQ ID NO: 958305 - DNA, 25 bp, Mus musculus
gtgaggcctttgcctggcacaccat

SEQ ID NO: 958306 - DNA, 25 bp, Mus musculus
gtgaggcctttggctggcacaccat

SEQ ID NO: 958307 - DNA, 25 bp, Mus musculus
gtgaggcgcccaaactctcaggggc

SEQ ID NO: 958308 - DNA, 25 bp, Mus musculus
gtgaggcgcccaaagtctcaggggc

SEQ ID NO: 958309 - DNA, 25 bp, Mus musculus
gtgagggaagagcctcaggagatcc

SEQ ID NO: 958310 - DNA, 25 bp, Mus musculus
gtgagggaagtgcctcaggagatcc

SEQ ID NO: 958311 - DNA, 25 bp, Mus musculus
gtgagggctgcaaacgtttcttccg

SEQ ID NO: 958312 - DNA, 25 bp, Mus musculus
gtgagggctgcaaaggtttcttccg

SEQ ID NO: 958313 - DNA, 25 bp, Mus musculus
gtgaggtacacacgcgcaggtctga

SEQ ID NO: 958314 - DNA, 25 bp, Mus musculus
gtgaggtacacaggcgcaggtctga

SEQ ID NO: 958315 - DNA, 25 bp, Mus musculus
gtgagtaaaaatcaacaagtgtgtg

SEQ ID NO: 958316 - DNA, 25 bp, Mus musculus
gtgagtaaaaatgaacaagtgtgtg

SEQ ID NO: 958317 - DNA, 25 bp, Mus musculus
gtgagtaaacaacaattcctcagag

SEQ ID NO: 958318 - DNA, 25 bp, Mus musculus
gtgagtaaacaagaattcctcagag

SEQ ID NO: 958319 - DNA, 25 bp, Mus musculus
gtgagtcggcagatgaaagtggggg

SEQ ID NO: 958320 - DNA, 25 bp, Mus musculus
gtgagtcggcagcgctctgagtcag

SEQ ID NO: 958321 - DNA, 25 bp, Mus musculus
gtgagtcggcagggctctgagtcag

SEQ ID NO: 958322 - DNA, 25 bp, Mus musculus
gtgagtcggcagttgaaagtggggg

SEQ ID NO: 958323 - DNA, 25 bp, Mus musculus
gtgagtgaagatagtttaggtcaac

SEQ ID NO: 958324 - DNA, 25 bp, Mus musculus
gtgagtgaagatcatcgtaatactt

SEQ ID NO: 958325 - DNA, 25 bp, Mus musculus
gtgagtgaagatgatcgtaatactt

SEQ ID NO: 958326 - DNA, 25 bp, Mus musculus
gtgagtgaagattgtttaggtcaac

SEQ ID NO: 958327 - DNA, 25 bp, Mus musculus
gtgagttcaatgagcgacagattgc

SEQ ID NO: 958328 - DNA, 25 bp, Mus musculus
gtgagttcaatgagggacagattgc

SEQ ID NO: 958329 - DNA, 25 bp, Mus musculus
gtgagttcagctactcagttcgtgt

SEQ ID NO: 958330 - DNA, 25 bp, Mus musculus
gtgagttcaggtactcagttcgtgt

SEQ ID NO: 958331 - DNA, 25 bp, Mus musculus
gtgagttgtcagctaaagatgagcc

SEQ ID NO: 958332 - DNA, 25 bp, Mus musculus
gtgagttgtcaggtaaagatgagcc

SEQ ID NO: 958333 - DNA, 25 bp, Mus musculus
gtgataaagatgtccagcttcgtta

SEQ ID NO: 958334 - DNA, 25 bp, Mus musculus
gtgataaagatgtcgagcttcgtta

SEQ ID NO: 958335 - DNA, 25 bp, Mus musculus
gtgataacagtgcccacccttcttg

SEQ ID NO: 958336 - DNA, 25 bp, Mus musculus
gtgataacagtggccacccttcttg

SEQ ID NO: 958337 - DNA, 25 bp, Mus musculus
gtgataagtaacaatcttttagaga

SEQ ID NO: 958338 - DNA, 25 bp, Mus musculus
gtgataagtaactatcttttagaga

SEQ ID NO: 958339 - DNA, 25 bp, Mus musculus
gtgataataacccactggtaatgct

SEQ ID NO: 958340 - DNA, 25 bp, Mus musculus
gtgataataacccagtggtaatgct

SEQ ID NO: 958341 - DNA, 25 bp, Mus musculus
gtgataatagcttaaagaatttgcc

SEQ ID NO: 958342 - DNA, 25 bp, Mus musculus
gtgataataggttaaagaatttgcc

SEQ ID NO: 958343 - DNA, 25 bp, Mus musculus
gtgataccagaccctgaagaagaaa

SEQ ID NO: 958344 - DNA, 25 bp, Mus musculus
gtgataccagtccctgaagaagaaa

SEQ ID NO: 958345 - DNA, 25 bp, Mus musculus
gtgatatcagcaaggaggattctct

SEQ ID NO: 958346 - DNA, 25 bp, Mus musculus
gtgatatcaggaaggaggattctct

SEQ ID NO: 958347 - DNA, 25 bp, Mus musculus
gtgatcaggatacacgtgatctggt

SEQ ID NO: 958348 - DNA, 25 bp, Mus musculus
gtgatcaggatacaggtgatctggt

SEQ ID NO: 958349 - DNA, 25 bp, Mus musculus
gtgatcccgaagatcaactcaccaa

SEQ ID NO: 958350 - DNA, 25 bp, Mus musculus
gtgatcccgaagttcaactcaccaa

SEQ ID NO: 958351 - DNA, 25 bp, Mus musculus
gtgatcctccatcttcagtatcaga

SEQ ID NO: 958352 - DNA, 25 bp, Mus musculus
gtgatcctccatgttcagtatcaga

SEQ ID NO: 958353 - DNA, 25 bp, Mus musculus
gtgatcgccaaggacaattaccctc

SEQ ID NO: 958354 - DNA, 25 bp, Mus musculus
gtgatcgccaaggagaattaccctc

SEQ ID NO: 958355 - DNA, 25 bp, Mus musculus
gtgatctactctacagagctatcgt

SEQ ID NO: 958356 - DNA, 25 bp, Mus musculus
gtgatctactgtacagagctatcgt

SEQ ID NO: 958357 - DNA, 25 bp, Mus musculus
gtgatcttgatgcctccaccaagga

SEQ ID NO: 958358 - DNA, 25 bp, Mus musculus
gtgatcttgatggctccaccaagga

SEQ ID NO: 958359 - DNA, 25 bp, Mus musculus
gtgatcttggaggctggtccaggag

SEQ ID NO: 958360 - DNA, 25 bp, Mus musculus
gtgatcttggtggctggtccaggag

SEQ ID NO: 958361 - DNA, 25 bp, Mus musculus
gtgatgaaaactacatggaatttct

SEQ ID NO: 958362 - DNA, 25 bp, Mus musculus
gtgatgaaaacttcatggaatttct

SEQ ID NO: 958363 - DNA, 25 bp, Mus musculus
gtgatgaaagaggctcagctcaaca

SEQ ID NO: 958364 - DNA, 25 bp, Mus musculus
gtgatgaaagtggctcagctcaaca

SEQ ID NO: 958365 - DNA, 25 bp, Mus musculus
gtgatgacaagaaacgaattgtgga

SEQ ID NO: 958366 - DNA, 25 bp, Mus musculus
gtgatgacaagaaaggaattgtgga

SEQ ID NO: 958367 - DNA, 25 bp, Mus musculus
gtgatgacacagaacactttgttgc

SEQ ID NO: 958368 - DNA, 25 bp, Mus musculus
gtgatgacacagaagactttgttgc

SEQ ID NO: 958369 - DNA, 25 bp, Mus musculus
gtgatgacagacacctctcctctct

SEQ ID NO: 958370 - DNA, 25 bp, Mus musculus
gtgatgacagaggacaaaggtgtgg

SEQ ID NO: 958371 - DNA, 25 bp, Mus musculus
gtgatgacagtcacctctcctctct

SEQ ID NO: 958372 - DNA, 25 bp, Mus musculus
gtgatgacagtggacaaaggtgtgg

SEQ ID NO: 958373 - DNA, 25 bp, Mus musculus
gtgatgactgcccagtgtttccagg

SEQ ID NO: 958374 - DNA, 25 bp, Mus musculus
gtgatgactggccagtgtttccagg

SEQ ID NO: 958375 - DNA, 25 bp, Mus musculus
gtgatgagagcaagctttgtctcct

SEQ ID NO: 958376 - DNA, 25 bp, Mus musculus
gtgatgagaggaagctttgtctcct

SEQ ID NO: 958377 - DNA, 25 bp, Mus musculus
gtgatgatccacagacagaatttgg

SEQ ID NO: 958378 - DNA, 25 bp, Mus musculus
gtgatgatccactgacagaatttgg

SEQ ID NO: 958379 - DNA, 25 bp, Mus musculus
gtgatgcaaatacgcagccgagaga

SEQ ID NO: 958380 - DNA, 25 bp, Mus musculus
gtgatgcaaataggcagccgagaga

SEQ ID NO: 958381 - DNA, 25 bp, Mus musculus
gtgatgcacaagcacgctcctctgc

SEQ ID NO: 958382 - DNA, 25 bp, Mus musculus
gtgatgcacaagcaggctcctctgc

SEQ ID NO: 958383 - DNA, 25 bp, Mus musculus
gtgatgcaccgacacatcaagcccg

SEQ ID NO: 958384 - DNA, 25 bp, Mus musculus
gtgatgcaccgagacatcaagcccg

SEQ ID NO: 958385 - DNA, 25 bp, Mus musculus
gtgatgcgcaagcgctacgagggcc

SEQ ID NO: 958386 - DNA, 25 bp, Mus musculus
gtgatgcgcaagctatgaatgctgc

SEQ ID NO: 958387 - DNA, 25 bp, Mus musculus
gtgatgcgcaagggctacgagggcc

SEQ ID NO: 958388 - DNA, 25 bp, Mus musculus
gtgatgcgcaaggtatgaatgctgc

SEQ ID NO: 958389 - DNA, 25 bp, Mus musculus
gtgatgcttgcgagcaatgctcacc

SEQ ID NO: 958390 - DNA, 25 bp, Mus musculus
gtgatgcttgcgcaatgcagcccgc

SEQ ID NO: 958391 - DNA, 25 bp, Mus musculus
gtgatgcttgcggaatgcagcccgc

SEQ ID NO: 958392 - DNA, 25 bp, Mus musculus
gtgatgcttgcgtgcaatgctcacc

SEQ ID NO: 958393 - DNA, 25 bp, Mus musculus
gtgatgctttcagacctttacaggt

SEQ ID NO: 958394 - DNA, 25 bp, Mus musculus
gtgatgctttcagagctttacaggt

SEQ ID NO: 958395 - DNA, 25 bp, Mus musculus
gtgatggagaggaaggaggagaggt

SEQ ID NO: 958396 - DNA, 25 bp, Mus musculus
gtgatggagaggtaggaggagaggt

SEQ ID NO: 958397 - DNA, 25 bp, Mus musculus
gtgatggagtgatgcgttatggcta

SEQ ID NO: 958398 - DNA, 25 bp, Mus musculus
gtgatggagtgatgggttatggcta

SEQ ID NO: 958399 - DNA, 25 bp, Mus musculus
gtgatgtatcagcgtaagacataca

SEQ ID NO: 958400 - DNA, 25 bp, Mus musculus
gtgatgtatcagggtaagacataca

SEQ ID NO: 958401 - DNA, 25 bp, Mus musculus
gtgatgtggccaaacatatgcttcc

SEQ ID NO: 958402 - DNA, 25 bp, Mus musculus
gtgatgtggccaaagatatgcttcc

SEQ ID NO: 958403 - DNA, 25 bp, Mus musculus
gtgattacagagaattgtatttctt

SEQ ID NO: 958404 - DNA, 25 bp, Mus musculus
gtgattacagagcctttggtatagg

SEQ ID NO: 958405 - DNA, 25 bp, Mus musculus
gtgattacagagcttgccatgaagt

SEQ ID NO: 958406 - DNA, 25 bp, Mus musculus
gtgattacagaggctttggtatagg

SEQ ID NO: 958407 - DNA, 25 bp, Mus musculus
gtgattacagaggttgccatgaagt

SEQ ID NO: 958408 - DNA, 25 bp, Mus musculus
gtgattacagagtattgtatttctt

SEQ ID NO: 958409 - DNA, 25 bp, Mus musculus
gtgattactgcaaccctgtggaatc

SEQ ID NO: 958410 - DNA, 25 bp, Mus musculus
gtgattactggaaccctgtggaatc

SEQ ID NO: 958411 - DNA, 25 bp, Mus musculus
gtgattctaaacctgatatcttgtc

SEQ ID NO: 958412 - DNA, 25 bp, Mus musculus
gtgattctaaacgtgatatcttgtc

SEQ ID NO: 958413 - DNA, 25 bp, Mus musculus
gtgattctcaagctgggaagtcatc

SEQ ID NO: 958414 - DNA, 25 bp, Mus musculus
gtgattctcaaggtgggaagtcatc

SEQ ID NO: 958415 - DNA, 25 bp, Mus musculus
gtgattctcttgcattgttcatcac

SEQ ID NO: 958416 - DNA, 25 bp, Mus musculus
gtgattctcttgccattcattgaca

SEQ ID NO: 958417 - DNA, 25 bp, Mus musculus
gtgattctcttggattgttcatcac

SEQ ID NO: 958418 - DNA, 25 bp, Mus musculus
gtgattctcttggcattcattgaca

SEQ ID NO: 958419 - DNA, 25 bp, Mus musculus
gtgattcttcagcctgaaaaagaac

SEQ ID NO: 958420 - DNA, 25 bp, Mus musculus
gtgattcttcaggctgaaaaagaac

SEQ ID NO: 958421 - DNA, 25 bp, Mus musculus
gtgattgcgcagcccttcagaagta

SEQ ID NO: 958422 - DNA, 25 bp, Mus musculus
gtgattgcgcaggccttcagaagta

SEQ ID NO: 958423 - DNA, 25 bp, Mus musculus
gtgattggagctctgatagctgttg

SEQ ID NO: 958424 - DNA, 25 bp, Mus musculus
gtgattggaggtctgatagctgttg

SEQ ID NO: 958425 - DNA, 25 bp, Mus musculus
gtgattgtaaactacttttttactt

SEQ ID NO: 958426 - DNA, 25 bp, Mus musculus
gtgattgtaacaatgaagatatcct

SEQ ID NO: 958427 - DNA, 25 bp, Mus musculus
gtgattgtaagaatgaagatatcct

SEQ ID NO: 958428 - DNA, 25 bp, Mus musculus
gtgattgtaatctacttttttactt

SEQ ID NO: 958429 - DNA, 25 bp, Mus musculus
gtgattgtcaagcatcagctgtaat

SEQ ID NO: 958430 - DNA, 25 bp, Mus musculus
gtgattgtcaaggatcagctgtaat

SEQ ID NO: 958431 - DNA, 25 bp, Mus musculus
gtgattgtcgagacgtgcgaccgca

SEQ ID NO: 958432 - DNA, 25 bp, Mus musculus
gtgattgtcgagtcgtgcgaccgca

SEQ ID NO: 958433 - DNA, 25 bp, Mus musculus
gtgatttcagcttgatgactgagga

SEQ ID NO: 958434 - DNA, 25 bp, Mus musculus
gtgatttcaggttgatgactgagga

SEQ ID NO: 958435 - DNA, 25 bp, Mus musculus
gtgatttctgactggctgctgctcc

SEQ ID NO: 958436 - DNA, 25 bp, Mus musculus
gtgatttctgtctggctgctgctcc

SEQ ID NO: 958437 - DNA, 25 bp, Mus musculus
gtgatttgcgcaaatccctcttcac

SEQ ID NO: 958438 - DNA, 25 bp, Mus musculus
gtgatttgcggaaatccctcttcac

SEQ ID NO: 958439 - DNA, 25 bp, Mus musculus
gtgcaaaaagcctatcaccacagga

SEQ ID NO: 958440 - DNA, 25 bp, Mus musculus
gtgcaaaaaggctatcaccacagga

SEQ ID NO: 958441 - DNA, 25 bp, Mus musculus
gtgcaaacaactcaacttcactgcc

SEQ ID NO: 958442 - DNA, 25 bp, Mus musculus
gtgcaaacaactgaacttcactgcc

SEQ ID NO: 958443 - DNA, 25 bp, Mus musculus
gtgcaaacactgcacgttaaaatgc

SEQ ID NO: 958444 - DNA, 25 bp, Mus musculus
gtgcaaacactgcaggttaaaatgc

SEQ ID NO: 958445 - DNA, 25 bp, Mus musculus
gtgcaaacagagagacataatgatg

SEQ ID NO: 958446 - DNA, 25 bp, Mus musculus
gtgcaaacagagtgacataatgatg

SEQ ID NO: 958447 - DNA, 25 bp, Mus musculus
gtgcaaacagctcgccagtaaggct

SEQ ID NO: 958448 - DNA, 25 bp, Mus musculus
gtgcaaacaggtcgccagtaaggct

SEQ ID NO: 958449 - DNA, 25 bp, Mus musculus
gtgcaaccacagcgactggaaatgg

SEQ ID NO: 958450 - DNA, 25 bp, Mus musculus
gtgcaaccacagggactggaaatgg

SEQ ID NO: 958451 - DNA, 25 bp, Mus musculus
gtgcaaccagctagaatgtcatcct

SEQ ID NO: 958452 - DNA, 25 bp, Mus musculus
gtgcaaccaggtagaatgtcatcct

SEQ ID NO: 958453 - DNA, 25 bp, Mus musculus
gtgcaacctgcaccatgggcttggc

SEQ ID NO: 958454 - DNA, 25 bp, Mus musculus
gtgcaacctggaccatgggcttggc

SEQ ID NO: 958455 - DNA, 25 bp, Mus musculus
gtgcaagacaagcctttggatgcca

SEQ ID NO: 958456 - DNA, 25 bp, Mus musculus
gtgcaagacaaggctttggatgcca

SEQ ID NO: 958457 - DNA, 25 bp, Mus musculus
gtgcaagaggatgacatcgactggg

SEQ ID NO: 958458 - DNA, 25 bp, Mus musculus
gtgcaagaggatgagatcgactggg

SEQ ID NO: 958459 - DNA, 25 bp, Mus musculus
gtgcacagaagaaaccattgtggaa

SEQ ID NO: 958460 - DNA, 25 bp, Mus musculus
gtgcacagaagaaagcattgtggaa

SEQ ID NO: 958461 - DNA, 25 bp, Mus musculus
gtgcacatcctccggactctaatga

SEQ ID NO: 958462 - DNA, 25 bp, Mus musculus
gtgcacatcctcgggactctaatga

SEQ ID NO: 958463 - DNA, 25 bp, Mus musculus
gtgcacattcagatacggtggagca

SEQ ID NO: 958464 - DNA, 25 bp, Mus musculus
gtgcacattcagcagatacggtgga

SEQ ID NO: 958465 - DNA, 25 bp, Mus musculus
gtgcacattcagcagtgtgttccag

SEQ ID NO: 958466 - DNA, 25 bp, Mus musculus
gtgcacattcaggagatacggtgga

SEQ ID NO: 958467 - DNA, 25 bp, Mus musculus
gtgcacattcaggagtgtgttccag

SEQ ID NO: 958468 - DNA, 25 bp, Mus musculus
gtgcacattcagttacggtggagca

SEQ ID NO: 958469 - DNA, 25 bp, Mus musculus
gtgcaccaagaagtcgcagcctgac

SEQ ID NO: 958470 - DNA, 25 bp, Mus musculus
gtgcaccaagaagtggcagcctgac

SEQ ID NO: 958471 - DNA, 25 bp, Mus musculus
gtgcaccaagctgcagagtggcacc

SEQ ID NO: 958472 - DNA, 25 bp, Mus musculus
gtgcaccaaggtgcagagtggcacc

SEQ ID NO: 958473 - DNA, 25 bp, Mus musculus
gtgcaccagcatttcgtataggagg

SEQ ID NO: 958474 - DNA, 25 bp, Mus musculus
gtgcaccagcatttggtataggagg

SEQ ID NO: 958475 - DNA, 25 bp, Mus musculus
gtgcaccatcccatcgtatataatg

SEQ ID NO: 958476 - DNA, 25 bp, Mus musculus
gtgcaccatcccatggtatataatg

SEQ ID NO: 958477 - DNA, 25 bp, Mus musculus
gtgcacccagaaaacgaagagatgg

SEQ ID NO: 958478 - DNA, 25 bp, Mus musculus
gtgcacccagtaaacgaagagatgg

SEQ ID NO: 958479 - DNA, 25 bp, Mus musculus
gtgcaccctgcaacagcttcagaga

SEQ ID NO: 958480 - DNA, 25 bp, Mus musculus
gtgcaccctggaacagcttcagaga

SEQ ID NO: 958481 - DNA, 25 bp, Mus musculus
gtgcacctcaaggacggttcagaag

SEQ ID NO: 958482 - DNA, 25 bp, Mus musculus
gtgcacctcaaggagggttcagaag

SEQ ID NO: 958483 - DNA, 25 bp, Mus musculus
gtgcaccttgtgccttgcgctctgg

SEQ ID NO: 958484 - DNA, 25 bp, Mus musculus
gtgcaccttgtggcttgcgctctgg

SEQ ID NO: 958485 - DNA, 25 bp, Mus musculus
gtgcacgctgcacatatgatcatac

SEQ ID NO: 958486 - DNA, 25 bp, Mus musculus
gtgcacgctgcagatatgatcatac

SEQ ID NO: 958487 - DNA, 25 bp, Mus musculus
gtgcactgtccaaacggccagaagg

SEQ ID NO: 958488 - DNA, 25 bp, Mus musculus
gtgcactgtccaaagggccagaagg

SEQ ID NO: 958489 - DNA, 25 bp, Mus musculus
gtgcactgtctgctcccaccccttg

SEQ ID NO: 958490 - DNA, 25 bp, Mus musculus
gtgcactgtctgctgccaccccttg

SEQ ID NO: 958491 - DNA, 25 bp, Mus musculus
gtgcagaaagagctcagggactgca

SEQ ID NO: 958492 - DNA, 25 bp, Mus musculus
gtgcagaaagagctcagggactgga

SEQ ID NO: 958493 - DNA, 25 bp, Mus musculus
gtgcagaaagaggtcagggactgca

SEQ ID NO: 958494 - DNA, 25 bp, Mus musculus
gtgcagaaagaggtcagggactgga

SEQ ID NO: 958495 - DNA, 25 bp, Mus musculus
gtgcagaatgactcacagatctttg

SEQ ID NO: 958496 - DNA, 25 bp, Mus musculus
gtgcagaatgtctcacagatctttg

SEQ ID NO: 958497 - DNA, 25 bp, Mus musculus
gtgcagacacagcgcagatgtaatt

SEQ ID NO: 958498 - DNA, 25 bp, Mus musculus
gtgcagacacagggcagatgtaatt

SEQ ID NO: 958499 - DNA, 25 bp, Mus musculus
gtgcagacagcccctgcaggaacaa

SEQ ID NO: 958500 - DNA, 25 bp, Mus musculus
gtgcagacaggccctgcaggaacaa

SEQ ID NO: 958501 - DNA, 25 bp, Mus musculus
gtgcagagacagatgcactgttgtg

SEQ ID NO: 958502 - DNA, 25 bp, Mus musculus
gtgcagagacagttgcactgttgtg

SEQ ID NO: 958503 - DNA, 25 bp, Mus musculus
gtgcagaggaaaaagaagccctcct

SEQ ID NO: 958504 - DNA, 25 bp, Mus musculus
gtgcagaggaaatagaagccctcct

SEQ ID NO: 958505 - DNA, 25 bp, Mus musculus
gtgcagagtcaacgagaagccaatg

SEQ ID NO: 958506 - DNA, 25 bp, Mus musculus
gtgcagagtcaaggagaagccaatg

SEQ ID NO: 958507 - DNA, 25 bp, Mus musculus
gtgcagagtgctcatcagggcactg

SEQ ID NO: 958508 - DNA, 25 bp, Mus musculus
gtgcagagtgctgatcagggcactg

SEQ ID NO: 958509 - DNA, 25 bp, Mus musculus
gtgcagagtgtacaccgaccctagg

SEQ ID NO: 958510 - DNA, 25 bp, Mus musculus
gtgcagagtgtacagcgaccctagg

SEQ ID NO: 958511 - DNA, 25 bp, Mus musculus
gtgcagatgctgacatggacttggc

SEQ ID NO: 958512 - DNA, 25 bp, Mus musculus
gtgcagatgctgacttggacttggc

SEQ ID NO: 958513 - DNA, 25 bp, Mus musculus
gtgcagccagcactgtgccaggtga

SEQ ID NO: 958514 - DNA, 25 bp, Mus musculus
gtgcagccagcagtgtgccaggtga

SEQ ID NO: 958515 - DNA, 25 bp, Mus musculus
gtgcagcctcagccaagttgaagtt

SEQ ID NO: 958516 - DNA, 25 bp, Mus musculus
gtgcagcctcaggcaagttgaagtt

SEQ ID NO: 958517 - DNA, 25 bp, Mus musculus
gtgcagcgatcacgtaatagtgcag

SEQ ID NO: 958518 - DNA, 25 bp, Mus musculus
gtgcagcgatcaggtaatagtgcag

SEQ ID NO: 958519 - DNA, 25 bp, Mus musculus
gtgcagcgcactgagctgctgtggc

SEQ ID NO: 958520 - DNA, 25 bp, Mus musculus
gtgcagcgcagcctgagctgctgtg

SEQ ID NO: 958521 - DNA, 25 bp, Mus musculus
gtgcagcgcagcgtgagctgctgtg

SEQ ID NO: 958522 - DNA, 25 bp, Mus musculus
gtgcagcgcagtgagctgctgtggc

SEQ ID NO: 958523 - DNA, 25 bp, Mus musculus
gtgcagcggacttcagttctatttg

SEQ ID NO: 958524 - DNA, 25 bp, Mus musculus
gtgcagcggacttctgttctatttg

SEQ ID NO: 958525 - DNA, 25 bp, Mus musculus
gtgcagctcttgctttacccatcgc

SEQ ID NO: 958526 - DNA, 25 bp, Mus musculus
gtgcagctcttggtttacccatcgc

SEQ ID NO: 958527 - DNA, 25 bp, Mus musculus
gtgcagctgcgacgctctacacaga

SEQ ID NO: 958528 - DNA, 25 bp, Mus musculus
gtgcagctgcgaggctctacacaga

SEQ ID NO: 958529 - DNA, 25 bp, Mus musculus
gtgcagctggagagtgtcgcaagca

SEQ ID NO: 958530 - DNA, 25 bp, Mus musculus
gtgcagctggagtgtgtcgcaagca

SEQ ID NO: 958531 - DNA, 25 bp, Mus musculus
gtgcaggaaaacattgctgatagcc

SEQ ID NO: 958532 - DNA, 25 bp, Mus musculus
gtgcaggaaaactttgctgatagcc

SEQ ID NO: 958533 - DNA, 25 bp, Mus musculus
gtgcaggaacaacgatatcaataaa

SEQ ID NO: 958534 - DNA, 25 bp, Mus musculus
gtgcaggaacaaggatatcaataaa

SEQ ID NO: 958535 - DNA, 25 bp, Mus musculus
gtgcaggaggcacgactgacgtggt

SEQ ID NO: 958536 - DNA, 25 bp, Mus musculus
gtgcaggagggacgactgacgtggt

SEQ ID NO: 958537 - DNA, 25 bp, Mus musculus
gtgcaggcatgacacgagctggaga

SEQ ID NO: 958538 - DNA, 25 bp, Mus musculus
gtgcaggcatgacaggagctggaga

SEQ ID NO: 958539 - DNA, 25 bp, Mus musculus
gtgcaggcgcagctcaagtgctgtg

SEQ ID NO: 958540 - DNA, 25 bp, Mus musculus
gtgcaggcgcaggtcaagtgctgtg

SEQ ID NO: 958541 - DNA, 25 bp, Mus musculus
gtgcagtacaaacagtacttttgag

SEQ ID NO: 958542 - DNA, 25 bp, Mus musculus
gtgcagtacaaagagtacttttgag

SEQ ID NO: 958543 - DNA, 25 bp, Mus musculus
gtgcagtcacagctggataccctcc

SEQ ID NO: 958544 - DNA, 25 bp, Mus musculus
gtgcagtcacaggtggataccctcc

SEQ ID NO: 958545 - DNA, 25 bp, Mus musculus
gtgcagtcctagaacgagatgcgat

SEQ ID NO: 958546 - DNA, 25 bp, Mus musculus
gtgcagtcctagaaggagatgcgat

SEQ ID NO: 958547 - DNA, 25 bp, Mus musculus
gtgcagtgaccacaacatcaaactg

SEQ ID NO: 958548 - DNA, 25 bp, Mus musculus
gtgcagtgaccagaacatcaaactg

SEQ ID NO: 958549 - DNA, 25 bp, Mus musculus
gtgcagtgcaaaaaccctatcacca

SEQ ID NO: 958550 - DNA, 25 bp, Mus musculus
gtgcagtgcaaaaagcctatcacca

SEQ ID NO: 958551 - DNA, 25 bp, Mus musculus
gtgcagtggttacggtgtcgtagtc

SEQ ID NO: 958552 - DNA, 25 bp, Mus musculus
gtgcagtggttagggtgtcgtagtc

SEQ ID NO: 958553 - DNA, 25 bp, Mus musculus
gtgcagtgtgctctgcagtagacag

SEQ ID NO: 958554 - DNA, 25 bp, Mus musculus
gtgcagtgtggtctgcagtagacag

SEQ ID NO: 958555 - DNA, 25 bp, Mus musculus
gtgcagttagctatctctggagaca

SEQ ID NO: 958556 - DNA, 25 bp, Mus musculus
gtgcagttaggtatctctggagaca

SEQ ID NO: 958557 - DNA, 25 bp, Mus musculus
gtgcagttcaagcctccggcctatc

SEQ ID NO: 958558 - DNA, 25 bp, Mus musculus
gtgcagttcaaggctccggcctatc

SEQ ID NO: 958559 - DNA, 25 bp, Mus musculus
gtgcatacggatcaggagattgcca

SEQ ID NO: 958560 - DNA, 25 bp, Mus musculus
gtgcatacggatgaggagattgcca

SEQ ID NO: 958561 - DNA, 25 bp, Mus musculus
gtgcatcattcacgtttttcctgat

SEQ ID NO: 958562 - DNA, 25 bp, Mus musculus
gtgcatcattcaggtttttcctgat

SEQ ID NO: 958563 - DNA, 25 bp, Mus musculus
gtgcatccctctcgcctggttcccc

SEQ ID NO: 958564 - DNA, 25 bp, Mus musculus
gtgcatccctctggcctggttcccc

SEQ ID NO: 958565 - DNA, 25 bp, Mus musculus
gtgcatctccagctcccacctgctc

SEQ ID NO: 958566 - DNA, 25 bp, Mus musculus
gtgcatctccaggtcccacctgctc

SEQ ID NO: 958567 - DNA, 25 bp, Mus musculus
gtgcatgcagatggatgatgtaatt

SEQ ID NO: 958568 - DNA, 25 bp, Mus musculus
gtgcatgcagttggatgatgtaatt

SEQ ID NO: 958569 - DNA, 25 bp, Mus musculus
gtgcatgtggcagacaggctgctgc

SEQ ID NO: 958570 - DNA, 25 bp, Mus musculus
gtgcatgtggcagagaggctgctgc

SEQ ID NO: 958571 - DNA, 25 bp, Mus musculus
gtgcattacgctattattatgatgg

SEQ ID NO: 958572 - DNA, 25 bp, Mus musculus
gtgcattacggtattattatgatgg

SEQ ID NO: 958573 - DNA, 25 bp, Mus musculus
gtgcattgagaaagaagtcaacaaa

SEQ ID NO: 958574 - DNA, 25 bp, Mus musculus
gtgcattgagagctgtctgtctagg

SEQ ID NO: 958575 - DNA, 25 bp, Mus musculus
gtgcattgagtaagaagtcaacaaa

SEQ ID NO: 958576 - DNA, 25 bp, Mus musculus
gtgcattgagtgctgtctgtctagg

SEQ ID NO: 958577 - DNA, 25 bp, Mus musculus
gtgcattggacacattgtccttctg

SEQ ID NO: 958578 - DNA, 25 bp, Mus musculus
gtgcattggacagattgtccttctg

SEQ ID NO: 958579 - DNA, 25 bp, Mus musculus
gtgccaaagaggaacgcatcgtcat

SEQ ID NO: 958580 - DNA, 25 bp, Mus musculus
gtgccaaagaggaaggcatcgtcat

SEQ ID NO: 958581 - DNA, 25 bp, Mus musculus
gtgccaaccaaccgaatggcgaaga

SEQ ID NO: 958582 - DNA, 25 bp, Mus musculus
gtgccaaccaacggaatggcgaaga

SEQ ID NO: 958583 - DNA, 25 bp, Mus musculus
gtgccaagaaaaagagcattcacat

SEQ ID NO: 958584 - DNA, 25 bp, Mus musculus
gtgccaagaaaaagtgcattcacat

SEQ ID NO: 958585 - DNA, 25 bp, Mus musculus
gtgccaagaaagactgacctcttcc

SEQ ID NO: 958586 - DNA, 25 bp, Mus musculus
gtgccaagaaagtctgacctcttcc

SEQ ID NO: 958587 - DNA, 25 bp, Mus musculus
gtgccaagagcgagctccgctttgg

SEQ ID NO: 958588 - DNA, 25 bp, Mus musculus
gtgccaagagggagctccgctttgg

SEQ ID NO: 958589 - DNA, 25 bp, Mus musculus
gtgccaatcccctgcctgtcgacct

SEQ ID NO: 958590 - DNA, 25 bp, Mus musculus
gtgccaatcccctggctgtcgacct

SEQ ID NO: 958591 - DNA, 25 bp, Mus musculus
gtgccaatctgcaaatggcctttgt

SEQ ID NO: 958592 - DNA, 25 bp, Mus musculus
gtgccaatctgctaatggcctttgt

SEQ ID NO: 958593 - DNA, 25 bp, Mus musculus
gtgccacaggcaccctgtctgacct

SEQ ID NO: 958594 - DNA, 25 bp, Mus musculus
gtgccacaggcaccgtgtctgacct

SEQ ID NO: 958595 - DNA, 25 bp, Mus musculus
gtgccacccgacagcgccgcagcct

SEQ ID NO: 958596 - DNA, 25 bp, Mus musculus
gtgccacccgacagggccgcagcct

SEQ ID NO: 958597 - DNA, 25 bp, Mus musculus
gtgccactgaatggaactctgacct

SEQ ID NO: 958598 - DNA, 25 bp, Mus musculus
gtgccactgattggaactctgacct

SEQ ID NO: 958599 - DNA, 25 bp, Mus musculus
gtgccagaagcggaccgagagactc

SEQ ID NO: 958600 - DNA, 25 bp, Mus musculus
gtgccagaaggggaccgagagactc

SEQ ID NO: 958601 - DNA, 25 bp, Mus musculus
gtgccagacctcatccattccagaa

SEQ ID NO: 958602 - DNA, 25 bp, Mus musculus
gtgccagacctcatgcattccagaa

SEQ ID NO: 958603 - DNA, 25 bp, Mus musculus
gtgccagacgggaaccctcttatcc

SEQ ID NO: 958604 - DNA, 25 bp, Mus musculus
gtgccagacgggaagcctcttatcc

SEQ ID NO: 958605 - DNA, 25 bp, Mus musculus
gtgccagaggcatgctaccacggct

SEQ ID NO: 958606 - DNA, 25 bp, Mus musculus
gtgccagagggatgctaccacggct

SEQ ID NO: 958607 - DNA, 25 bp, Mus musculus
gtgccagatatactgtcttgtttca

SEQ ID NO: 958608 - DNA, 25 bp, Mus musculus
gtgccagatatagtgtcttgtttca

SEQ ID NO: 958609 - DNA, 25 bp, Mus musculus
gtgccagatgtcaacaaagcgtgta

SEQ ID NO: 958610 - DNA, 25 bp, Mus musculus
gtgccagatgtcaacatatctgttt

SEQ ID NO: 958611 - DNA, 25 bp, Mus musculus
gtgccagatgtcaagaaagcgtgta

SEQ ID NO: 958612 - DNA, 25 bp, Mus musculus
gtgccagatgtcaagatatctgttt

SEQ ID NO: 958613 - DNA, 25 bp, Mus musculus
gtgccagctgcccgactgccctcca

SEQ ID NO: 958614 - DNA, 25 bp, Mus musculus
gtgccagctgccggactgccctcca

SEQ ID NO: 958615 - DNA, 25 bp, Mus musculus
gtgccagggacatacgaatgttcta

SEQ ID NO: 958616 - DNA, 25 bp, Mus musculus
gtgccagggacataggaatgttcta

SEQ ID NO: 958617 - DNA, 25 bp, Mus musculus
gtgccaggtaagcaaagtgcaccct

SEQ ID NO: 958618 - DNA, 25 bp, Mus musculus
gtgccaggtatgcaaagtgcaccct

SEQ ID NO: 958619 - DNA, 25 bp, Mus musculus
gtgccatacccacgcatgaacaacc

SEQ ID NO: 958620 - DNA, 25 bp, Mus musculus
gtgccatacccaggcatgaacaacc

SEQ ID NO: 958621 - DNA, 25 bp, Mus musculus
gtgccatctagtcctcttcctcctg

SEQ ID NO: 958622 - DNA, 25 bp, Mus musculus
gtgccatctagtgctcttcctcctg

SEQ ID NO: 958623 - DNA, 25 bp, Mus musculus
gtgccatgaccccactgaccgtctg

SEQ ID NO: 958624 - DNA, 25 bp, Mus musculus
gtgccatgaccccagtgaccgtctg

SEQ ID NO: 958625 - DNA, 25 bp, Mus musculus
gtgccattgacgcacattgtttgct

SEQ ID NO: 958626 - DNA, 25 bp, Mus musculus
gtgccattgacgcagattgtttgct

SEQ ID NO: 958627 - DNA, 25 bp, Mus musculus
gtgccattgccactggttctgagct

SEQ ID NO: 958628 - DNA, 25 bp, Mus musculus
gtgccattgccagtggttctgagct

SEQ ID NO: 958629 - DNA, 25 bp, Mus musculus
gtgccattgtcctggagacgacaca

SEQ ID NO: 958630 - DNA, 25 bp, Mus musculus
gtgccattgtgctggagacgacaca

SEQ ID NO: 958631 - DNA, 25 bp, Mus musculus
gtgcccacattccacggccctctgc

SEQ ID NO: 958632 - DNA, 25 bp, Mus musculus
gtgcccacattccagggccctctgc

SEQ ID NO: 958633 - DNA, 25 bp, Mus musculus
gtgcccactcagcctcctattaatg

SEQ ID NO: 958634 - DNA, 25 bp, Mus musculus
gtgcccactcaggctcctattaatg

SEQ ID NO: 958635 - DNA, 25 bp, Mus musculus
gtgcccagatcaaatcgtgtccagc

SEQ ID NO: 958636 - DNA, 25 bp, Mus musculus
gtgcccagatcaactattagacatg

SEQ ID NO: 958637 - DNA, 25 bp, Mus musculus
gtgcccagatcatatcgtgtccagc

SEQ ID NO: 958638 - DNA, 25 bp, Mus musculus
gtgcccagatcatctattagacatg

SEQ ID NO: 958639 - DNA, 25 bp, Mus musculus
gtgcccatgattaccgtggatggga

SEQ ID NO: 958640 - DNA, 25 bp, Mus musculus
gtgcccatgattacggtggatggga

SEQ ID NO: 958641 - DNA, 25 bp, Mus musculus
gtgcccatggagctcctgtccagag

SEQ ID NO: 958642 - DNA, 25 bp, Mus musculus
gtgcccatggaggtcctgtccagag

SEQ ID NO: 958643 - DNA, 25 bp, Mus musculus
gtgcccattccacctgtcgcagaga

SEQ ID NO: 958644 - DNA, 25 bp, Mus musculus
gtgcccattccagctgtcgcagaga

SEQ ID NO: 958645 - DNA, 25 bp, Mus musculus
gtgcccattgcacggatgcctgctg

SEQ ID NO: 958646 - DNA, 25 bp, Mus musculus
gtgcccattgcagggatgcctgctg

SEQ ID NO: 958647 - DNA, 25 bp, Mus musculus
gtgcccattttgctggtgagcttct

SEQ ID NO: 958648 - DNA, 25 bp, Mus musculus
gtgcccattttggtggtgagcttct

SEQ ID NO: 958649 - DNA, 25 bp, Mus musculus
gtgccccaagatcaggacgctcgca

SEQ ID NO: 958650 - DNA, 25 bp, Mus musculus
gtgccccaagatgaggacgctcgca

SEQ ID NO: 958651 - DNA, 25 bp, Mus musculus
gtgcccccaagccacaccctaaggc

SEQ ID NO: 958652 - DNA, 25 bp, Mus musculus
gtgcccccaagcgacaccctaaggc

SEQ ID NO: 958653 - DNA, 25 bp, Mus musculus
gtgcccctagagatgtcatgtgtgg

SEQ ID NO: 958654 - DNA, 25 bp, Mus musculus
gtgcccctagtgatgtcatgtgtgg

SEQ ID NO: 958655 - DNA, 25 bp, Mus musculus
gtgcccctgcagcacctcatggtca

SEQ ID NO: 958656 - DNA, 25 bp, Mus musculus
gtgcccctgcaggacctcatggtca

SEQ ID NO: 958657 - DNA, 25 bp, Mus musculus
gtgccccttgatgtagagtataaaa

SEQ ID NO: 958658 - DNA, 25 bp, Mus musculus
gtgccccttgttgtagagtataaaa

SEQ ID NO: 958659 - DNA, 25 bp, Mus musculus
gtgcccgcccagcttgtcttgacac

SEQ ID NO: 958660 - DNA, 25 bp, Mus musculus
gtgcccgcccaggttgtcttgacac

SEQ ID NO: 958661 - DNA, 25 bp, Mus musculus
gtgcccgctgcgtgcacattgatga

SEQ ID NO: 958662 - DNA, 25 bp, Mus musculus
gtgcccgctgcgtggacattgatga

SEQ ID NO: 958663 - DNA, 25 bp, Mus musculus
gtgcccgtatagattacatctcgct

SEQ ID NO: 958664 - DNA, 25 bp, Mus musculus
gtgcccgtatagccacgtcagcttt

SEQ ID NO: 958665 - DNA, 25 bp, Mus musculus
gtgcccgtataggcacgtcagcttt

SEQ ID NO: 958666 - DNA, 25 bp, Mus musculus
gtgcccgtatagtttacatctcgct

SEQ ID NO: 958667 - DNA, 25 bp, Mus musculus
gtgcccgttgagcaagcaagtggcc

SEQ ID NO: 958668 - DNA, 25 bp, Mus musculus
gtgcccgttgagcaagtggccagca

SEQ ID NO: 958669 - DNA, 25 bp, Mus musculus
gtgcccgttgaggaagcaagtggcc

SEQ ID NO: 958670 - DNA, 25 bp, Mus musculus
gtgcccgttgaggaagtggccagca

SEQ ID NO: 958671 - DNA, 25 bp, Mus musculus
gtgccctatatccacgaggagtttc

SEQ ID NO: 958672 - DNA, 25 bp, Mus musculus
gtgccctatatccaggaggagtttc

SEQ ID NO: 958673 - DNA, 25 bp, Mus musculus
gtgccctcaccactcaatccctgtt

SEQ ID NO: 958674 - DNA, 25 bp, Mus musculus
gtgccctcaccagtcaatccctgtt

SEQ ID NO: 958675 - DNA, 25 bp, Mus musculus
gtgccctcttctccacatcgagtca

SEQ ID NO: 958676 - DNA, 25 bp, Mus musculus
gtgccctcttctgcacatcgagtca

SEQ ID NO: 958677 - DNA, 25 bp, Mus musculus
gtgccctgcgcatcctaatcgtgga

SEQ ID NO: 958678 - DNA, 25 bp, Mus musculus
gtgccctgcgcgcttcgagggtgcc

SEQ ID NO: 958679 - DNA, 25 bp, Mus musculus
gtgccctgcggatcctaatcgtgga

SEQ ID NO: 958680 - DNA, 25 bp, Mus musculus
gtgccctgcgggcttcgagggtgcc

SEQ ID NO: 958681 - DNA, 25 bp, Mus musculus
gtgccctgctggctggggagacagc

SEQ ID NO: 958682 - DNA, 25 bp, Mus musculus
gtgccctgctgggtggggagacagc

SEQ ID NO: 958683 - DNA, 25 bp, Mus musculus
gtgcccttaccacgcaaatccaaaa

SEQ ID NO: 958684 - DNA, 25 bp, Mus musculus
gtgcccttaccaggcaaatccaaaa

SEQ ID NO: 958685 - DNA, 25 bp, Mus musculus
gtgccgaggaggcgcgtgctggtca

SEQ ID NO: 958686 - DNA, 25 bp, Mus musculus
gtgccgaggaggggcgtgctggtca

SEQ ID NO: 958687 - DNA, 25 bp, Mus musculus
gtgccgcacactctggaataaaagc

SEQ ID NO: 958688 - DNA, 25 bp, Mus musculus
gtgccgcacagtctggaataaaagc

SEQ ID NO: 958689 - DNA, 25 bp, Mus musculus
gtgccgcctctgcgctggagccttc

SEQ ID NO: 958690 - DNA, 25 bp, Mus musculus
gtgccgcctctgggctggagccttc

SEQ ID NO: 958691 - DNA, 25 bp, Mus musculus
gtgccgctgcttccaaggagaagtt

SEQ ID NO: 958692 - DNA, 25 bp, Mus musculus
gtgccgctgcttgcaaggagaagtt

SEQ ID NO: 958693 - DNA, 25 bp, Mus musculus
gtgccgcttccgcaagctgcactgt

SEQ ID NO: 958694 - DNA, 25 bp, Mus musculus
gtgccgcttccggaagctgcactgt

SEQ ID NO: 958695 - DNA, 25 bp, Mus musculus
gtgccggatcagcagggccaggagg

SEQ ID NO: 958696 - DNA, 25 bp, Mus musculus
gtgccggatcaggagggccaggagg

SEQ ID NO: 958697 - DNA, 25 bp, Mus musculus
gtgccggttaggcactgcatgagaa

SEQ ID NO: 958698 - DNA, 25 bp, Mus musculus
gtgccggttagggactgcatgagaa

SEQ ID NO: 958699 - DNA, 25 bp, Mus musculus
gtgccgtctgccaacgactttattg

SEQ ID NO: 958700 - DNA, 25 bp, Mus musculus
gtgccgtctgccaaggactttattg

SEQ ID NO: 958701 - DNA, 25 bp, Mus musculus
gtgcctacagagaagcggtcagcaa

SEQ ID NO: 958702 - DNA, 25 bp, Mus musculus
gtgcctacagtgaagcggtcagcaa

SEQ ID NO: 958703 - DNA, 25 bp, Mus musculus
gtgcctacattaatcattccattgg

SEQ ID NO: 958704 - DNA, 25 bp, Mus musculus
gtgcctacattaatcctaccgtctt

SEQ ID NO: 958705 - DNA, 25 bp, Mus musculus
gtgcctacattaatgattccattgg

SEQ ID NO: 958706 - DNA, 25 bp, Mus musculus
gtgcctacattaatgctaccgtctt

SEQ ID NO: 958707 - DNA, 25 bp, Mus musculus
gtgcctacggcaaggaaacatgaca

SEQ ID NO: 958708 - DNA, 25 bp, Mus musculus
gtgcctacggcatggaaacatgaca

SEQ ID NO: 958709 - DNA, 25 bp, Mus musculus
gtgcctagaaagacggacctgttcc

SEQ ID NO: 958710 - DNA, 25 bp, Mus musculus
gtgcctagaaagtcggacctgttcc

SEQ ID NO: 958711 - DNA, 25 bp, Mus musculus
gtgcctattcagcgacagaggcaga

SEQ ID NO: 958712 - DNA, 25 bp, Mus musculus
gtgcctattcagggacagaggcaga

SEQ ID NO: 958713 - DNA, 25 bp, Mus musculus
gtgcctcatacattcgaacctccaa

SEQ ID NO: 958714 - DNA, 25 bp, Mus musculus
gtgcctcatacattggaacctccaa

SEQ ID NO: 958715 - DNA, 25 bp, Mus musculus
gtgcctcatgagtggacaactggct

SEQ ID NO: 958716 - DNA, 25 bp, Mus musculus
gtgcctcatgtgtggacaactggct

SEQ ID NO: 958717 - DNA, 25 bp, Mus musculus
gtgcctccaaggcttcccgtgagaa

SEQ ID NO: 958718 - DNA, 25 bp, Mus musculus
gtgcctccaagggttcccgtgagaa

SEQ ID NO: 958719 - DNA, 25 bp, Mus musculus
gtgcctcccacgtcagaaccgttac

SEQ ID NO: 958720 - DNA, 25 bp, Mus musculus
gtgcctcccaggtcagaaccgttac

SEQ ID NO: 958721 - DNA, 25 bp, Mus musculus
gtgcctcctgcgctccacctccagc

SEQ ID NO: 958722 - DNA, 25 bp, Mus musculus
gtgcctcctgcggtccacctccagc

SEQ ID NO: 958723 - DNA, 25 bp, Mus musculus
gtgcctcgccatcgctgaccagctg

SEQ ID NO: 958724 - DNA, 25 bp, Mus musculus
gtgcctcgccatggctgaccagctg

SEQ ID NO: 958725 - DNA, 25 bp, Mus musculus
gtgcctctcatgcgggttggggtga

SEQ ID NO: 958726 - DNA, 25 bp, Mus musculus
gtgcctctcatgggggttggggtga

SEQ ID NO: 958727 - DNA, 25 bp, Mus musculus
gtgcctctgtgtctcactaatgctc

SEQ ID NO: 958728 - DNA, 25 bp, Mus musculus
gtgcctctgtgtctcgtttaaaaag

SEQ ID NO: 958729 - DNA, 25 bp, Mus musculus
gtgcctctgtgtctgactaatgctc

SEQ ID NO: 958730 - DNA, 25 bp, Mus musculus
gtgcctctgtgtctggtttaaaaag

SEQ ID NO: 958731 - DNA, 25 bp, Mus musculus
gtgcctgacacccatggcagacttt

SEQ ID NO: 958732 - DNA, 25 bp, Mus musculus
gtgcctgacaccgatggcagacttt

SEQ ID NO: 958733 - DNA, 25 bp, Mus musculus
gtgcctgagaatcggaagagaaaga

SEQ ID NO: 958734 - DNA, 25 bp, Mus musculus
gtgcctgagaatgggaagagaaaga

SEQ ID NO: 958735 - DNA, 25 bp, Mus musculus
gtgcctgcagcatcggaacgtcaat

SEQ ID NO: 958736 - DNA, 25 bp, Mus musculus
gtgcctgcagcgtccagtgcctcca

SEQ ID NO: 958737 - DNA, 25 bp, Mus musculus
gtgcctgcaggatcggaacgtcaat

SEQ ID NO: 958738 - DNA, 25 bp, Mus musculus
gtgcctgcagggtccagtgcctcca

SEQ ID NO: 958739 - DNA, 25 bp, Mus musculus
gtgcctgcttgccacgttttgctgg

SEQ ID NO: 958740 - DNA, 25 bp, Mus musculus
gtgcctgcttgccaggttttgctgg

SEQ ID NO: 958741 - DNA, 25 bp, Mus musculus
gtgcctggacagaaatatcttgagc

SEQ ID NO: 958742 - DNA, 25 bp, Mus musculus
gtgcctggacagtaatatcttgagc

SEQ ID NO: 958743 - DNA, 25 bp, Mus musculus
gtgcctggagaataggtgctcctat

SEQ ID NO: 958744 - DNA, 25 bp, Mus musculus
gtgcctggagcacgaacagctccca

SEQ ID NO: 958745 - DNA, 25 bp, Mus musculus
gtgcctggagcaggaacagctccca

SEQ ID NO: 958746 - DNA, 25 bp, Mus musculus
gtgcctggagctgctcctatgttgg

SEQ ID NO: 958747 - DNA, 25 bp, Mus musculus
gtgcctggaggtgctcctatgttgg

SEQ ID NO: 958748 - DNA, 25 bp, Mus musculus
gtgcctggagtataggtgctcctat

SEQ ID NO: 958749 - DNA, 25 bp, Mus musculus
gtgcctgtcaaagacgagaaggctg

SEQ ID NO: 958750 - DNA, 25 bp, Mus musculus
gtgcctgtcaaagaggagaaggctg

SEQ ID NO: 958751 - DNA, 25 bp, Mus musculus
gtgcctgtcctgcttgttcctcaaa

SEQ ID NO: 958752 - DNA, 25 bp, Mus musculus
gtgcctgtcctggttgttcctcaaa

SEQ ID NO: 958753 - DNA, 25 bp, Mus musculus
gtgccttattcaagccctggtgtgt

SEQ ID NO: 958754 - DNA, 25 bp, Mus musculus
gtgccttattcaagcggtgtggaat

SEQ ID NO: 958755 - DNA, 25 bp, Mus musculus
gtgccttattcaaggcctggtgtgt

SEQ ID NO: 958756 - DNA, 25 bp, Mus musculus
gtgccttattcaaggggtgtggaat

SEQ ID NO: 958757 - DNA, 25 bp, Mus musculus
gtgccttcagagtgatccaccttga

SEQ ID NO: 958758 - DNA, 25 bp, Mus musculus
gtgccttcagctgccttggagcact

SEQ ID NO: 958759 - DNA, 25 bp, Mus musculus
gtgccttcaggtgccttggagcact

SEQ ID NO: 958760 - DNA, 25 bp, Mus musculus
gtgccttcagtgtgatccaccttga

SEQ ID NO: 958761 - DNA, 25 bp, Mus musculus
gtgccttccaaagacgcctgctgtt

SEQ ID NO: 958762 - DNA, 25 bp, Mus musculus
gtgccttccaaagaggcctgctgtt

SEQ ID NO: 958763 - DNA, 25 bp, Mus musculus
gtgcctttaacccacgtgactcata

SEQ ID NO: 958764 - DNA, 25 bp, Mus musculus
gtgcctttaacccaggtgactcata

SEQ ID NO: 958765 - DNA, 25 bp, Mus musculus
gtgcctttactccacacaaatcgcc

SEQ ID NO: 958766 - DNA, 25 bp, Mus musculus
gtgcctttactccactgcctatgac

SEQ ID NO: 958767 - DNA, 25 bp, Mus musculus
gtgcctttactccagacaaatcgcc

SEQ ID NO: 958768 - DNA, 25 bp, Mus musculus
gtgcctttactccagtgcctatgac

SEQ ID NO: 958769 - DNA, 25 bp, Mus musculus
gtgcgaatcaccgcagacatgaaga

SEQ ID NO: 958770 - DNA, 25 bp, Mus musculus
gtgcgaatcaccgctgacatgaaga

SEQ ID NO: 958771 - DNA, 25 bp, Mus musculus
gtgcgaccagatctgctgcttactc

SEQ ID NO: 958772 - DNA, 25 bp, Mus musculus
gtgcgaccagctgtctgcctgtatc

SEQ ID NO: 958773 - DNA, 25 bp, Mus musculus
gtgcgaccaggtgtctgcctgtatc

SEQ ID NO: 958774 - DNA, 25 bp, Mus musculus
gtgcgaccagttctgctgcttactc

SEQ ID NO: 958775 - DNA, 25 bp, Mus musculus
gtgcgagcggcttgctgttctggct

SEQ ID NO: 958776 - DNA, 25 bp, Mus musculus
gtgcgagcgggttgctgttctggct

SEQ ID NO: 958777 - DNA, 25 bp, Mus musculus
gtgcgaggagctggagcctactacc

SEQ ID NO: 958778 - DNA, 25 bp, Mus musculus
gtgcgaggaggtggagcctactacc

SEQ ID NO: 958779 - DNA, 25 bp, Mus musculus
gtgcgagtccttaggaaccagacta

SEQ ID NO: 958780 - DNA, 25 bp, Mus musculus
gtgcgagtccttcaaccagactagc

SEQ ID NO: 958781 - DNA, 25 bp, Mus musculus
gtgcgagtccttgaaccagactagc

SEQ ID NO: 958782 - DNA, 25 bp, Mus musculus
gtgcgagtcctttggaaccagacta

SEQ ID NO: 958783 - DNA, 25 bp, Mus musculus
gtgcgataggctgtctataaccctc

SEQ ID NO: 958784 - DNA, 25 bp, Mus musculus
gtgcgatagggtaaaccctcgagac

SEQ ID NO: 958785 - DNA, 25 bp, Mus musculus
gtgcgatagggtgtctataaccctc

SEQ ID NO: 958786 - DNA, 25 bp, Mus musculus
gtgcgatagggttaaccctcgagac

SEQ ID NO: 958787 - DNA, 25 bp, Mus musculus
gtgcgatggctgctatgacatggtg

SEQ ID NO: 958788 - DNA, 25 bp, Mus musculus
gtgcgatggctggtatgacatggtg

SEQ ID NO: 958789 - DNA, 25 bp, Mus musculus
gtgcgatggtgtaacgtggatgatg

SEQ ID NO: 958790 - DNA, 25 bp, Mus musculus
gtgcgatggtgtaaggtggatgatg

SEQ ID NO: 958791 - DNA, 25 bp, Mus musculus
gtgcgcacagccatcattgggaaga

SEQ ID NO: 958792 - DNA, 25 bp, Mus musculus
gtgcgcacaggcatcattgggaaga

SEQ ID NO: 958793 - DNA, 25 bp, Mus musculus
gtgcgcatagagcctcgacttctgt

SEQ ID NO: 958794 - DNA, 25 bp, Mus musculus
gtgcgcatagcttttggctccttcg

SEQ ID NO: 958795 - DNA, 25 bp, Mus musculus
gtgcgcataggttttggctccttcg

SEQ ID NO: 958796 - DNA, 25 bp, Mus musculus
gtgcgcatagtgcctcgacttctgt

SEQ ID NO: 958797 - DNA, 25 bp, Mus musculus
gtgcgcatcatgagcgtggagttct

SEQ ID NO: 958798 - DNA, 25 bp, Mus musculus
gtgcgcatcatgagggtggagttct

SEQ ID NO: 958799 - DNA, 25 bp, Mus musculus
gtgcgccaaggccacagaaatcttg

SEQ ID NO: 958800 - DNA, 25 bp, Mus musculus
gtgcgccaaggccagagaaatcttg

SEQ ID NO: 958801 - DNA, 25 bp, Mus musculus
gtgcgcccagacccagcaccccacc

SEQ ID NO: 958802 - DNA, 25 bp, Mus musculus
gtgcgcccagtcccagcaccccacc

SEQ ID NO: 958803 - DNA, 25 bp, Mus musculus
gtgcgccgcaagctacctgcgctgc

SEQ ID NO: 958804 - DNA, 25 bp, Mus musculus
gtgcgccgcaaggtacctgcgctgc

SEQ ID NO: 958805 - DNA, 25 bp, Mus musculus
gtgcgccgtacacacgaattcttta

SEQ ID NO: 958806 - DNA, 25 bp, Mus musculus
gtgcgccgtacacaggaattcttta

SEQ ID NO: 958807 - DNA, 25 bp, Mus musculus
gtgcgcctgcagctctctgcaagaa

SEQ ID NO: 958808 - DNA, 25 bp, Mus musculus
gtgcgcctgcagctggtggtggaag

SEQ ID NO: 958809 - DNA, 25 bp, Mus musculus
gtgcgcctgcagcttcacattgaga

SEQ ID NO: 958810 - DNA, 25 bp, Mus musculus
gtgcgcctgcaggtctctgcaagaa

SEQ ID NO: 958811 - DNA, 25 bp, Mus musculus
gtgcgcctgcaggtggtggtggaag

SEQ ID NO: 958812 - DNA, 25 bp, Mus musculus
gtgcgcctgcaggttcacattgaga

SEQ ID NO: 958813 - DNA, 25 bp, Mus musculus
gtgcgctccacacgacctgctaaga

SEQ ID NO: 958814 - DNA, 25 bp, Mus musculus
gtgcgctccacaggacctgctaaga

SEQ ID NO: 958815 - DNA, 25 bp, Mus musculus
gtgcggcaagctgttcaatgctcac

SEQ ID NO: 958816 - DNA, 25 bp, Mus musculus
gtgcggcaaggtgttcaatgctcac

SEQ ID NO: 958817 - DNA, 25 bp, Mus musculus
gtgcggcgagacacaccagaagagg

SEQ ID NO: 958818 - DNA, 25 bp, Mus musculus
gtgcggcgagatcccacgggttcct

SEQ ID NO: 958819 - DNA, 25 bp, Mus musculus
gtgcggcgagtcacaccagaagagg

SEQ ID NO: 958820 - DNA, 25 bp, Mus musculus
gtgcggcgagttcccacgggttcct

SEQ ID NO: 958821 - DNA, 25 bp, Mus musculus
gtgcggcgcgccgacggtgtgtggg

SEQ ID NO: 958822 - DNA, 25 bp, Mus musculus
gtgcggcgcgccgacttgaactttc

SEQ ID NO: 958823 - DNA, 25 bp, Mus musculus
gtgcggcgcgccgagggtgtgtggg

SEQ ID NO: 958824 - DNA, 25 bp, Mus musculus
gtgcggcgcgccgagttgaactttc

SEQ ID NO: 958825 - DNA, 25 bp, Mus musculus
gtgcggcggagacttgagcctacgg

SEQ ID NO: 958826 - DNA, 25 bp, Mus musculus
gtgcggcggagagttgagcctacgg

SEQ ID NO: 958827 - DNA, 25 bp, Mus musculus
gtgcgggaactgctcgtgtgatcct

SEQ ID NO: 958828 - DNA, 25 bp, Mus musculus
gtgcgggaactgctggtgtgatcct

SEQ ID NO: 958829 - DNA, 25 bp, Mus musculus
gtgcgggaagcgccggcggccctgg

SEQ ID NO: 958830 - DNA, 25 bp, Mus musculus
gtgcgggaagcggcggcggccctgg

SEQ ID NO: 958831 - DNA, 25 bp, Mus musculus
gtgcgggatatgcacctgtgcccct

SEQ ID NO: 958832 - DNA, 25 bp, Mus musculus
gtgcgggatatgcagctgtgcccct

SEQ ID NO: 958833 - DNA, 25 bp, Mus musculus
gtgcgtcggcttcgcactatacctg

SEQ ID NO: 958834 - DNA, 25 bp, Mus musculus
gtgcgtcggcttcggactatacctg

SEQ ID NO: 958835 - DNA, 25 bp, Mus musculus
gtgcgtgtaacacatgctccatcct

SEQ ID NO: 958836 - DNA, 25 bp, Mus musculus
gtgcgtgtaacacgggctccttatt

SEQ ID NO: 958837 - DNA, 25 bp, Mus musculus
gtgcgtgtaacagatgctccatcct

SEQ ID NO: 958838 - DNA, 25 bp, Mus musculus
gtgcgtgtaacaggggctccttatt

SEQ ID NO: 958839 - DNA, 25 bp, Mus musculus
gtgcgttatcagagtgaagccatag

SEQ ID NO: 958840 - DNA, 25 bp, Mus musculus
gtgcgttatcagtgtgaagccatag

SEQ ID NO: 958841 - DNA, 25 bp, Mus musculus
gtgctaccaaaatccgtaaggagag

SEQ ID NO: 958842 - DNA, 25 bp, Mus musculus
gtgctaccaaaatcggtaaggagag

SEQ ID NO: 958843 - DNA, 25 bp, Mus musculus
gtgctaccttagcatcgagcggtcc

SEQ ID NO: 958844 - DNA, 25 bp, Mus musculus
gtgctaccttaggatcgagcggtcc

SEQ ID NO: 958845 - DNA, 25 bp, Mus musculus
gtgctagatgagccagataaattgt

SEQ ID NO: 958846 - DNA, 25 bp, Mus musculus
gtgctagatgaggcagataaattgt

SEQ ID NO: 958847 - DNA, 25 bp, Mus musculus
gtgctatacacacatcaaggtagtg

SEQ ID NO: 958848 - DNA, 25 bp, Mus musculus
gtgctatacacagatcaaggtagtg

SEQ ID NO: 958849 - DNA, 25 bp, Mus musculus
gtgctatcaacacacgcattcctga

SEQ ID NO: 958850 - DNA, 25 bp, Mus musculus
gtgctatcaacacaggcattcctga

SEQ ID NO: 958851 - DNA, 25 bp, Mus musculus
gtgctatgaagcaacctacagccag

SEQ ID NO: 958852 - DNA, 25 bp, Mus musculus
gtgctatgaagcactggccatgggc

SEQ ID NO: 958853 - DNA, 25 bp, Mus musculus
gtgctatgaagctacctacagccag

SEQ ID NO: 958854 - DNA, 25 bp, Mus musculus
gtgctatgaagctctggccatgggc

SEQ ID NO: 958855 - DNA, 25 bp, Mus musculus
gtgctattccttcacgtcgctggat

SEQ ID NO: 958856 - DNA, 25 bp, Mus musculus
gtgctattccttcaggtcgctggat

SEQ ID NO: 958857 - DNA, 25 bp, Mus musculus
gtgctcaatcagcgaatggagatcg

SEQ ID NO: 958858 - DNA, 25 bp, Mus musculus
gtgctcaatcagggaatggagatcg

SEQ ID NO: 958859 - DNA, 25 bp, Mus musculus
gtgctcactgccaacgggacaatga

SEQ ID NO: 958860 - DNA, 25 bp, Mus musculus
gtgctcactgccaacgtgaaagcag

SEQ ID NO: 958861 - DNA, 25 bp, Mus musculus
gtgctcactgccaaggggacaatga

SEQ ID NO: 958862 - DNA, 25 bp, Mus musculus
gtgctcactgccaaggtgaaagcag

SEQ ID NO: 958863 - DNA, 25 bp, Mus musculus
gtgctcatcaatacatttggtgcca

SEQ ID NO: 958864 - DNA, 25 bp, Mus musculus
gtgctcatcaattcatttggtgcca

SEQ ID NO: 958865 - DNA, 25 bp, Mus musculus
gtgctcattgctattgctaataccc

SEQ ID NO: 958866 - DNA, 25 bp, Mus musculus
gtgctcattggtattgctaataccc

SEQ ID NO: 958867 - DNA, 25 bp, Mus musculus
gtgctcccagatcgtgtcataagcc

SEQ ID NO: 958868 - DNA, 25 bp, Mus musculus
gtgctcccagatggtgtcataagcc

SEQ ID NO: 958869 - DNA, 25 bp, Mus musculus
gtgctcccagcggtgatctgctttg

SEQ ID NO: 958870 - DNA, 25 bp, Mus musculus
gtgctcccaggggtgatctgctttg

SEQ ID NO: 958871 - DNA, 25 bp, Mus musculus
gtgctccctcagctcctcctggact

SEQ ID NO: 958872 - DNA, 25 bp, Mus musculus
gtgctccctcagctgctcctggact

SEQ ID NO: 958873 - DNA, 25 bp, Mus musculus
gtgctccggcaacacgtggaagatc

SEQ ID NO: 958874 - DNA, 25 bp, Mus musculus
gtgctccggcaacaggtggaagatc

SEQ ID NO: 958875 - DNA, 25 bp, Mus musculus
gtgctcctagcccacatcccaccct

SEQ ID NO: 958876 - DNA, 25 bp, Mus musculus
gtgctcctagcccagatcccaccct

SEQ ID NO: 958877 - DNA, 25 bp, Mus musculus
gtgctcctctcttgctcaaactaca

SEQ ID NO: 958878 - DNA, 25 bp, Mus musculus
gtgctcctctcttggtcaaactaca

SEQ ID NO: 958879 - DNA, 25 bp, Mus musculus
gtgctcgaagcatctacaccagtgt

SEQ ID NO: 958880 - DNA, 25 bp, Mus musculus
gtgctcgaaggatctacaccagtgt

SEQ ID NO: 958881 - DNA, 25 bp, Mus musculus
gtgctctcgacacgaagtcatctcc

SEQ ID NO: 958882 - DNA, 25 bp, Mus musculus
gtgctctcgacaggaagtcatctcc

SEQ ID NO: 958883 - DNA, 25 bp, Mus musculus
gtgctctcgggagacgttctaaatg

SEQ ID NO: 958884 - DNA, 25 bp, Mus musculus
gtgctctcgggagaggttctaaatg

SEQ ID NO: 958885 - DNA, 25 bp, Mus musculus
gtgctctctaagcgccatgcagctc

SEQ ID NO: 958886 - DNA, 25 bp, Mus musculus
gtgctctctaagggccatgcagctc

SEQ ID NO: 958887 - DNA, 25 bp, Mus musculus
gtgctcttggagaacttcatcagtg

SEQ ID NO: 958888 - DNA, 25 bp, Mus musculus
gtgctcttggagaagttcatcagtg

SEQ ID NO: 958889 - DNA, 25 bp, Mus musculus
gtgctgaaagcgttcaacttctctg

SEQ ID NO: 958890 - DNA, 25 bp, Mus musculus
gtgctgaaagctattcccaagccag

SEQ ID NO: 958891 - DNA, 25 bp, Mus musculus
gtgctgaaagggttcaacttctctg

SEQ ID NO: 958892 - DNA, 25 bp, Mus musculus
gtgctgaaaggtattcccaagccag

SEQ ID NO: 958893 - DNA, 25 bp, Mus musculus
gtgctgaagcctttcgcaagattgt

SEQ ID NO: 958894 - DNA, 25 bp, Mus musculus
gtgctgaagcctttggcaagattgt

SEQ ID NO: 958895 - DNA, 25 bp, Mus musculus
gtgctgaagctacacggttgaaaaa

SEQ ID NO: 958896 - DNA, 25 bp, Mus musculus
gtgctgaagctacagggttgaaaaa

SEQ ID NO: 958897 - DNA, 25 bp, Mus musculus
gtgctgacagcgtccctccctaagc

SEQ ID NO: 958898 - DNA, 25 bp, Mus musculus
gtgctgacagggtccctccctaagc

SEQ ID NO: 958899 - DNA, 25 bp, Mus musculus
gtgctgaccgttcaatcttttgagc

SEQ ID NO: 958900 - DNA, 25 bp, Mus musculus
gtgctgaccgttgaatcttttgagc

SEQ ID NO: 958901 - DNA, 25 bp, Mus musculus
gtgctgagagtcggcccctgtctcc

SEQ ID NO: 958902 - DNA, 25 bp, Mus musculus
gtgctgagagtcggcggcctggtgt

SEQ ID NO: 958903 - DNA, 25 bp, Mus musculus
gtgctgagagtcgggccctgtctcc

SEQ ID NO: 958904 - DNA, 25 bp, Mus musculus
gtgctgagagtcgggggcctggtgt

SEQ ID NO: 958905 - DNA, 25 bp, Mus musculus
gtgctgagattacacaggcctcatt

SEQ ID NO: 958906 - DNA, 25 bp, Mus musculus
gtgctgagattacagaggcctcatt

SEQ ID NO: 958907 - DNA, 25 bp, Mus musculus
gtgctgcacctgaacaatgctgaca

SEQ ID NO: 958908 - DNA, 25 bp, Mus musculus
gtgctgcacctgtacaatgctgaca

SEQ ID NO: 958909 - DNA, 25 bp, Mus musculus
gtgctgcagcagattgtcaatctga

SEQ ID NO: 958910 - DNA, 25 bp, Mus musculus
gtgctgcagcagtttgtcaatctga

SEQ ID NO: 958911 - DNA, 25 bp, Mus musculus
gtgctgcagcgagacgtggaggtag

SEQ ID NO: 958912 - DNA, 25 bp, Mus musculus
gtgctgcagcgagaggtggaggtag

SEQ ID NO: 958913 - DNA, 25 bp, Mus musculus
gtgctgcaggaggctgtgcctggct

SEQ ID NO: 958914 - DNA, 25 bp, Mus musculus
gtgctgcaggtggctgtgcctggct

SEQ ID NO: 958915 - DNA, 25 bp, Mus musculus
gtgctgccagaggaagacctcacgt

SEQ ID NO: 958916 - DNA, 25 bp, Mus musculus
gtgctgccagctgaggaggagctga

SEQ ID NO: 958917 - DNA, 25 bp, Mus musculus
gtgctgccaggtgaggaggagctga

SEQ ID NO: 958918 - DNA, 25 bp, Mus musculus
gtgctgccagtggaagacctcacgt

SEQ ID NO: 958919 - DNA, 25 bp, Mus musculus
gtgctgcccatgccactggagctcg

SEQ ID NO: 958920 - DNA, 25 bp, Mus musculus
gtgctgcccatggcactggagctcg

SEQ ID NO: 958921 - DNA, 25 bp, Mus musculus
gtgctgcctgagccctaggaccatg

SEQ ID NO: 958922 - DNA, 25 bp, Mus musculus
gtgctgcctgaggcctaggaccatg

SEQ ID NO: 958923 - DNA, 25 bp, Mus musculus
gtgctgccttatggcgagtgaactt

SEQ ID NO: 958924 - DNA, 25 bp, Mus musculus
gtgctgccttatggggagtgaactt

SEQ ID NO: 958925 - DNA, 25 bp, Mus musculus
gtgctgcgacaacgcccttggactg

SEQ ID NO: 958926 - DNA, 25 bp, Mus musculus
gtgctgcgacaaggcccttggactg

SEQ ID NO: 958927 - DNA, 25 bp, Mus musculus
gtgctgctcaagcctcccccggctt

SEQ ID NO: 958928 - DNA, 25 bp, Mus musculus
gtgctgctcaaggctcccccggctt

SEQ ID NO: 958929 - DNA, 25 bp, Mus musculus
gtgctgctccagaactatggcatga

SEQ ID NO: 958930 - DNA, 25 bp, Mus musculus
gtgctgctccagtactatggcatga

SEQ ID NO: 958931 - DNA, 25 bp, Mus musculus
gtgctgctcctacgcaatgactaca

SEQ ID NO: 958932 - DNA, 25 bp, Mus musculus
gtgctgctcctaggcaatgactaca

SEQ ID NO: 958933 - DNA, 25 bp, Mus musculus
gtgctgctcttcttatatatgatca

SEQ ID NO: 958934 - DNA, 25 bp, Mus musculus
gtgctgctcttcttttatatgatca

SEQ ID NO: 958935 - DNA, 25 bp, Mus musculus
gtgctgcttaatcccatcagtgtct

SEQ ID NO: 958936 - DNA, 25 bp, Mus musculus
gtgctgcttaatccgatcagtgtct

SEQ ID NO: 958937 - DNA, 25 bp, Mus musculus
gtgctggagtgagacagcctgtgct

SEQ ID NO: 958938 - DNA, 25 bp, Mus musculus
gtgctggagtgagacaggaggagcg

SEQ ID NO: 958939 - DNA, 25 bp, Mus musculus
gtgctggagtgagacctgggaagtc

SEQ ID NO: 958940 - DNA, 25 bp, Mus musculus
gtgctggagtgagagagcctgtgct

SEQ ID NO: 958941 - DNA, 25 bp, Mus musculus
gtgctggagtgagagaggaggagcg

SEQ ID NO: 958942 - DNA, 25 bp, Mus musculus
gtgctggagtgagagctgggaagtc

SEQ ID NO: 958943 - DNA, 25 bp, Mus musculus
gtgctggcctgccgctatgtttcag

SEQ ID NO: 958944 - DNA, 25 bp, Mus musculus
gtgctggcctgccggtatgtttcag

SEQ ID NO: 958945 - DNA, 25 bp, Mus musculus
gtgctgggactaaacgggacagctg

SEQ ID NO: 958946 - DNA, 25 bp, Mus musculus
gtgctgggactaaaggggacagctg

SEQ ID NO: 958947 - DNA, 25 bp, Mus musculus
gtgctgggactgctcggcccgctgc

SEQ ID NO: 958948 - DNA, 25 bp, Mus musculus
gtgctgggactgctgggcccgctgc

SEQ ID NO: 958949 - DNA, 25 bp, Mus musculus
gtgctgggagctgtcattgccggag

SEQ ID NO: 958950 - DNA, 25 bp, Mus musculus
gtgctgggaggtgtcattgccggag

SEQ ID NO: 958951 - DNA, 25 bp, Mus musculus
gtgctgggattacacgttggcttcc

SEQ ID NO: 958952 - DNA, 25 bp, Mus musculus
gtgctgggattacaggttggcttcc

SEQ ID NO: 958953 - DNA, 25 bp, Mus musculus
gtgctgggattagacgagttggaac

SEQ ID NO: 958954 - DNA, 25 bp, Mus musculus
gtgctgggattagaggagttggaac

SEQ ID NO: 958955 - DNA, 25 bp, Mus musculus
gtgctgggattgcacttttcaaaga

SEQ ID NO: 958956 - DNA, 25 bp, Mus musculus
gtgctgggattgcagttttcaaaga

SEQ ID NO: 958957 - DNA, 25 bp, Mus musculus
gtgctggtagccccacagaacatga

SEQ ID NO: 958958 - DNA, 25 bp, Mus musculus
gtgctggtaggcccacagaacatga

SEQ ID NO: 958959 - DNA, 25 bp, Mus musculus
gtgctggtcaatgacaaacctttga

SEQ ID NO: 958960 - DNA, 25 bp, Mus musculus
gtgctggtcaatgagaaacctttga

SEQ ID NO: 958961 - DNA, 25 bp, Mus musculus
gtgctggtggcggaagaactgtatt

SEQ ID NO: 958962 - DNA, 25 bp, Mus musculus
gtgctggtgggcagccttcattctg

SEQ ID NO: 958963 - DNA, 25 bp, Mus musculus
gtgctggtgggcaggcttcattctg

SEQ ID NO: 958964 - DNA, 25 bp, Mus musculus
gtgctggtgggggaagaactgtatt

SEQ ID NO: 958965 - DNA, 25 bp, Mus musculus
gtgctggtgtcctacgccacagaag

SEQ ID NO: 958966 - DNA, 25 bp, Mus musculus
gtgctggtgtcctaggccacagaag

SEQ ID NO: 958967 - DNA, 25 bp, Mus musculus
gtgctgtagctaaacgagttcatac

SEQ ID NO: 958968 - DNA, 25 bp, Mus musculus
gtgctgtagctaaaggagttcatac

SEQ ID NO: 958969 - DNA, 25 bp, Mus musculus
gtgctgtctgtgagccatggcatgg

SEQ ID NO: 958970 - DNA, 25 bp, Mus musculus
gtgctgtctgtgaggcatggcatgg

SEQ ID NO: 958971 - DNA, 25 bp, Mus musculus
gtgctgtgagagtttccaccactcc

SEQ ID NO: 958972 - DNA, 25 bp, Mus musculus
gtgctgtgagtgtttccaccactcc

SEQ ID NO: 958973 - DNA, 25 bp, Mus musculus
gtgctgtgcgcttctattccaagga

SEQ ID NO: 958974 - DNA, 25 bp, Mus musculus
gtgctgtgcggttctattccaagga

SEQ ID NO: 958975 - DNA, 25 bp, Mus musculus
gtgctgtggatgcccccagaagtaa

SEQ ID NO: 958976 - DNA, 25 bp, Mus musculus
gtgctgtggatggccccagaagtaa

SEQ ID NO: 958977 - DNA, 25 bp, Mus musculus
gtgctgtgtgcctcagtgctaggtt

SEQ ID NO: 958978 - DNA, 25 bp, Mus musculus
gtgctgtgtgcctctgtgctaggtt

SEQ ID NO: 958979 - DNA, 25 bp, Mus musculus
gtgctgttggagcaactgtactgag

SEQ ID NO: 958980 - DNA, 25 bp, Mus musculus
gtgctgttggaggaactgtactgag

SEQ ID NO: 958981 - DNA, 25 bp, Mus musculus
gtgcttatgacacgattgtggttgc

SEQ ID NO: 958982 - DNA, 25 bp, Mus musculus
gtgcttatgacacgctgaagccatc

SEQ ID NO: 958983 - DNA, 25 bp, Mus musculus
gtgcttatgacaggattgtggttgc

SEQ ID NO: 958984 - DNA, 25 bp, Mus musculus
gtgcttatgacaggctgaagccatc

SEQ ID NO: 958985 - DNA, 25 bp, Mus musculus
gtgcttattatgctggataataaga

SEQ ID NO: 958986 - DNA, 25 bp, Mus musculus
gtgcttattatggtggataataaga

SEQ ID NO: 958987 - DNA, 25 bp, Mus musculus
gtgcttcagcagattgtgaagaaat

SEQ ID NO: 958988 - DNA, 25 bp, Mus musculus
gtgcttcagcagtttgtgaagaaat

SEQ ID NO: 958989 - DNA, 25 bp, Mus musculus
gtgcttcatgaccacctacacactt

SEQ ID NO: 958990 - DNA, 25 bp, Mus musculus
gtgcttcatgaccagctacacactt

SEQ ID NO: 958991 - DNA, 25 bp, Mus musculus
gtgcttccaaagcacaggctggctc

SEQ ID NO: 958992 - DNA, 25 bp, Mus musculus
gtgcttccaaagccaggtgtcagat

SEQ ID NO: 958993 - DNA, 25 bp, Mus musculus
gtgcttccaaaggacaggctggctc

SEQ ID NO: 958994 - DNA, 25 bp, Mus musculus
gtgcttccaaaggcaggtgtcagat

SEQ ID NO: 958995 - DNA, 25 bp, Mus musculus
gtgcttccagagctttctaaggtgc

SEQ ID NO: 958996 - DNA, 25 bp, Mus musculus
gtgcttccagaggtttctaaggtgc

SEQ ID NO: 958997 - DNA, 25 bp, Mus musculus
gtgcttctcctccacctaaaccgga

SEQ ID NO: 958998 - DNA, 25 bp, Mus musculus
gtgcttctcctccagctaaaccgga

SEQ ID NO: 958999 - DNA, 25 bp, Mus musculus
gtgcttctgtagaaggggtgagccg

SEQ ID NO: 959000 - DNA, 25 bp, Mus musculus
gtgcttctgttgaaggggtgagccg

SEQ ID NO: 959001 - DNA, 25 bp, Mus musculus
gtgcttgcagagcttgtgactgcca

SEQ ID NO: 959002 - DNA, 25 bp, Mus musculus
gtgcttgcagaggttgtgactgcca

SEQ ID NO: 959003 - DNA, 25 bp, Mus musculus
gtgcttggcgcgaaaaggtggacaa

SEQ ID NO: 959004 - DNA, 25 bp, Mus musculus
gtgcttggcgcgatatgctaatgaa

SEQ ID NO: 959005 - DNA, 25 bp, Mus musculus
gtgcttggcgcgctgaaggcgataa

SEQ ID NO: 959006 - DNA, 25 bp, Mus musculus
gtgcttggcgcggtgaaggcgataa

SEQ ID NO: 959007 - DNA, 25 bp, Mus musculus
gtgcttggcgcgtaaaggtggacaa

SEQ ID NO: 959008 - DNA, 25 bp, Mus musculus
gtgcttggcgcgttatgctaatgaa

SEQ ID NO: 959009 - DNA, 25 bp, Mus musculus
gtgcttggtgagaaggaagagtgtg

SEQ ID NO: 959010 - DNA, 25 bp, Mus musculus
gtgcttggtgagtaggaagagtgtg

SEQ ID NO: 959011 - DNA, 25 bp, Mus musculus
gtgcttgtcatacaactgggcggca

SEQ ID NO: 959012 - DNA, 25 bp, Mus musculus
gtgcttgtcatagaactgggcggca

SEQ ID NO: 959013 - DNA, 25 bp, Mus musculus
gtgctttcagctcagacagccatgg

SEQ ID NO: 959014 - DNA, 25 bp, Mus musculus
gtgctttcaggtcagacagccatgg

SEQ ID NO: 959015 - DNA, 25 bp, Mus musculus
gtgctttgccaacgctgaactcacg

SEQ ID NO: 959016 - DNA, 25 bp, Mus musculus
gtgctttgccaaggctgaactcacg

SEQ ID NO: 959017 - DNA, 25 bp, Mus musculus
gtgcttttcacgcaaggagttcgct

SEQ ID NO: 959018 - DNA, 25 bp, Mus musculus
gtgcttttcacggaaggagttcgct

SEQ ID NO: 959019 - DNA, 25 bp, Mus musculus
gtggaaaagtgtgacaccatccatg

SEQ ID NO: 959020 - DNA, 25 bp, Mus musculus
gtggaaaagtgtgagaccatccatg

SEQ ID NO: 959021 - DNA, 25 bp, Mus musculus
gtggaaaatgctaaaattgtactga

SEQ ID NO: 959022 - DNA, 25 bp, Mus musculus
gtggaaaatggtaaaattgtactga

SEQ ID NO: 959023 - DNA, 25 bp, Mus musculus
gtggaaacaatgcccactttatcgc

SEQ ID NO: 959024 - DNA, 25 bp, Mus musculus
gtggaaacaatggccactttatcgc

SEQ ID NO: 959025 - DNA, 25 bp, Mus musculus
gtggaaacagcatgttctcacagca

SEQ ID NO: 959026 - DNA, 25 bp, Mus musculus
gtggaaacaggatgttctcacagca

SEQ ID NO: 959027 - DNA, 25 bp, Mus musculus
gtggaaagaaaacactgacaacata

SEQ ID NO: 959028 - DNA, 25 bp, Mus musculus
gtggaaagaaaacagtgacaacata

SEQ ID NO: 959029 - DNA, 25 bp, Mus musculus
gtggaaagattgagttcaggagggg

SEQ ID NO: 959030 - DNA, 25 bp, Mus musculus
gtggaaagattgtgttcaggagggg

SEQ ID NO: 959031 - DNA, 25 bp, Mus musculus
gtggaaagccgacaagggtgacagg

SEQ ID NO: 959032 - DNA, 25 bp, Mus musculus
gtggaaagccgagaagggtgacagg

SEQ ID NO: 959033 - DNA, 25 bp, Mus musculus
gtggaaaggatgcactgtgtggctg

SEQ ID NO: 959034 - DNA, 25 bp, Mus musculus
gtggaaaggatgcagtgtgtggctg

SEQ ID NO: 959035 - DNA, 25 bp, Mus musculus
gtggaaaggcagctgtccacagcca

SEQ ID NO: 959036 - DNA, 25 bp, Mus musculus
gtggaaaggcaggtgtccacagcca

SEQ ID NO: 959037 - DNA, 25 bp, Mus musculus
gtggaaatagcaaaaccagcaagta

SEQ ID NO: 959038 - DNA, 25 bp, Mus musculus
gtggaaatagcgcgtaccactgatg

SEQ ID NO: 959039 - DNA, 25 bp, Mus musculus
gtggaaatagcgggtaccactgatg

SEQ ID NO: 959040 - DNA, 25 bp, Mus musculus
gtggaaataggaaaaccagcaagta

SEQ ID NO: 959041 - DNA, 25 bp, Mus musculus
gtggaaatccagcctgttcatcagc

SEQ ID NO: 959042 - DNA, 25 bp, Mus musculus
gtggaaatccagcgcagagatgacc

SEQ ID NO: 959043 - DNA, 25 bp, Mus musculus
gtggaaatccaggctgttcatcagc

SEQ ID NO: 959044 - DNA, 25 bp, Mus musculus
gtggaaatccagggcagagatgacc

SEQ ID NO: 959045 - DNA, 25 bp, Mus musculus
gtggaaatggggaacttctgtggcc

SEQ ID NO: 959046 - DNA, 25 bp, Mus musculus
gtggaaatggggcactttctgcatc

SEQ ID NO: 959047 - DNA, 25 bp, Mus musculus
gtggaaatgggggactttctgcatc

SEQ ID NO: 959048 - DNA, 25 bp, Mus musculus
gtggaaatggggtacttctgtggcc

SEQ ID NO: 959049 - DNA, 25 bp, Mus musculus
gtggaaattgctcttggtgacaaag

SEQ ID NO: 959050 - DNA, 25 bp, Mus musculus
gtggaaattgctgttggtgacaaag

SEQ ID NO: 959051 - DNA, 25 bp, Mus musculus
gtggaaatttggcagcttggataat

SEQ ID NO: 959052 - DNA, 25 bp, Mus musculus
gtggaaatttgggagcttggataat

SEQ ID NO: 959053 - DNA, 25 bp, Mus musculus
gtggaacaagagctagccattgagc

SEQ ID NO: 959054 - DNA, 25 bp, Mus musculus
gtggaacaagtgctagccattgagc

SEQ ID NO: 959055 - DNA, 25 bp, Mus musculus
gtggaacactgaagacatgctgttt

SEQ ID NO: 959056 - DNA, 25 bp, Mus musculus
gtggaacactgatgacatgctgttt

SEQ ID NO: 959057 - DNA, 25 bp, Mus musculus
gtggaacagatgcgttgcaaacatg

SEQ ID NO: 959058 - DNA, 25 bp, Mus musculus
gtggaacagatgggttgcaaacatg

SEQ ID NO: 959059 - DNA, 25 bp, Mus musculus
gtggaacatgaaccccgtgtgccca

SEQ ID NO: 959060 - DNA, 25 bp, Mus musculus
gtggaacatgaagcccgtgtgccca

SEQ ID NO: 959061 - DNA, 25 bp, Mus musculus
gtggaacctttgcccctcattttcc

SEQ ID NO: 959062 - DNA, 25 bp, Mus musculus
gtggaacctttgccgctcattttcc

SEQ ID NO: 959063 - DNA, 25 bp, Mus musculus
gtggaacgtatgatcgaaatttcta

SEQ ID NO: 959064 - DNA, 25 bp, Mus musculus
gtggaacgtatgatggaaatttcta

SEQ ID NO: 959065 - DNA, 25 bp, Mus musculus
gtggaactacagccaaccccaaagg

SEQ ID NO: 959066 - DNA, 25 bp, Mus musculus
gtggaactacaggcaaccccaaagg

SEQ ID NO: 959067 - DNA, 25 bp, Mus musculus
gtggaactggaacgtgattatcgag

SEQ ID NO: 959068 - DNA, 25 bp, Mus musculus
gtggaactggaaggtgattatcgag

SEQ ID NO: 959069 - DNA, 25 bp, Mus musculus
gtggaagaaaccacattgtagtctg

SEQ ID NO: 959070 - DNA, 25 bp, Mus musculus
gtggaagaaagcacattgtagtctg

SEQ ID NO: 959071 - DNA, 25 bp, Mus musculus
gtggaagaagctcagcaacttatga

SEQ ID NO: 959072 - DNA, 25 bp, Mus musculus
gtggaagaagctgagcaacttatga

SEQ ID NO: 959073 - DNA, 25 bp, Mus musculus
gtggaagacaccatcattggacctc

SEQ ID NO: 959074 - DNA, 25 bp, Mus musculus
gtggaagacagcatcattggacctc

SEQ ID NO: 959075 - DNA, 25 bp, Mus musculus
gtggaagacgccaaggggatcaagc

SEQ ID NO: 959076 - DNA, 25 bp, Mus musculus
gtggaagacggcaaggggatcaagc

SEQ ID NO: 959077 - DNA, 25 bp, Mus musculus
gtggaagcacatccagaaggagctt

SEQ ID NO: 959078 - DNA, 25 bp, Mus musculus
gtggaagcacatcctgaaggagctt

SEQ ID NO: 959079 - DNA, 25 bp, Mus musculus
gtggaagccgagcttagcaacatta

SEQ ID NO: 959080 - DNA, 25 bp, Mus musculus
gtggaagccgaggttagcaacatta

SEQ ID NO: 959081 - DNA, 25 bp, Mus musculus
gtggaagcgaaggtgaatgagaatg

SEQ ID NO: 959082 - DNA, 25 bp, Mus musculus
gtggaagcgatggtgaatgagaatg

SEQ ID NO: 959083 - DNA, 25 bp, Mus musculus
gtggaagggcatagccagccaccta

SEQ ID NO: 959084 - DNA, 25 bp, Mus musculus
gtggaagggcataggcagccaccta

SEQ ID NO: 959085 - DNA, 25 bp, Mus musculus
gtggaagggctaatcaccacagtcc

SEQ ID NO: 959086 - DNA, 25 bp, Mus musculus
gtggaagggctaatgaccacagtcc

SEQ ID NO: 959087 - DNA, 25 bp, Mus musculus
gtggaaggtccacctatccttgacc

SEQ ID NO: 959088 - DNA, 25 bp, Mus musculus
gtggaaggtccagctatccttgacc

SEQ ID NO: 959089 - DNA, 25 bp, Mus musculus
gtggaagtcgccctgttatgagaca

SEQ ID NO: 959090 - DNA, 25 bp, Mus musculus
gtggaagtcggcctgttatgagaca

SEQ ID NO: 959091 - DNA, 25 bp, Mus musculus
gtggaagtgcagcagaagtccagcg

SEQ ID NO: 959092 - DNA, 25 bp, Mus musculus
gtggaagtgcaggagaagtccagcg

SEQ ID NO: 959093 - DNA, 25 bp, Mus musculus
gtggaagtgctgaacgcagggaagc

SEQ ID NO: 959094 - DNA, 25 bp, Mus musculus
gtggaagtgctgaaggcagggaagc

SEQ ID NO: 959095 - DNA, 25 bp, Mus musculus
gtggaatgagattcatgaagcttgt

SEQ ID NO: 959096 - DNA, 25 bp, Mus musculus
gtggaatgagtttcatgaagcttgt

SEQ ID NO: 959097 - DNA, 25 bp, Mus musculus
gtggaatggaagacctgtgacttgg

SEQ ID NO: 959098 - DNA, 25 bp, Mus musculus
gtggaatggaagtcctgtgacttgg

SEQ ID NO: 959099 - DNA, 25 bp, Mus musculus
gtggaatgttagaacagagactcag

SEQ ID NO: 959100 - DNA, 25 bp, Mus musculus
gtggaatgttagagactcagccatg

SEQ ID NO: 959101 - DNA, 25 bp, Mus musculus
gtggaatgttagtacagagactcag

SEQ ID NO: 959102 - DNA, 25 bp, Mus musculus
gtggaatgttagtgactcagccatg

SEQ ID NO: 959103 - DNA, 25 bp, Mus musculus
gtggacaaatccaggtggctcctcc

SEQ ID NO: 959104 - DNA, 25 bp, Mus musculus
gtggacaaatcctggtggctcctcc

SEQ ID NO: 959105 - DNA, 25 bp, Mus musculus
gtggacaaggaacactttctctgtg

SEQ ID NO: 959106 - DNA, 25 bp, Mus musculus
gtggacaaggaacgttctgagcctg

SEQ ID NO: 959107 - DNA, 25 bp, Mus musculus
gtggacaaggaagactttctctgtg

SEQ ID NO: 959108 - DNA, 25 bp, Mus musculus
gtggacaaggaaggttctgagcctg

SEQ ID NO: 959109 - DNA, 25 bp, Mus musculus
gtggacaatcatcgctgtcatggta

SEQ ID NO: 959110 - DNA, 25 bp, Mus musculus
gtggacaatcatggctgtcatggta

SEQ ID NO: 959111 - DNA, 25 bp, Mus musculus
gtggacacctatcaacttgcgatgt

SEQ ID NO: 959112 - DNA, 25 bp, Mus musculus
gtggacacctatcttttcaaagata

SEQ ID NO: 959113 - DNA, 25 bp, Mus musculus
gtggacacctatgaacttgcgatgt

SEQ ID NO: 959114 - DNA, 25 bp, Mus musculus
gtggacacctatgttttcaaagata

SEQ ID NO: 959115 - DNA, 25 bp, Mus musculus
gtggacacgatccgtcagatgtcct

SEQ ID NO: 959116 - DNA, 25 bp, Mus musculus
gtggacacgatcggtcagatgtcct

SEQ ID NO: 959117 - DNA, 25 bp, Mus musculus
gtggacacgtacaccgtttatgtca

SEQ ID NO: 959118 - DNA, 25 bp, Mus musculus
gtggacacgtacacggtttatgtca

SEQ ID NO: 959119 - DNA, 25 bp, Mus musculus
gtggacactggaaggtctacgtctg

SEQ ID NO: 959120 - DNA, 25 bp, Mus musculus
gtggacactggagacgtctacgtct

SEQ ID NO: 959121 - DNA, 25 bp, Mus musculus
gtggacactggagaggtctacgtct

SEQ ID NO: 959122 - DNA, 25 bp, Mus musculus
gtggacactggatggtctacgtctg

SEQ ID NO: 959123 - DNA, 25 bp, Mus musculus
gtggacacttaacacgtccccaggc

SEQ ID NO: 959124 - DNA, 25 bp, Mus musculus
gtggacacttaacaggtccccaggc

SEQ ID NO: 959125 - DNA, 25 bp, Mus musculus
gtggacatctacactttccccaagg

SEQ ID NO: 959126 - DNA, 25 bp, Mus musculus
gtggacatctactctttccccaagg

SEQ ID NO: 959127 - DNA, 25 bp, Mus musculus
gtggacatctccaacatgcacatga

SEQ ID NO: 959128 - DNA, 25 bp, Mus musculus
gtggacatctccaagatgcacatga

SEQ ID NO: 959129 - DNA, 25 bp, Mus musculus
gtggacatgaaactggccgaggtcc

SEQ ID NO: 959130 - DNA, 25 bp, Mus musculus
gtggacatgaaagtggccgaggtcc

SEQ ID NO: 959131 - DNA, 25 bp, Mus musculus
gtggacattgccacatctctgatcc

SEQ ID NO: 959132 - DNA, 25 bp, Mus musculus
gtggacattggcacatctctgatcc

SEQ ID NO: 959133 - DNA, 25 bp, Mus musculus
gtggaccaagccaccaagggaatag

SEQ ID NO: 959134 - DNA, 25 bp, Mus musculus
gtggaccaagcgtggatgcgagctg

SEQ ID NO: 959135 - DNA, 25 bp, Mus musculus
gtggaccaaggcaccaagggaatag

SEQ ID NO: 959136 - DNA, 25 bp, Mus musculus
gtggaccaagggtggatgcgagctg

SEQ ID NO: 959137 - DNA, 25 bp, Mus musculus
gtggaccaggacaacatatttcaag

SEQ ID NO: 959138 - DNA, 25 bp, Mus musculus
gtggaccaggacaagatatttcaag

SEQ ID NO: 959139 - DNA, 25 bp, Mus musculus
gtggaccatcggcgtacctggaatg

SEQ ID NO: 959140 - DNA, 25 bp, Mus musculus
gtggaccatcggggtacctggaatg

SEQ ID NO: 959141 - DNA, 25 bp, Mus musculus
gtggaccccaaacgccatgaagaag

SEQ ID NO: 959142 - DNA, 25 bp, Mus musculus
gtggaccccaaaggccatgaagaag

SEQ ID NO: 959143 - DNA, 25 bp, Mus musculus
gtggaccctgagatccaccaggtga

SEQ ID NO: 959144 - DNA, 25 bp, Mus musculus
gtggaccctgagttccaccaggtga

SEQ ID NO: 959145 - DNA, 25 bp, Mus musculus
gtggacctttcaaacatacccctga

SEQ ID NO: 959146 - DNA, 25 bp, Mus musculus
gtggacctttcaaagatacccctga

SEQ ID NO: 959147 - DNA, 25 bp, Mus musculus
gtggaccttttgcgtattgcagttg

SEQ ID NO: 959148 - DNA, 25 bp, Mus musculus
gtggaccttttgggtattgcagttg

SEQ ID NO: 959149 - DNA, 25 bp, Mus musculus
gtggacggccagcgaagtctcgtga

SEQ ID NO: 959150 - DNA, 25 bp, Mus musculus
gtggacggccagggaagtctcgtga

SEQ ID NO: 959151 - DNA, 25 bp, Mus musculus
gtggacggggagctgctgaggacta

SEQ ID NO: 959152 - DNA, 25 bp, Mus musculus
gtggacggggaggtgctgaggacta

SEQ ID NO: 959153 - DNA, 25 bp, Mus musculus
gtggactcagacatataaagaacag

SEQ ID NO: 959154 - DNA, 25 bp, Mus musculus
gtggactcagtcatataaagaacag

SEQ ID NO: 959155 - DNA, 25 bp, Mus musculus
gtggactccggacgaacctggctca

SEQ ID NO: 959156 - DNA, 25 bp, Mus musculus
gtggactccggaggaacctggctca

SEQ ID NO: 959157 - DNA, 25 bp, Mus musculus
gtggactccgtgaacacacggatgc

SEQ ID NO: 959158 - DNA, 25 bp, Mus musculus
gtggactccgtgaagacacggatgc

SEQ ID NO: 959159 - DNA, 25 bp, Mus musculus
gtggactggtttttcattcacaagg

SEQ ID NO: 959160 - DNA, 25 bp, Mus musculus
gtggactggtttttgattcacaagg

SEQ ID NO: 959161 - DNA, 25 bp, Mus musculus
gtggactgtcagactgctgggctga

SEQ ID NO: 959162 - DNA, 25 bp, Mus musculus
gtggactgtcagcattctctttcaa

SEQ ID NO: 959163 - DNA, 25 bp, Mus musculus
gtggactgtcaggattctctttcaa

SEQ ID NO: 959164 - DNA, 25 bp, Mus musculus
gtggactgtcagtctgctgggctga

SEQ ID NO: 959165 - DNA, 25 bp, Mus musculus
gtggacttagagcatcactcttaca

SEQ ID NO: 959166 - DNA, 25 bp, Mus musculus
gtggacttagaggatcactcttaca

SEQ ID NO: 959167 - DNA, 25 bp, Mus musculus
gtggacttggaacacgtagccaatg

SEQ ID NO: 959168 - DNA, 25 bp, Mus musculus
gtggacttggaacaggtagccaatg

SEQ ID NO: 959169 - DNA, 25 bp, Mus musculus
gtggactttgaacagtttgtccgga

SEQ ID NO: 959170 - DNA, 25 bp, Mus musculus
gtggactttgaagagtttgtccgga

SEQ ID NO: 959171 - DNA, 25 bp, Mus musculus
gtggactttgtgagaggtttgtaca

SEQ ID NO: 959172 - DNA, 25 bp, Mus musculus
gtggactttgtgagtggtttgtaca

SEQ ID NO: 959173 - DNA, 25 bp, Mus musculus
gtggagaaagattgctatgagtccc

SEQ ID NO: 959174 - DNA, 25 bp, Mus musculus
gtggagaaagtttgctatgagtccc

SEQ ID NO: 959175 - DNA, 25 bp, Mus musculus
gtggagaaggctcaactgctgctac

SEQ ID NO: 959176 - DNA, 25 bp, Mus musculus
gtggagaaggctttcaaagctgaat

SEQ ID NO: 959177 - DNA, 25 bp, Mus musculus
gtggagaagggtcaactgctgctac

SEQ ID NO: 959178 - DNA, 25 bp, Mus musculus
gtggagaagggtttcaaagctgaat

SEQ ID NO: 959179 - DNA, 25 bp, Mus musculus
gtggagaatgtgcgctcatggcaga

SEQ ID NO: 959180 - DNA, 25 bp, Mus musculus
gtggagaatgtgggctcatggcaga

SEQ ID NO: 959181 - DNA, 25 bp, Mus musculus
gtggagacaacgcaaagacgatgct

SEQ ID NO: 959182 - DNA, 25 bp, Mus musculus
gtggagacaacggaaagacgatgct

SEQ ID NO: 959183 - DNA, 25 bp, Mus musculus
gtggagacacagaccactgaggaag

SEQ ID NO: 959184 - DNA, 25 bp, Mus musculus
gtggagacacagacgctgttccggc

SEQ ID NO: 959185 - DNA, 25 bp, Mus musculus
gtggagacacagtccactgaggaag

SEQ ID NO: 959186 - DNA, 25 bp, Mus musculus
gtggagacacagtcgctgttccggc

SEQ ID NO: 959187 - DNA, 25 bp, Mus musculus
gtggagacagcacgggactcggaac

SEQ ID NO: 959188 - DNA, 25 bp, Mus musculus
gtggagacagcaggggactcggaac

SEQ ID NO: 959189 - DNA, 25 bp, Mus musculus
gtggagaccaagatccgactcagtg

SEQ ID NO: 959190 - DNA, 25 bp, Mus musculus
gtggagaccaagttccgactcagtg

SEQ ID NO: 959191 - DNA, 25 bp, Mus musculus
gtggagacgtacaacattttttatg

SEQ ID NO: 959192 - DNA, 25 bp, Mus musculus
gtggagacgtacaagattttttatg

SEQ ID NO: 959193 - DNA, 25 bp, Mus musculus
gtggagactgagcaaatcggccaag

SEQ ID NO: 959194 - DNA, 25 bp, Mus musculus
gtggagactgccacccagctggaaa

SEQ ID NO: 959195 - DNA, 25 bp, Mus musculus
gtggagactgctcttgctttgtgcc

SEQ ID NO: 959196 - DNA, 25 bp, Mus musculus
gtggagactggcacccagctggaaa

SEQ ID NO: 959197 - DNA, 25 bp, Mus musculus
gtggagactggtcttgctttgtgcc

SEQ ID NO: 959198 - DNA, 25 bp, Mus musculus
gtggagactgtgcaaatcggccaag

SEQ ID NO: 959199 - DNA, 25 bp, Mus musculus
gtggagagagatatgactcctatga

SEQ ID NO: 959200 - DNA, 25 bp, Mus musculus
gtggagagagcataccggatgtcag

SEQ ID NO: 959201 - DNA, 25 bp, Mus musculus
gtggagagaggataccggatgtcag

SEQ ID NO: 959202 - DNA, 25 bp, Mus musculus
gtggagagagggaacagcaaatgtg

SEQ ID NO: 959203 - DNA, 25 bp, Mus musculus
gtggagagagggaagagcaaatgtg

SEQ ID NO: 959204 - DNA, 25 bp, Mus musculus
gtggagagagttatgactcctatga

SEQ ID NO: 959205 - DNA, 25 bp, Mus musculus
gtggagagcaagctcgaagaggatg

SEQ ID NO: 959206 - DNA, 25 bp, Mus musculus
gtggagagcaaggtcgaagaggatg

SEQ ID NO: 959207 - DNA, 25 bp, Mus musculus
gtggagagggaacacgagtacatca

SEQ ID NO: 959208 - DNA, 25 bp, Mus musculus
gtggagagggaacaggagtacatca

SEQ ID NO: 959209 - DNA, 25 bp, Mus musculus
gtggagagtccactcttacctccag

SEQ ID NO: 959210 - DNA, 25 bp, Mus musculus
gtggagagtccagtcttacctccag

SEQ ID NO: 959211 - DNA, 25 bp, Mus musculus
gtggagatccagctcatggtagaag

SEQ ID NO: 959212 - DNA, 25 bp, Mus musculus
gtggagatccagctgatggtagaag

SEQ ID NO: 959213 - DNA, 25 bp, Mus musculus
gtggagattacacggtttcctgagg

SEQ ID NO: 959214 - DNA, 25 bp, Mus musculus
gtggagattacagggtttcctgagg

SEQ ID NO: 959215 - DNA, 25 bp, Mus musculus
gtggagattccaccaattcctggag

SEQ ID NO: 959216 - DNA, 25 bp, Mus musculus
gtggagattccacgaagcccctgag

SEQ ID NO: 959217 - DNA, 25 bp, Mus musculus
gtggagattccagcaattcctggag

SEQ ID NO: 959218 - DNA, 25 bp, Mus musculus
gtggagattccaggaagcccctgag

SEQ ID NO: 959219 - DNA, 25 bp, Mus musculus
gtggagcaagctggccctgtctcaa

SEQ ID NO: 959220 - DNA, 25 bp, Mus musculus
gtggagcaaggtggccctgtctcaa

SEQ ID NO: 959221 - DNA, 25 bp, Mus musculus
gtggagcagacgcgtcgaggcgagc

SEQ ID NO: 959222 - DNA, 25 bp, Mus musculus
gtggagcagacgggtcgaggcgagc

SEQ ID NO: 959223 - DNA, 25 bp, Mus musculus
gtggagcagatgtacttcatcctat

SEQ ID NO: 959224 - DNA, 25 bp, Mus musculus
gtggagcagatgtagttcatcctat

SEQ ID NO: 959225 - DNA, 25 bp, Mus musculus
gtggagcaggcctcaaactcagaaa

SEQ ID NO: 959226 - DNA, 25 bp, Mus musculus
gtggagcagggctcaaactcagaaa

SEQ ID NO: 959227 - DNA, 25 bp, Mus musculus
gtggagcagttcactgaagccagcc

SEQ ID NO: 959228 - DNA, 25 bp, Mus musculus
gtggagcagttctctgaagccagcc

SEQ ID NO: 959229 - DNA, 25 bp, Mus musculus
gtggagccacagcactgtgagtcac

SEQ ID NO: 959230 - DNA, 25 bp, Mus musculus
gtggagccacaggactgtgagtcac

SEQ ID NO: 959231 - DNA, 25 bp, Mus musculus
gtggagccagagcctccttccccag

SEQ ID NO: 959232 - DNA, 25 bp, Mus musculus
gtggagccagtgcctccttccccag

SEQ ID NO: 959233 - DNA, 25 bp, Mus musculus
gtggagcccaagattcagccatggc

SEQ ID NO: 959234 - DNA, 25 bp, Mus musculus
gtggagcccaagtttcagccatggc

SEQ ID NO: 959235 - DNA, 25 bp, Mus musculus
gtggagcccttgacgcctccttggc

SEQ ID NO: 959236 - DNA, 25 bp, Mus musculus
gtggagcccttgtcgcctccttggc

SEQ ID NO: 959237 - DNA, 25 bp, Mus musculus
gtggagcgacaacgtaaaagaagaa

SEQ ID NO: 959238 - DNA, 25 bp, Mus musculus
gtggagcgacaaggtaaaagaagaa

SEQ ID NO: 959239 - DNA, 25 bp, Mus musculus
gtggagcgcatacactgcaagacct

SEQ ID NO: 959240 - DNA, 25 bp, Mus musculus
gtggagcgcatacagtgcaagacct

SEQ ID NO: 959241 - DNA, 25 bp, Mus musculus
gtggagctgcagcgatacaaactgc

SEQ ID NO: 959242 - DNA, 25 bp, Mus musculus
gtggagctgcagggatacaaactgc

SEQ ID NO: 959243 - DNA, 25 bp, Mus musculus
gtggagctgctgcgaagatgctacc

SEQ ID NO: 959244 - DNA, 25 bp, Mus musculus
gtggagctgctgggaagatgctacc

SEQ ID NO: 959245 - DNA, 25 bp, Mus musculus
gtggagctggaacgtcttgttgcag

SEQ ID NO: 959246 - DNA, 25 bp, Mus musculus
gtggagctggaaggtcttgttgcag

SEQ ID NO: 959247 - DNA, 25 bp, Mus musculus
gtggagctggagcgctaaaaccgac

SEQ ID NO: 959248 - DNA, 25 bp, Mus musculus
gtggagctggagggctaaaaccgac

SEQ ID NO: 959249 - DNA, 25 bp, Mus musculus
gtggaggaagcacacttcgctgcag

SEQ ID NO: 959250 - DNA, 25 bp, Mus musculus
gtggaggaaggacacttcgctgcag

SEQ ID NO: 959251 - DNA, 25 bp, Mus musculus
gtggaggagaagcgaacgcaaggac

SEQ ID NO: 959252 - DNA, 25 bp, Mus musculus
gtggaggagaagggaacgcaaggac

SEQ ID NO: 959253 - DNA, 25 bp, Mus musculus
gtggaggagacaggcgtacctgtgg

SEQ ID NO: 959254 - DNA, 25 bp, Mus musculus
gtggaggagacaggggtacctgtgg

SEQ ID NO: 959255 - DNA, 25 bp, Mus musculus
gtggaggatgaacagatcgagtgcc

SEQ ID NO: 959256 - DNA, 25 bp, Mus musculus
gtggaggatgaagagatcgagtgcc

SEQ ID NO: 959257 - DNA, 25 bp, Mus musculus
gtggaggatgggcattgcaaacagt

SEQ ID NO: 959258 - DNA, 25 bp, Mus musculus
gtggaggatggggattgcaaacagt

SEQ ID NO: 959259 - DNA, 25 bp, Mus musculus
gtggaggcaaagcatcgtaagagtg

SEQ ID NO: 959260 - DNA, 25 bp, Mus musculus
gtggaggcaaaggatcgtaagagtg

SEQ ID NO: 959261 - DNA, 25 bp, Mus musculus
gtggaggcagaggacgtagaggagg

SEQ ID NO: 959262 - DNA, 25 bp, Mus musculus
gtggaggcagaggaggtagaggagg

SEQ ID NO: 959263 - DNA, 25 bp, Mus musculus
gtggaggccacgcgaatgacgtgcc

SEQ ID NO: 959264 - DNA, 25 bp, Mus musculus
gtggaggccacgggaatgacgtgcc

SEQ ID NO: 959265 - DNA, 25 bp, Mus musculus
gtggaggctgctcgcctggagaaag

SEQ ID NO: 959266 - DNA, 25 bp, Mus musculus
gtggaggctgctcggctggagaaag

SEQ ID NO: 959267 - DNA, 25 bp, Mus musculus
gtggaggctgtgcttgaatgtaatt

SEQ ID NO: 959268 - DNA, 25 bp, Mus musculus
gtggaggctgtggttgaatgtaatt

SEQ ID NO: 959269 - DNA, 25 bp, Mus musculus
gtggagggacagagacaggtttctg

SEQ ID NO: 959270 - DNA, 25 bp, Mus musculus
gtggagggacagcaactgctttgct

SEQ ID NO: 959271 - DNA, 25 bp, Mus musculus
gtggagggacaggaactgctttgct

SEQ ID NO: 959272 - DNA, 25 bp, Mus musculus
gtggagggacagtgacaggtttctg

SEQ ID NO: 959273 - DNA, 25 bp, Mus musculus
gtggagggcaagcaagggaagcagg

SEQ ID NO: 959274 - DNA, 25 bp, Mus musculus
gtggagggcaaggaagggaagcagg

SEQ ID NO: 959275 - DNA, 25 bp, Mus musculus
gtggaggtctacacattccctgaag

SEQ ID NO: 959276 - DNA, 25 bp, Mus musculus
gtggaggtctactcattccctgaag

SEQ ID NO: 959277 - DNA, 25 bp, Mus musculus
gtggaggtcttcaacgaaccagcac

SEQ ID NO: 959278 - DNA, 25 bp, Mus musculus
gtggaggtcttcaaggaaccagcac

SEQ ID NO: 959279 - DNA, 25 bp, Mus musculus
gtggaggtgaagcccaatacatatg

SEQ ID NO: 959280 - DNA, 25 bp, Mus musculus
gtggaggtgaaggccaatacatatg

SEQ ID NO: 959281 - DNA, 25 bp, Mus musculus
gtggaggttttgttcgtgtgcaaca

SEQ ID NO: 959282 - DNA, 25 bp, Mus musculus
gtggaggttttgttggtgtgcaaca

SEQ ID NO: 959283 - DNA, 25 bp, Mus musculus
gtggagtccttcagaagcttatcca

SEQ ID NO: 959284 - DNA, 25 bp, Mus musculus
gtggagtccttctgaagcttatcca

SEQ ID NO: 959285 - DNA, 25 bp, Mus musculus
gtggagtctcaacgggatattgtgt

SEQ ID NO: 959286 - DNA, 25 bp, Mus musculus
gtggagtctcaaggggatattgtgt

SEQ ID NO: 959287 - DNA, 25 bp, Mus musculus
gtggagtggtcaggcgatggcagtg

SEQ ID NO: 959288 - DNA, 25 bp, Mus musculus
gtggagtggtcaggggatggcagtg

SEQ ID NO: 959289 - DNA, 25 bp, Mus musculus
gtggagttcgctgcgtgcttccctg

SEQ ID NO: 959290 - DNA, 25 bp, Mus musculus
gtggagttcggtgcgtgcttccctg

SEQ ID NO: 959291 - DNA, 25 bp, Mus musculus
gtggataaagctctccagagcttta

SEQ ID NO: 959292 - DNA, 25 bp, Mus musculus
gtggataaaggtctccagagcttta

SEQ ID NO: 959293 - DNA, 25 bp, Mus musculus
gtggataaatagatgcccgtgtggt

SEQ ID NO: 959294 - DNA, 25 bp, Mus musculus
gtggataaattgatgcccgtgtggt

SEQ ID NO: 959295 - DNA, 25 bp, Mus musculus
gtggataacctgcaccacctataca

SEQ ID NO: 959296 - DNA, 25 bp, Mus musculus
gtggataacctgcagcacctataca

SEQ ID NO: 959297 - DNA, 25 bp, Mus musculus
gtggataccacacgcaccttcaaga

SEQ ID NO: 959298 - DNA, 25 bp, Mus musculus
gtggataccacaggcaccttcaaga

SEQ ID NO: 959299 - DNA, 25 bp, Mus musculus
gtggatcaaaagctccctggtatga

SEQ ID NO: 959300 - DNA, 25 bp, Mus musculus
gtggatcaaaagctgcctggtatga

SEQ ID NO: 959301 - DNA, 25 bp, Mus musculus
gtggatcaagccggaagaccaactg

SEQ ID NO: 959302 - DNA, 25 bp, Mus musculus
gtggatcaaggcggaagaccaactg

SEQ ID NO: 959303 - DNA, 25 bp, Mus musculus
gtggatcacgatgaacgcttggact

SEQ ID NO: 959304 - DNA, 25 bp, Mus musculus
gtggatcacgttgaacgcttggact

SEQ ID NO: 959305 - DNA, 25 bp, Mus musculus
gtggatcatgactatgctatccgtg

SEQ ID NO: 959306 - DNA, 25 bp, Mus musculus
gtggatcatgtctatgctatccgtg

SEQ ID NO: 959307 - DNA, 25 bp, Mus musculus
gtggatccgcaacacagcgtggtga

SEQ ID NO: 959308 - DNA, 25 bp, Mus musculus
gtggatccgcaacaccgtggtgatg

SEQ ID NO: 959309 - DNA, 25 bp, Mus musculus
gtggatccgcaacagagcgtggtga

SEQ ID NO: 959310 - DNA, 25 bp, Mus musculus
gtggatccgcaacagcgtggtgatg

SEQ ID NO: 959311 - DNA, 25 bp, Mus musculus
gtggatcgagttaacgatctctata

SEQ ID NO: 959312 - DNA, 25 bp, Mus musculus
gtggatcgagttaaggatctctata

SEQ ID NO: 959313 - DNA, 25 bp, Mus musculus
gtggatcggcggatcattacagcat

SEQ ID NO: 959314 - DNA, 25 bp, Mus musculus
gtggatcggcggttcattacagcat

SEQ ID NO: 959315 - DNA, 25 bp, Mus musculus
gtggatcttcttaacgagagcgatt

SEQ ID NO: 959316 - DNA, 25 bp, Mus musculus
gtggatcttcttaaggagagcgatt

SEQ ID NO: 959317 - DNA, 25 bp, Mus musculus
gtggatgacctacgcaagtcggctt

SEQ ID NO: 959318 - DNA, 25 bp, Mus musculus
gtggatgacctaggcaagtcggctt

SEQ ID NO: 959319 - DNA, 25 bp, Mus musculus
gtggatgagtttaacacacagagtg

SEQ ID NO: 959320 - DNA, 25 bp, Mus musculus
gtggatgagtttaagacacagagtg

SEQ ID NO: 959321 - DNA, 25 bp, Mus musculus
gtggatgatattggagatgtaacca

SEQ ID NO: 959322 - DNA, 25 bp, Mus musculus
gtggatgatattggtgatgtaacca

SEQ ID NO: 959323 - DNA, 25 bp, Mus musculus
gtggatgatgagcagatggggggtt

SEQ ID NO: 959324 - DNA, 25 bp, Mus musculus
gtggatgatgaggagatggggggtt

SEQ ID NO: 959325 - DNA, 25 bp, Mus musculus
gtggatgctgacagggacaccaagc

SEQ ID NO: 959326 - DNA, 25 bp, Mus musculus
gtggatgctgactgggacaccaagc

SEQ ID NO: 959327 - DNA, 25 bp, Mus musculus
gtggatgctgatcagttcttgacca

SEQ ID NO: 959328 - DNA, 25 bp, Mus musculus
gtggatgctgatcgcaatggcacca

SEQ ID NO: 959329 - DNA, 25 bp, Mus musculus
gtggatgctgatcgcaatgggacca

SEQ ID NO: 959330 - DNA, 25 bp, Mus musculus
gtggatgctgatgagttcttgacca

SEQ ID NO: 959331 - DNA, 25 bp, Mus musculus
gtggatgctgatggcaatggcacca

SEQ ID NO: 959332 - DNA, 25 bp, Mus musculus
gtggatgctgatggcaatgggacca

SEQ ID NO: 959333 - DNA, 25 bp, Mus musculus
gtggatggagagcttcgggcctgac

SEQ ID NO: 959334 - DNA, 25 bp, Mus musculus
gtggatggagaggttcgggcctgac

SEQ ID NO: 959335 - DNA, 25 bp, Mus musculus
gtggatggcaagcacgtggagctgg

SEQ ID NO: 959336 - DNA, 25 bp, Mus musculus
gtggatggcaagcaggtggagctgg

SEQ ID NO: 959337 - DNA, 25 bp, Mus musculus
gtggatggccgacgcaaagcaacaa

SEQ ID NO: 959338 - DNA, 25 bp, Mus musculus
gtggatggccgaggcaaagcaacaa

SEQ ID NO: 959339 - DNA, 25 bp, Mus musculus
gtggatgggaagcaagagataagaa

SEQ ID NO: 959340 - DNA, 25 bp, Mus musculus
gtggatgggaaggaagagataagaa

SEQ ID NO: 959341 - DNA, 25 bp, Mus musculus
gtggatgtagagaacgccatcgccc

SEQ ID NO: 959342 - DNA, 25 bp, Mus musculus
gtggatgtagagaaggccatcgccc

SEQ ID NO: 959343 - DNA, 25 bp, Mus musculus
gtggatgtgcagccaatgaagagag

SEQ ID NO: 959344 - DNA, 25 bp, Mus musculus
gtggatgtgcaggcaatgaagagag

SEQ ID NO: 959345 - DNA, 25 bp, Mus musculus
gtggattctgaccacctcatcctcc

SEQ ID NO: 959346 - DNA, 25 bp, Mus musculus
gtggattctgtccacctcatcctcc

SEQ ID NO: 959347 - DNA, 25 bp, Mus musculus
gtggattggccgcctatggggcatg

SEQ ID NO: 959348 - DNA, 25 bp, Mus musculus
gtggattggccggctatggggcatg

SEQ ID NO: 959349 - DNA, 25 bp, Mus musculus
gtggatttagcagaggatgaagatc

SEQ ID NO: 959350 - DNA, 25 bp, Mus musculus
gtggatttaggagaggatgaagatc

SEQ ID NO: 959351 - DNA, 25 bp, Mus musculus
gtggcaaaaccgaaagtgacagaga

SEQ ID NO: 959352 - DNA, 25 bp, Mus musculus
gtggcaaaaccgtaagtgacagaga

SEQ ID NO: 959353 - DNA, 25 bp, Mus musculus
gtggcaaaagactgctggagttaat

SEQ ID NO: 959354 - DNA, 25 bp, Mus musculus
gtggcaaaagccctggaagagagac

SEQ ID NO: 959355 - DNA, 25 bp, Mus musculus
gtggcaaaaggcctggaagagagac

SEQ ID NO: 959356 - DNA, 25 bp, Mus musculus
gtggcaaaagtctgctggagttaat

SEQ ID NO: 959357 - DNA, 25 bp, Mus musculus
gtggcaacagctccctcgttgctaa

SEQ ID NO: 959358 - DNA, 25 bp, Mus musculus
gtggcaacaggtccctcgttgctaa

SEQ ID NO: 959359 - DNA, 25 bp, Mus musculus
gtggcaactcagcattgcagcagga

SEQ ID NO: 959360 - DNA, 25 bp, Mus musculus
gtggcaactcaggattgcagcagga

SEQ ID NO: 959361 - DNA, 25 bp, Mus musculus
gtggcaagcaaaagaatgatgagaa

SEQ ID NO: 959362 - DNA, 25 bp, Mus musculus
gtggcaagcaaatgaatgatgagaa

SEQ ID NO: 959363 - DNA, 25 bp, Mus musculus
gtggcaatccagacccccagcagta

SEQ ID NO: 959364 - DNA, 25 bp, Mus musculus
gtggcaatccagtcccccagcagta

SEQ ID NO: 959365 - DNA, 25 bp, Mus musculus
gtggcacaagagcacgccaggatct

SEQ ID NO: 959366 - DNA, 25 bp, Mus musculus
gtggcacaagagcaggccaggatct

SEQ ID NO: 959367 - DNA, 25 bp, Mus musculus
gtggcacaccatgacgctactcatc

SEQ ID NO: 959368 - DNA, 25 bp, Mus musculus
gtggcacaccatgaggctactcatc

SEQ ID NO: 959369 - DNA, 25 bp, Mus musculus
gtggcacaggagtggactccatcat

SEQ ID NO: 959370 - DNA, 25 bp, Mus musculus
gtggcacaggtgtggactccatcat

SEQ ID NO: 959371 - DNA, 25 bp, Mus musculus
gtggcaccctcaccaccgcgtccac

SEQ ID NO: 959372 - DNA, 25 bp, Mus musculus
gtggcaccctcagcaccgcgtccac

SEQ ID NO: 959373 - DNA, 25 bp, Mus musculus
gtggcacctgtggaagtgctcggcc

SEQ ID NO: 959374 - DNA, 25 bp, Mus musculus
gtggcacctgtggatgtgctcggcc

SEQ ID NO: 959375 - DNA, 25 bp, Mus musculus
gtggcacggcagcattcacagatgg

SEQ ID NO: 959376 - DNA, 25 bp, Mus musculus
gtggcacggcaggattcacagatgg

SEQ ID NO: 959377 - DNA, 25 bp, Mus musculus
gtggcacgtgagctggtgatggagt

SEQ ID NO: 959378 - DNA, 25 bp, Mus musculus
gtggcacgtgaggtggtgatggagt

SEQ ID NO: 959379 - DNA, 25 bp, Mus musculus
gtggcactggccctagcgaccgtcg

SEQ ID NO: 959380 - DNA, 25 bp, Mus musculus
gtggcactgggcctagcgaccgtcg

SEQ ID NO: 959381 - DNA, 25 bp, Mus musculus
gtggcactgtcacatcaaacctgga

SEQ ID NO: 959382 - DNA, 25 bp, Mus musculus
gtggcactgtcagatcaaacctgga

SEQ ID NO: 959383 - DNA, 25 bp, Mus musculus
gtggcacttctgatgttcagcaaac

SEQ ID NO: 959384 - DNA, 25 bp, Mus musculus
gtggcacttctgttgttcagcaaac

SEQ ID NO: 959385 - DNA, 25 bp, Mus musculus
gtggcagaagaagccacgctatgag

SEQ ID NO: 959386 - DNA, 25 bp, Mus musculus
gtggcagaagtagccacgctatgag

SEQ ID NO: 959387 - DNA, 25 bp, Mus musculus
gtggcagacgcgcttacggcgtggt

SEQ ID NO: 959388 - DNA, 25 bp, Mus musculus
gtggcagacgggcttacggcgtggt

SEQ ID NO: 959389 - DNA, 25 bp, Mus musculus
gtggcagagctaaacggtttggatc

SEQ ID NO: 959390 - DNA, 25 bp, Mus musculus
gtggcagagctaaagggtttggatc

SEQ ID NO: 959391 - DNA, 25 bp, Mus musculus
gtggcagcaccgcgctaaagaagcc

SEQ ID NO: 959392 - DNA, 25 bp, Mus musculus
gtggcagcaccgggctaaagaagcc

SEQ ID NO: 959393 - DNA, 25 bp, Mus musculus
gtggcagcagatacgtgtgaggaca

SEQ ID NO: 959394 - DNA, 25 bp, Mus musculus
gtggcagcagttacgtgtgaggaca

SEQ ID NO: 959395 - DNA, 25 bp, Mus musculus
gtggcagcgactttctgttccaggc

SEQ ID NO: 959396 - DNA, 25 bp, Mus musculus
gtggcagcgactttgtgttccaggc

SEQ ID NO: 959397 - DNA, 25 bp, Mus musculus
gtggcagctatgcgaaagagatacc

SEQ ID NO: 959398 - DNA, 25 bp, Mus musculus
gtggcagctatgggaaagagatacc

SEQ ID NO: 959399 - DNA, 25 bp, Mus musculus
gtggcaggcacagacatgagtcagt

SEQ ID NO: 959400 - DNA, 25 bp, Mus musculus
gtggcaggcacagagatgagtcagt

SEQ ID NO: 959401 - DNA, 25 bp, Mus musculus
gtggcaggtgactccagctccgtcc

SEQ ID NO: 959402 - DNA, 25 bp, Mus musculus
gtggcaggtgcgacctgaccaagct

SEQ ID NO: 959403 - DNA, 25 bp, Mus musculus
gtggcaggtgggacctgaccaagct

SEQ ID NO: 959404 - DNA, 25 bp, Mus musculus
gtggcaggtgtctccagctccgtcc

SEQ ID NO: 959405 - DNA, 25 bp, Mus musculus
gtggcagtgaaacacctgggtgtta

SEQ ID NO: 959406 - DNA, 25 bp, Mus musculus
gtggcagtgaaacagctgggtgtta

SEQ ID NO: 959407 - DNA, 25 bp, Mus musculus
gtggcagttcagcgaggaatcatgg

SEQ ID NO: 959408 - DNA, 25 bp, Mus musculus
gtggcagttcagggaggaatcatgg

SEQ ID NO: 959409 - DNA, 25 bp, Mus musculus
gtggcataagctacagaaagttaag

SEQ ID NO: 959410 - DNA, 25 bp, Mus musculus
gtggcataagctgatgttccctgtt

SEQ ID NO: 959411 - DNA, 25 bp, Mus musculus
gtggcataaggtacagaaagttaag

SEQ ID NO: 959412 - DNA, 25 bp, Mus musculus
gtggcataaggtgatgttccctgtt

SEQ ID NO: 959413 - DNA, 25 bp, Mus musculus
gtggcatatgcgtgccgggtggagt

SEQ ID NO: 959414 - DNA, 25 bp, Mus musculus
gtggcatatgggtgccgggtggagt

SEQ ID NO: 959415 - DNA, 25 bp, Mus musculus
gtggcatgaaaacgcccttgctgct

SEQ ID NO: 959416 - DNA, 25 bp, Mus musculus
gtggcatgaaaaggcccttgctgct

SEQ ID NO: 959417 - DNA, 25 bp, Mus musculus
gtggcatgccagctgccagtcccga

SEQ ID NO: 959418 - DNA, 25 bp, Mus musculus
gtggcatgccaggtgccagtcccga

SEQ ID NO: 959419 - DNA, 25 bp, Mus musculus
gtggcattagaagtgatgaggaaga

SEQ ID NO: 959420 - DNA, 25 bp, Mus musculus
gtggcattagagatgaggaagagga

SEQ ID NO: 959421 - DNA, 25 bp, Mus musculus
gtggcattagtagtgatgaggaaga

SEQ ID NO: 959422 - DNA, 25 bp, Mus musculus
gtggcattagtgatgaggaagagga

SEQ ID NO: 959423 - DNA, 25 bp, Mus musculus
gtggccaaagacccaatcgtcaacg

SEQ ID NO: 959424 - DNA, 25 bp, Mus musculus
gtggccaaagaccctatcgtcaacg

SEQ ID NO: 959425 - DNA, 25 bp, Mus musculus
gtggccaaagatatgcttccatcgt

SEQ ID NO: 959426 - DNA, 25 bp, Mus musculus
gtggccaaagttatgcttccatcgt

SEQ ID NO: 959427 - DNA, 25 bp, Mus musculus
gtggccacagagacactggagctcc

SEQ ID NO: 959428 - DNA, 25 bp, Mus musculus
gtggccacagagtcactggagctcc

SEQ ID NO: 959429 - DNA, 25 bp, Mus musculus
gtggccacctatatttttatcttta

SEQ ID NO: 959430 - DNA, 25 bp, Mus musculus
gtggccacctatttttttatcttta

SEQ ID NO: 959431 - DNA, 25 bp, Mus musculus
gtggccagccagccctgcagcatca

SEQ ID NO: 959432 - DNA, 25 bp, Mus musculus
gtggccagccaggcctgcagcatca

SEQ ID NO: 959433 - DNA, 25 bp, Mus musculus
gtggccagttcaagagccccaaatg

SEQ ID NO: 959434 - DNA, 25 bp, Mus musculus
gtggccagttcatgagccccaaatg

SEQ ID NO: 959435 - DNA, 25 bp, Mus musculus
gtggccatacagctcctgtccagag

SEQ ID NO: 959436 - DNA, 25 bp, Mus musculus
gtggccatacaggtcctgtccagag

SEQ ID NO: 959437 - DNA, 25 bp, Mus musculus
gtggccatagcacgactgatggatg

SEQ ID NO: 959438 - DNA, 25 bp, Mus musculus
gtggccatagcaggactgatggatg

SEQ ID NO: 959439 - DNA, 25 bp, Mus musculus
gtggccatgcttcacaggcttctgg

SEQ ID NO: 959440 - DNA, 25 bp, Mus musculus
gtggccatgcttcagaggcttctgg

SEQ ID NO: 959441 - DNA, 25 bp, Mus musculus
gtggccattttacacaatctgcacc

SEQ ID NO: 959442 - DNA, 25 bp, Mus musculus
gtggccattttacagaatctgcacc

SEQ ID NO: 959443 - DNA, 25 bp, Mus musculus
gtggcccagaaggacatccttaagc

SEQ ID NO: 959444 - DNA, 25 bp, Mus musculus
gtggcccagaaggagatccttaagc

SEQ ID NO: 959445 - DNA, 25 bp, Mus musculus
gtggcccagacactgactcaggtgc

SEQ ID NO: 959446 - DNA, 25 bp, Mus musculus
gtggcccagacagtgactcaggtgc

SEQ ID NO: 959447 - DNA, 25 bp, Mus musculus
gtggcccaggatgacaacgagtgta

SEQ ID NO: 959448 - DNA, 25 bp, Mus musculus
gtggcccaggttgacaacgagtgta

SEQ ID NO: 959449 - DNA, 25 bp, Mus musculus
gtggccccagctgcccccagcatca

SEQ ID NO: 959450 - DNA, 25 bp, Mus musculus
gtggccccaggtgcccccagcatca

SEQ ID NO: 959451 - DNA, 25 bp, Mus musculus
gtggcccctgaagacgactgcatta

SEQ ID NO: 959452 - DNA, 25 bp, Mus musculus
gtggcccctgaagaggactgcatta

SEQ ID NO: 959453 - DNA, 25 bp, Mus musculus
gtggccctcagacggtctttggagg

SEQ ID NO: 959454 - DNA, 25 bp, Mus musculus
gtggccctcagagggtctttggagg

SEQ ID NO: 959455 - DNA, 25 bp, Mus musculus
gtggccctcccaccgccagccgcac

SEQ ID NO: 959456 - DNA, 25 bp, Mus musculus
gtggccctcccagcgccagccgcac

SEQ ID NO: 959457 - DNA, 25 bp, Mus musculus
gtggccctctccaacacatataaca

SEQ ID NO: 959458 - DNA, 25 bp, Mus musculus
gtggccctctccaagacatataaca

SEQ ID NO: 959459 - DNA, 25 bp, Mus musculus
gtggcccttcaacctctatatacct

SEQ ID NO: 959460 - DNA, 25 bp, Mus musculus
gtggcccttcaagctctatatacct

SEQ ID NO: 959461 - DNA, 25 bp, Mus musculus
gtggccgagtgtagctgaacacaac

SEQ ID NO: 959462 - DNA, 25 bp, Mus musculus
gtggccgagtgttgctgaacacaac

SEQ ID NO: 959463 - DNA, 25 bp, Mus musculus
gtggccgcgagacacggctgatgaa

SEQ ID NO: 959464 - DNA, 25 bp, Mus musculus
gtggccgcgagacagggctgatgaa

SEQ ID NO: 959465 - DNA, 25 bp, Mus musculus
gtggccgcgtccggctgatctctgg

SEQ ID NO: 959466 - DNA, 25 bp, Mus musculus
gtggccgcgtccgggtgatctctgg

SEQ ID NO: 959467 - DNA, 25 bp, Mus musculus
gtggccggcatgaacgtgcgggagc

SEQ ID NO: 959468 - DNA, 25 bp, Mus musculus
gtggccggcatgaaggtgcgggagc

SEQ ID NO: 959469 - DNA, 25 bp, Mus musculus
gtggccgtggcccgcattccaggga

SEQ ID NO: 959470 - DNA, 25 bp, Mus musculus
gtggccgtggccggcattccaggga

SEQ ID NO: 959471 - DNA, 25 bp, Mus musculus
gtggcctatcagcgcgcttatccgc

SEQ ID NO: 959472 - DNA, 25 bp, Mus musculus
gtggcctatcagcgcgtcatagaag

SEQ ID NO: 959473 - DNA, 25 bp, Mus musculus
gtggcctatcagcgggcttatccgc

SEQ ID NO: 959474 - DNA, 25 bp, Mus musculus
gtggcctatcagcgggtcatagaag

SEQ ID NO: 959475 - DNA, 25 bp, Mus musculus
gtggcctcagcgtgcttggacatta

SEQ ID NO: 959476 - DNA, 25 bp, Mus musculus
gtggcctcagggtgcttggacatta

SEQ ID NO: 959477 - DNA, 25 bp, Mus musculus
gtggcctcggtgattgaagtgagtg

SEQ ID NO: 959478 - DNA, 25 bp, Mus musculus
gtggcctcggtgtttgaagtgagtg

SEQ ID NO: 959479 - DNA, 25 bp, Mus musculus
gtggcctctaagagccatcacctgt

SEQ ID NO: 959480 - DNA, 25 bp, Mus musculus
gtggcctctaagatgctgactgtcc

SEQ ID NO: 959481 - DNA, 25 bp, Mus musculus
gtggcctctaagtgccatcacctgt

SEQ ID NO: 959482 - DNA, 25 bp, Mus musculus
gtggcctctaagttgctgactgtcc

SEQ ID NO: 959483 - DNA, 25 bp, Mus musculus
gtggcctctgtacgctggcccggga

SEQ ID NO: 959484 - DNA, 25 bp, Mus musculus
gtggcctctgtaggctggcccggga

SEQ ID NO: 959485 - DNA, 25 bp, Mus musculus
gtggcctgaaagcggctgtggtgtg

SEQ ID NO: 959486 - DNA, 25 bp, Mus musculus
gtggcctgaaaggggctgtggtgtg

SEQ ID NO: 959487 - DNA, 25 bp, Mus musculus
gtggcctgcctcaccgtccgctatg

SEQ ID NO: 959488 - DNA, 25 bp, Mus musculus
gtggcctgcctcacggtccgctatg

SEQ ID NO: 959489 - DNA, 25 bp, Mus musculus
gtggcctgctgcatagtgttcttcg

SEQ ID NO: 959490 - DNA, 25 bp, Mus musculus
gtggcctgctgcattgtgttcttcg

SEQ ID NO: 959491 - DNA, 25 bp, Mus musculus
gtggccttgcagactatgccgacga

SEQ ID NO: 959492 - DNA, 25 bp, Mus musculus
gtggccttgcagtctatgccgacga

SEQ ID NO: 959493 - DNA, 25 bp, Mus musculus
gtggccttttcacaactcaagctct

SEQ ID NO: 959494 - DNA, 25 bp, Mus musculus
gtggccttttcacggctacagtgca

SEQ ID NO: 959495 - DNA, 25 bp, Mus musculus
gtggccttttcagaactcaagctct

SEQ ID NO: 959496 - DNA, 25 bp, Mus musculus
gtggccttttcagggctacagtgca

SEQ ID NO: 959497 - DNA, 25 bp, Mus musculus
gtggcgagaccgcggcatggaacaa

SEQ ID NO: 959498 - DNA, 25 bp, Mus musculus
gtggcgagaccggggcatggaacaa

SEQ ID NO: 959499 - DNA, 25 bp, Mus musculus
gtggcgagcccctccgtcttcaaag

SEQ ID NO: 959500 - DNA, 25 bp, Mus musculus
gtggcgagcccctcggtcttcaaag

SEQ ID NO: 959501 - DNA, 25 bp, Mus musculus
gtggcgctcaccctcattgactcgt

SEQ ID NO: 959502 - DNA, 25 bp, Mus musculus
gtggcgctcaccctccgactactgt

SEQ ID NO: 959503 - DNA, 25 bp, Mus musculus
gtggcgctcaccctgattgactcgt

SEQ ID NO: 959504 - DNA, 25 bp, Mus musculus
gtggcgctcaccctgcgactactgt

SEQ ID NO: 959505 - DNA, 25 bp, Mus musculus
gtggcgctgtatactccatgtttcc

SEQ ID NO: 959506 - DNA, 25 bp, Mus musculus
gtggcgctgtttactccatgtttcc

SEQ ID NO: 959507 - DNA, 25 bp, Mus musculus
gtggctagaactcatccactgggcc

SEQ ID NO: 959508 - DNA, 25 bp, Mus musculus
gtggctagaactgatccactgggcc

SEQ ID NO: 959509 - DNA, 25 bp, Mus musculus
gtggctatcaagctcgagcccatca

SEQ ID NO: 959510 - DNA, 25 bp, Mus musculus
gtggctatcaagctggagcccatca

SEQ ID NO: 959511 - DNA, 25 bp, Mus musculus
gtggctcaggaggtgggtttcactt

SEQ ID NO: 959512 - DNA, 25 bp, Mus musculus
gtggctcaggtggtgggtttcactt

SEQ ID NO: 959513 - DNA, 25 bp, Mus musculus
gtggctcatcctctcaatccaccat

SEQ ID NO: 959514 - DNA, 25 bp, Mus musculus
gtggctcatcctgtcaatccaccat

SEQ ID NO: 959515 - DNA, 25 bp, Mus musculus
gtggctccaactttcctcctgagac

SEQ ID NO: 959516 - DNA, 25 bp, Mus musculus
gtggctccaactttgctcctgagac

SEQ ID NO: 959517 - DNA, 25 bp, Mus musculus
gtggctctagagaacgagctagaag

SEQ ID NO: 959518 - DNA, 25 bp, Mus musculus
gtggctctagagaaggagctagaag

SEQ ID NO: 959519 - DNA, 25 bp, Mus musculus
gtggctctgagacacggccatctcc

SEQ ID NO: 959520 - DNA, 25 bp, Mus musculus
gtggctctgagacagggccatctcc

SEQ ID NO: 959521 - DNA, 25 bp, Mus musculus
gtggctgaagttcacgaattttatg

SEQ ID NO: 959522 - DNA, 25 bp, Mus musculus
gtggctgaagttcaggaattttatg

SEQ ID NO: 959523 - DNA, 25 bp, Mus musculus
gtggctgacaacccctgccagaacc

SEQ ID NO: 959524 - DNA, 25 bp, Mus musculus
gtggctgacatcccctgccagaacc

SEQ ID NO: 959525 - DNA, 25 bp, Mus musculus
gtggctgagtcacgtcctggcttgg

SEQ ID NO: 959526 - DNA, 25 bp, Mus musculus
gtggctgagtcaggtcctggcttgg

SEQ ID NO: 959527 - DNA, 25 bp, Mus musculus
gtggctgatgttgacgctttgttga

SEQ ID NO: 959528 - DNA, 25 bp, Mus musculus
gtggctgatgttgaggctttgttga

SEQ ID NO: 959529 - DNA, 25 bp, Mus musculus
gtggctgcaaaaacttgagaattac

SEQ ID NO: 959530 - DNA, 25 bp, Mus musculus
gtggctgcaaaaaggtcctggtctc

SEQ ID NO: 959531 - DNA, 25 bp, Mus musculus
gtggctgcaaaatcttgagaattac

SEQ ID NO: 959532 - DNA, 25 bp, Mus musculus
gtggctgcaaaatggtcctggtctc

SEQ ID NO: 959533 - DNA, 25 bp, Mus musculus
gtggctgcagagaatgatgtcactg

SEQ ID NO: 959534 - DNA, 25 bp, Mus musculus
gtggctgcagagctatctgttcttg

SEQ ID NO: 959535 - DNA, 25 bp, Mus musculus
gtggctgcagaggtatctgttcttg

SEQ ID NO: 959536 - DNA, 25 bp, Mus musculus
gtggctgcagcagtgaacagtcagc

SEQ ID NO: 959537 - DNA, 25 bp, Mus musculus
gtggctgcaggagtgaacagtcagc

SEQ ID NO: 959538 - DNA, 25 bp, Mus musculus
gtggctgcaggcggcccaagatgtc

SEQ ID NO: 959539 - DNA, 25 bp, Mus musculus
gtggctgcaggcggcttgaagatga

SEQ ID NO: 959540 - DNA, 25 bp, Mus musculus
gtggctgcaggcgggccaagatgtc

SEQ ID NO: 959541 - DNA, 25 bp, Mus musculus
gtggctgcaggcgggttgaagatga

SEQ ID NO: 959542 - DNA, 25 bp, Mus musculus
gtggctgcagtgaatgatgtcactg

SEQ ID NO: 959543 - DNA, 25 bp, Mus musculus
gtggctgcctcactgtactggctga

SEQ ID NO: 959544 - DNA, 25 bp, Mus musculus
gtggctgcctcagtgtactggctga

SEQ ID NO: 959545 - DNA, 25 bp, Mus musculus
gtggctggaactctaaacgatttca

SEQ ID NO: 959546 - DNA, 25 bp, Mus musculus
gtggctggaagtctaaacgatttca

SEQ ID NO: 959547 - DNA, 25 bp, Mus musculus
gtggctggagatgaattcagtcagc

SEQ ID NO: 959548 - DNA, 25 bp, Mus musculus
gtggctggagttgaattcagtcagc

SEQ ID NO: 959549 - DNA, 25 bp, Mus musculus
gtggctggatcccgtggacacacca

SEQ ID NO: 959550 - DNA, 25 bp, Mus musculus
gtggctggatccctaccccaagtac

SEQ ID NO: 959551 - DNA, 25 bp, Mus musculus
gtggctggatccctattcttgttcc

SEQ ID NO: 959552 - DNA, 25 bp, Mus musculus
gtggctggatccggtggacacacca

SEQ ID NO: 959553 - DNA, 25 bp, Mus musculus
gtggctggatccgtaccccaagtac

SEQ ID NO: 959554 - DNA, 25 bp, Mus musculus
gtggctggatccgtattcttgttcc

SEQ ID NO: 959555 - DNA, 25 bp, Mus musculus
gtggctggcccacaagctagaggaa

SEQ ID NO: 959556 - DNA, 25 bp, Mus musculus
gtggctggcccagaagctagaggaa

SEQ ID NO: 959557 - DNA, 25 bp, Mus musculus
gtggctggctatcgccccatcgagc

SEQ ID NO: 959558 - DNA, 25 bp, Mus musculus
gtggctggctatggccccatcgagc

SEQ ID NO: 959559 - DNA, 25 bp, Mus musculus
gtggctgtcaccaacgaccccaact

SEQ ID NO: 959560 - DNA, 25 bp, Mus musculus
gtggctgtcaccaaggaccccaact

SEQ ID NO: 959561 - DNA, 25 bp, Mus musculus
gtggctgtctacaacgatggccggg

SEQ ID NO: 959562 - DNA, 25 bp, Mus musculus
gtggctgtctacaaggatggccggg

SEQ ID NO: 959563 - DNA, 25 bp, Mus musculus
gtggctgtgaagacgctgaaggacg

SEQ ID NO: 959564 - DNA, 25 bp, Mus musculus
gtggctgtgaagtcgctgaaggacg

SEQ ID NO: 959565 - DNA, 25 bp, Mus musculus
gtggctgtgccacgagtggagggga

SEQ ID NO: 959566 - DNA, 25 bp, Mus musculus
gtggctgtgccaggagtggagggga

SEQ ID NO: 959567 - DNA, 25 bp, Mus musculus
gtggcttatctgatccctatgtaaa

SEQ ID NO: 959568 - DNA, 25 bp, Mus musculus
gtggcttatctgttccctatgtaaa

SEQ ID NO: 959569 - DNA, 25 bp, Mus musculus
gtggcttcagcacgtatgatgaagg

SEQ ID NO: 959570 - DNA, 25 bp, Mus musculus
gtggcttcagcaggtatgatgaagg

SEQ ID NO: 959571 - DNA, 25 bp, Mus musculus
gtggcttctttgcctctgaacccaa

SEQ ID NO: 959572 - DNA, 25 bp, Mus musculus
gtggcttctttggctctgaacccaa

SEQ ID NO: 959573 - DNA, 25 bp, Mus musculus
gtggcttgttagaggcactgtcacc

SEQ ID NO: 959574 - DNA, 25 bp, Mus musculus
gtggcttgttagtggcactgtcacc

SEQ ID NO: 959575 - DNA, 25 bp, Mus musculus
gtggctttccagcaagatgtgagct

SEQ ID NO: 959576 - DNA, 25 bp, Mus musculus
gtggctttccagcatgatgtgagct

SEQ ID NO: 959577 - DNA, 25 bp, Mus musculus
gtggcttttgcagacgtttcctggc

SEQ ID NO: 959578 - DNA, 25 bp, Mus musculus
gtggcttttgcagaggtttcctggc

SEQ ID NO: 959579 - DNA, 25 bp, Mus musculus
gtgggaaagctgatcaatgcaccct

SEQ ID NO: 959580 - DNA, 25 bp, Mus musculus
gtgggaaagctgatgaatgcaccct

SEQ ID NO: 959581 - DNA, 25 bp, Mus musculus
gtgggaaaggcagtcatgtggctgg

SEQ ID NO: 959582 - DNA, 25 bp, Mus musculus
gtgggaaagggagtcatgtggctgg

SEQ ID NO: 959583 - DNA, 25 bp, Mus musculus
gtgggaacagcaacagaatggaagc

SEQ ID NO: 959584 - DNA, 25 bp, Mus musculus
gtgggaacagctattgaagcccctg

SEQ ID NO: 959585 - DNA, 25 bp, Mus musculus
gtgggaacagctggaaggtaggccc

SEQ ID NO: 959586 - DNA, 25 bp, Mus musculus
gtgggaacaggaacagaatggaagc

SEQ ID NO: 959587 - DNA, 25 bp, Mus musculus
gtgggaacaggtattgaagcccctg

SEQ ID NO: 959588 - DNA, 25 bp, Mus musculus
gtgggaacaggtggaaggtaggccc

SEQ ID NO: 959589 - DNA, 25 bp, Mus musculus
gtgggaagatttgacaaagaacgag

SEQ ID NO: 959590 - DNA, 25 bp, Mus musculus
gtgggaagatttgagaaagaacgag

SEQ ID NO: 959591 - DNA, 25 bp, Mus musculus
gtgggaagcaaacgctcaagtcatt

SEQ ID NO: 959592 - DNA, 25 bp, Mus musculus
gtgggaagcaaaggctcaagtcatt

SEQ ID NO: 959593 - DNA, 25 bp, Mus musculus
gtgggaagcccacatttgccatgga

SEQ ID NO: 959594 - DNA, 25 bp, Mus musculus
gtgggaagcccagatttgccatgga

SEQ ID NO: 959595 - DNA, 25 bp, Mus musculus
gtgggaattgcaaacatgtgtccag

SEQ ID NO: 959596 - DNA, 25 bp, Mus musculus
gtgggaattgcaaactgtactggga

SEQ ID NO: 959597 - DNA, 25 bp, Mus musculus
gtgggaattgcaaagatgtgtccag

SEQ ID NO: 959598 - DNA, 25 bp, Mus musculus
gtgggaattgcaaagtgtactggga

SEQ ID NO: 959599 - DNA, 25 bp, Mus musculus
gtgggacaagcttttgagcattaat

SEQ ID NO: 959600 - DNA, 25 bp, Mus musculus
gtgggacaaggttttgagcattaat

SEQ ID NO: 959601 - DNA, 25 bp, Mus musculus
gtgggacacaaagcacctggaggag

SEQ ID NO: 959602 - DNA, 25 bp, Mus musculus
gtgggacacacacctggaggagcca

SEQ ID NO: 959603 - DNA, 25 bp, Mus musculus
gtgggacacagacctggaggagcca

SEQ ID NO: 959604 - DNA, 25 bp, Mus musculus
gtgggacacatagcacctggaggag

SEQ ID NO: 959605 - DNA, 25 bp, Mus musculus
gtgggacatgcggggcttacctgct

SEQ ID NO: 959606 - DNA, 25 bp, Mus musculus
gtgggacatggggggcttacctgct

SEQ ID NO: 959607 - DNA, 25 bp, Mus musculus
gtgggaccataggatcatggacgtc

SEQ ID NO: 959608 - DNA, 25 bp, Mus musculus
gtgggaccattggatcatggacgtc

SEQ ID NO: 959609 - DNA, 25 bp, Mus musculus
gtgggacctcagcctgactgctgtc

SEQ ID NO: 959610 - DNA, 25 bp, Mus musculus
gtgggacctcaggctgactgctgtc

SEQ ID NO: 959611 - DNA, 25 bp, Mus musculus
gtgggacttactcggtttgaatgcc

SEQ ID NO: 959612 - DNA, 25 bp, Mus musculus
gtgggacttactgggtttgaatgcc

SEQ ID NO: 959613 - DNA, 25 bp, Mus musculus
gtgggagaacagatccgacgtatcc

SEQ ID NO: 959614 - DNA, 25 bp, Mus musculus
gtgggagaacagttccgacgtatcc

SEQ ID NO: 959615 - DNA, 25 bp, Mus musculus
gtgggagaactcgcaccagggtcca

SEQ ID NO: 959616 - DNA, 25 bp, Mus musculus
gtgggagaactcgctccagggtcca

SEQ ID NO: 959617 - DNA, 25 bp, Mus musculus
gtgggagaagctgcagcagctggtg

SEQ ID NO: 959618 - DNA, 25 bp, Mus musculus
gtgggagaaggtgcagcagctggtg

SEQ ID NO: 959619 - DNA, 25 bp, Mus musculus
gtgggagacgagcctctttcacgag

SEQ ID NO: 959620 - DNA, 25 bp, Mus musculus
gtgggagacgaggctctttcacgag

SEQ ID NO: 959621 - DNA, 25 bp, Mus musculus
gtgggagcagagcaccttctgctgg

SEQ ID NO: 959622 - DNA, 25 bp, Mus musculus
gtgggagcagagcagcttctgctgg

SEQ ID NO: 959623 - DNA, 25 bp, Mus musculus
gtgggagcagcaactgtggaattca

SEQ ID NO: 959624 - DNA, 25 bp, Mus musculus
gtgggagcagcttccttcggagtcc

SEQ ID NO: 959625 - DNA, 25 bp, Mus musculus
gtgggagcaggaactgtggaattca

SEQ ID NO: 959626 - DNA, 25 bp, Mus musculus
gtgggagcaggttccttcggagtcc

SEQ ID NO: 959627 - DNA, 25 bp, Mus musculus
gtgggagctgtgtacatgtcaatga

SEQ ID NO: 959628 - DNA, 25 bp, Mus musculus
gtgggagctgtgtagatgtcaatga

SEQ ID NO: 959629 - DNA, 25 bp, Mus musculus
gtgggagttccagaagtatgggcat

SEQ ID NO: 959630 - DNA, 25 bp, Mus musculus
gtgggagttccagatgtatgggcat

SEQ ID NO: 959631 - DNA, 25 bp, Mus musculus
gtgggatgacaccacgtgtcctgtg

SEQ ID NO: 959632 - DNA, 25 bp, Mus musculus
gtgggatgacaccaggtgtcctgtg

SEQ ID NO: 959633 - DNA, 25 bp, Mus musculus
gtgggcaaagccaagagaatatctg

SEQ ID NO: 959634 - DNA, 25 bp, Mus musculus
gtgggcaaagctattgacttcattt

SEQ ID NO: 959635 - DNA, 25 bp, Mus musculus
gtgggcaaagctgcctgtgacagac

SEQ ID NO: 959636 - DNA, 25 bp, Mus musculus
gtgggcaaagctgcgtgtgacagac

SEQ ID NO: 959637 - DNA, 25 bp, Mus musculus
gtgggcaaaggcaagagaatatctg

SEQ ID NO: 959638 - DNA, 25 bp, Mus musculus
gtgggcaaaggtattgacttcattt

SEQ ID NO: 959639 - DNA, 25 bp, Mus musculus
gtgggcaggaagaacgttgctcagg

SEQ ID NO: 959640 - DNA, 25 bp, Mus musculus
gtgggcaggaagaaggttgctcagg

SEQ ID NO: 959641 - DNA, 25 bp, Mus musculus
gtgggcattaagataagggtgtggt

SEQ ID NO: 959642 - DNA, 25 bp, Mus musculus
gtgggcattaagctagataagggtg

SEQ ID NO: 959643 - DNA, 25 bp, Mus musculus
gtgggcattaaggtagataagggtg

SEQ ID NO: 959644 - DNA, 25 bp, Mus musculus
gtgggcattaagttaagggtgtggt

SEQ ID NO: 959645 - DNA, 25 bp, Mus musculus
gtgggcatttttcggtccccatgga

SEQ ID NO: 959646 - DNA, 25 bp, Mus musculus
gtgggcatttttgggtccccatgga

SEQ ID NO: 959647 - DNA, 25 bp, Mus musculus
gtgggcccagatggctttggccctg

SEQ ID NO: 959648 - DNA, 25 bp, Mus musculus
gtgggcccagttggctttggccctg

SEQ ID NO: 959649 - DNA, 25 bp, Mus musculus
gtgggccccttgcgatcatgcaggc

SEQ ID NO: 959650 - DNA, 25 bp, Mus musculus
gtgggccccttgggatcatgcaggc

SEQ ID NO: 959651 - DNA, 25 bp, Mus musculus
gtgggccttaaatcagtgtcggtga

SEQ ID NO: 959652 - DNA, 25 bp, Mus musculus
gtgggccttaaatctgtgtcggtga

SEQ ID NO: 959653 - DNA, 25 bp, Mus musculus
gtgggctaccagaggttgtccccat

SEQ ID NO: 959654 - DNA, 25 bp, Mus musculus
gtgggctaccagattttgttcggat

SEQ ID NO: 959655 - DNA, 25 bp, Mus musculus
gtgggctaccagtggttgtccccat

SEQ ID NO: 959656 - DNA, 25 bp, Mus musculus
gtgggctaccagtttttgttcggat

SEQ ID NO: 959657 - DNA, 25 bp, Mus musculus
gtgggctctgagagccccctgcccg

SEQ ID NO: 959658 - DNA, 25 bp, Mus musculus
gtgggctctgagaggcccctgcccg

SEQ ID NO: 959659 - DNA, 25 bp, Mus musculus
gtgggctgcatcagtgaagaggaca

SEQ ID NO: 959660 - DNA, 25 bp, Mus musculus
gtgggctgcatctgtgaagaggaca

SEQ ID NO: 959661 - DNA, 25 bp, Mus musculus
gtgggctgcgctatcagcctagcag

SEQ ID NO: 959662 - DNA, 25 bp, Mus musculus
gtgggctgcggtatcagcctagcag

SEQ ID NO: 959663 - DNA, 25 bp, Mus musculus
gtgggctggtcacccgcgtgttcca

SEQ ID NO: 959664 - DNA, 25 bp, Mus musculus
gtgggctggtcagccgcgtgttcca

SEQ ID NO: 959665 - DNA, 25 bp, Mus musculus
gtgggcttccgtcccttctctggtt

SEQ ID NO: 959666 - DNA, 25 bp, Mus musculus
gtgggcttccgtgccttctctggtt

SEQ ID NO: 959667 - DNA, 25 bp, Mus musculus
gtgggcttcgcaatcggcatcgcag

SEQ ID NO: 959668 - DNA, 25 bp, Mus musculus
gtgggcttcgcaatgggcatcgcag

SEQ ID NO: 959669 - DNA, 25 bp, Mus musculus
gtggggacagagcacaatttgatac

SEQ ID NO: 959670 - DNA, 25 bp, Mus musculus
gtggggacagagcacgggtgctctt

SEQ ID NO: 959671 - DNA, 25 bp, Mus musculus
gtggggacagagcagaatttgatac

SEQ ID NO: 959672 - DNA, 25 bp, Mus musculus
gtggggacagagcaggggtgctctt

SEQ ID NO: 959673 - DNA, 25 bp, Mus musculus
gtggggaccataaactctaaggttg

SEQ ID NO: 959674 - DNA, 25 bp, Mus musculus
gtggggaccataaagtctaaggttg

SEQ ID NO: 959675 - DNA, 25 bp, Mus musculus
gtggggcaagtgttcgtgatccttg

SEQ ID NO: 959676 - DNA, 25 bp, Mus musculus
gtggggcaagtgttggtgatccttg

SEQ ID NO: 959677 - DNA, 25 bp, Mus musculus
gtggggcagaacgacgttgtgaacc

SEQ ID NO: 959678 - DNA, 25 bp, Mus musculus
gtggggcagaacgaggttgtgaacc

SEQ ID NO: 959679 - DNA, 25 bp, Mus musculus
gtggggcagcagcttgtctttagct

SEQ ID NO: 959680 - DNA, 25 bp, Mus musculus
gtggggcagcaggttgtctttagct

SEQ ID NO: 959681 - DNA, 25 bp, Mus musculus
gtggggcatgagagtaatgttcaag

SEQ ID NO: 959682 - DNA, 25 bp, Mus musculus
gtggggcatgagtgtaatgttcaag

SEQ ID NO: 959683 - DNA, 25 bp, Mus musculus
gtggggccagctgtcctgtccatgg

SEQ ID NO: 959684 - DNA, 25 bp, Mus musculus
gtggggccaggtgtcctgtccatgg

SEQ ID NO: 959685 - DNA, 25 bp, Mus musculus
gtggggcctggacgacatcatgttc

SEQ ID NO: 959686 - DNA, 25 bp, Mus musculus
gtggggcctggaggacatcatgttc

SEQ ID NO: 959687 - DNA, 25 bp, Mus musculus
gtggggcgcacacccctgtgaagcc

SEQ ID NO: 959688 - DNA, 25 bp, Mus musculus
gtggggcgcacagccctgtgaagcc

SEQ ID NO: 959689 - DNA, 25 bp, Mus musculus
gtggggctcgcacgatccctgctgc

SEQ ID NO: 959690 - DNA, 25 bp, Mus musculus
gtggggctcgcaggatccctgctgc

SEQ ID NO: 959691 - DNA, 25 bp, Mus musculus
gtgggggccgcccagtcctgtctca

SEQ ID NO: 959692 - DNA, 25 bp, Mus musculus
gtgggggccgccctcctgtctcaac

SEQ ID NO: 959693 - DNA, 25 bp, Mus musculus
gtgggggccgccgagtcctgtctca

SEQ ID NO: 959694 - DNA, 25 bp, Mus musculus
gtgggggccgccgtcctgtctcaac

SEQ ID NO: 959695 - DNA, 25 bp, Mus musculus
gtgggggcttgtgacggtgactacg

SEQ ID NO: 959696 - DNA, 25 bp, Mus musculus
gtgggggcttgtgagggtgactacg

SEQ ID NO: 959697 - DNA, 25 bp, Mus musculus
gtggggtactgccacggaatgaatt

SEQ ID NO: 959698 - DNA, 25 bp, Mus musculus
gtggggtactgccactgctgcgcac

SEQ ID NO: 959699 - DNA, 25 bp, Mus musculus
gtggggtactgccagggaatgaatt

SEQ ID NO: 959700 - DNA, 25 bp, Mus musculus
gtggggtactgccagtgctgcgcac

SEQ ID NO: 959701 - DNA, 25 bp, Mus musculus
gtggggtcaggcaacgcagtccctc

SEQ ID NO: 959702 - DNA, 25 bp, Mus musculus
gtggggtcaggcaaggcagtccctc

SEQ ID NO: 959703 - DNA, 25 bp, Mus musculus
gtggggttcctcaaacccaatggaa

SEQ ID NO: 959704 - DNA, 25 bp, Mus musculus
gtggggttcctcaatcccaatggaa

SEQ ID NO: 959705 - DNA, 25 bp, Mus musculus
gtgggtaacacacaagccaccatgg

SEQ ID NO: 959706 - DNA, 25 bp, Mus musculus
gtgggtaacacagaagccaccatgg

SEQ ID NO: 959707 - DNA, 25 bp, Mus musculus
gtgggtcacaagaagccgtctcagt

SEQ ID NO: 959708 - DNA, 25 bp, Mus musculus
gtgggtcacaagctcaaagcaagta

SEQ ID NO: 959709 - DNA, 25 bp, Mus musculus
gtgggtcacaaggtcaaagcaagta

SEQ ID NO: 959710 - DNA, 25 bp, Mus musculus
gtgggtcacaagtagccgtctcagt

SEQ ID NO: 959711 - DNA, 25 bp, Mus musculus
gtgggtcgatatcacgtgtcctgga

SEQ ID NO: 959712 - DNA, 25 bp, Mus musculus
gtgggtcgatatcaggtgtcctgga

SEQ ID NO: 959713 - DNA, 25 bp, Mus musculus
gtgggtgaagcacgagtggcatgac

SEQ ID NO: 959714 - DNA, 25 bp, Mus musculus
gtgggtgaagcaggagtggcatgac

SEQ ID NO: 959715 - DNA, 25 bp, Mus musculus
gtgggtgatgacacagcttctaagg

SEQ ID NO: 959716 - DNA, 25 bp, Mus musculus
gtgggtgatgacagttgctttcact

SEQ ID NO: 959717 - DNA, 25 bp, Mus musculus
gtgggtgatgactcagcttctaagg

SEQ ID NO: 959718 - DNA, 25 bp, Mus musculus
gtgggtgatgactgttgctttcact

SEQ ID NO: 959719 - DNA, 25 bp, Mus musculus
gtgggtgcccgaccagccgatgtcc

SEQ ID NO: 959720 - DNA, 25 bp, Mus musculus
gtgggtgcccgacccgatgtcctgg

SEQ ID NO: 959721 - DNA, 25 bp, Mus musculus
gtgggtgcccgagcagccgatgtcc

SEQ ID NO: 959722 - DNA, 25 bp, Mus musculus
gtgggtgcccgagccgatgtcctgg

SEQ ID NO: 959723 - DNA, 25 bp, Mus musculus
gtgggtggagctggaacgcacggag

SEQ ID NO: 959724 - DNA, 25 bp, Mus musculus
gtgggtggaggtggaacgcacggag

SEQ ID NO: 959725 - DNA, 25 bp, Mus musculus
gtgggtgtgtggcacgaaagaaatg

SEQ ID NO: 959726 - DNA, 25 bp, Mus musculus
gtgggtgtgtggcaggaaagaaatg

SEQ ID NO: 959727 - DNA, 25 bp, Mus musculus
gtgggttgtgcacgtggagcagata

SEQ ID NO: 959728 - DNA, 25 bp, Mus musculus
gtgggttgtgcaggtggagcagata

SEQ ID NO: 959729 - DNA, 25 bp, Mus musculus
gtgggttgtggcacgcctgagtctt

SEQ ID NO: 959730 - DNA, 25 bp, Mus musculus
gtgggttgtggctcgcctgagtctt

SEQ ID NO: 959731 - DNA, 25 bp, Mus musculus
gtggtaaaagtgatatagtcatagc

SEQ ID NO: 959732 - DNA, 25 bp, Mus musculus
gtggtaaaagtgttatagtcatagc

SEQ ID NO: 959733 - DNA, 25 bp, Mus musculus
gtggtaaatgatgacggtacagttg

SEQ ID NO: 959734 - DNA, 25 bp, Mus musculus
gtggtaaatgttgacggtacagttg

SEQ ID NO: 959735 - DNA, 25 bp, Mus musculus
gtggtaacaacctccgcacagccgt

SEQ ID NO: 959736 - DNA, 25 bp, Mus musculus
gtggtaacaacctcggcacagccgt

SEQ ID NO: 959737 - DNA, 25 bp, Mus musculus
gtggtacaagcatgaggtgctgctg

SEQ ID NO: 959738 - DNA, 25 bp, Mus musculus
gtggtacaaggatgaggtgctgctg

SEQ ID NO: 959739 - DNA, 25 bp, Mus musculus
gtggtacccaggctgcaaataccta

SEQ ID NO: 959740 - DNA, 25 bp, Mus musculus
gtggtacccagggtgcaaataccta

SEQ ID NO: 959741 - DNA, 25 bp, Mus musculus
gtggtaccgcctctcgctcgatgag

SEQ ID NO: 959742 - DNA, 25 bp, Mus musculus
gtggtaccgcctctggctcgatgag

SEQ ID NO: 959743 - DNA, 25 bp, Mus musculus
gtggtatcattactcaaaatctttg

SEQ ID NO: 959744 - DNA, 25 bp, Mus musculus
gtggtatcattactgaaaatctttg

SEQ ID NO: 959745 - DNA, 25 bp, Mus musculus
gtggtattgctgcacggagtgtcaa

SEQ ID NO: 959746 - DNA, 25 bp, Mus musculus
gtggtattgctgcagggagtgtcaa

SEQ ID NO: 959747 - DNA, 25 bp, Mus musculus
gtggtcactgccgccaatagcggca

SEQ ID NO: 959748 - DNA, 25 bp, Mus musculus
gtggtcactggcgccaatagcggca

SEQ ID NO: 959749 - DNA, 25 bp, Mus musculus
gtggtcactgtgcacctcattctct

SEQ ID NO: 959750 - DNA, 25 bp, Mus musculus
gtggtcactgtgcacttccgctcgc

SEQ ID NO: 959751 - DNA, 25 bp, Mus musculus
gtggtcactgtgcagctcattctct

SEQ ID NO: 959752 - DNA, 25 bp, Mus musculus
gtggtcactgtgcagttccgctcgc

SEQ ID NO: 959753 - DNA, 25 bp, Mus musculus
gtggtcagggcatggcagtggcacc

SEQ ID NO: 959754 - DNA, 25 bp, Mus musculus
gtggtcaggggatggcagtggcacc

SEQ ID NO: 959755 - DNA, 25 bp, Mus musculus
gtggtcattccacaggatgaagagt

SEQ ID NO: 959756 - DNA, 25 bp, Mus musculus
gtggtcattccagaggatgaagagt

SEQ ID NO: 959757 - DNA, 25 bp, Mus musculus
gtggtccaagcgtcaagtatggatc

SEQ ID NO: 959758 - DNA, 25 bp, Mus musculus
gtggtccaagggtcaagtatggatc

SEQ ID NO: 959759 - DNA, 25 bp, Mus musculus
gtggtcccacataccttgcccttca

SEQ ID NO: 959760 - DNA, 25 bp, Mus musculus
gtggtcccacattccttgcccttca

SEQ ID NO: 959761 - DNA, 25 bp, Mus musculus
gtggtcccagcgggaggctcgtact

SEQ ID NO: 959762 - DNA, 25 bp, Mus musculus
gtggtcccagggggaggctcgtact

SEQ ID NO: 959763 - DNA, 25 bp, Mus musculus
gtggtcctccagatcatggagcttt

SEQ ID NO: 959764 - DNA, 25 bp, Mus musculus
gtggtcctccagttcatggagcttt

SEQ ID NO: 959765 - DNA, 25 bp, Mus musculus
gtggtcgagtgacccgaatctgtgg

SEQ ID NO: 959766 - DNA, 25 bp, Mus musculus
gtggtcgagtgaccggaatctgtgg

SEQ ID NO: 959767 - DNA, 25 bp, Mus musculus
gtggtcggaggagtcgtgtggaagg

SEQ ID NO: 959768 - DNA, 25 bp, Mus musculus
gtggtcggaggagtggtgtggaagg

SEQ ID NO: 959769 - DNA, 25 bp, Mus musculus
gtggtctcagcaggctgttgtggtt

SEQ ID NO: 959770 - DNA, 25 bp, Mus musculus
gtggtctcaggaggctgttgtggtt

SEQ ID NO: 959771 - DNA, 25 bp, Mus musculus
gtggtctccgcgttctgcaggagcc

SEQ ID NO: 959772 - DNA, 25 bp, Mus musculus
gtggtctccgggttctgcaggagcc

SEQ ID NO: 959773 - DNA, 25 bp, Mus musculus
gtggtctcggcggcccttcggagtg

SEQ ID NO: 959774 - DNA, 25 bp, Mus musculus
gtggtctcgggggcccttcggagtg

SEQ ID NO: 959775 - DNA, 25 bp, Mus musculus
gtggtctttctgcacgagcccacca

SEQ ID NO: 959776 - DNA, 25 bp, Mus musculus
gtggtctttctggacgagcccacca

SEQ ID NO: 959777 - DNA, 25 bp, Mus musculus
gtggtgaagaagcttcattatgatg

SEQ ID NO: 959778 - DNA, 25 bp, Mus musculus
gtggtgaagaaggttcattatgatg

SEQ ID NO: 959779 - DNA, 25 bp, Mus musculus
gtggtgacagcaatctatgaatact

SEQ ID NO: 959780 - DNA, 25 bp, Mus musculus
gtggtgacaggaatctatgaatact

SEQ ID NO: 959781 - DNA, 25 bp, Mus musculus
gtggtgacccgcaaccatcactgcc

SEQ ID NO: 959782 - DNA, 25 bp, Mus musculus
gtggtgacccgcaagcatcactgcc

SEQ ID NO: 959783 - DNA, 25 bp, Mus musculus
gtggtgactatacgtgtggattttg

SEQ ID NO: 959784 - DNA, 25 bp, Mus musculus
gtggtgactataggtgtggattttg

SEQ ID NO: 959785 - DNA, 25 bp, Mus musculus
gtggtgagccagctcccaggacctc

SEQ ID NO: 959786 - DNA, 25 bp, Mus musculus
gtggtgagccaggtcccaggacctc

SEQ ID NO: 959787 - DNA, 25 bp, Mus musculus
gtggtgagttcacgtactcagttcg

SEQ ID NO: 959788 - DNA, 25 bp, Mus musculus
gtggtgagttcaggtactcagttcg

SEQ ID NO: 959789 - DNA, 25 bp, Mus musculus
gtggtgatgaaactggctcagctca

SEQ ID NO: 959790 - DNA, 25 bp, Mus musculus
gtggtgatgaaagtggctcagctca

SEQ ID NO: 959791 - DNA, 25 bp, Mus musculus
gtggtgatgactgacagtgaagaca

SEQ ID NO: 959792 - DNA, 25 bp, Mus musculus
gtggtgatgagtgacagtgaagaca

SEQ ID NO: 959793 - DNA, 25 bp, Mus musculus
gtggtgccagcactggatcccagca

SEQ ID NO: 959794 - DNA, 25 bp, Mus musculus
gtggtgccagctgggggctcatact

SEQ ID NO: 959795 - DNA, 25 bp, Mus musculus
gtggtgccaggactggatcccagca

SEQ ID NO: 959796 - DNA, 25 bp, Mus musculus
gtggtgccaggtgggggctcatact

SEQ ID NO: 959797 - DNA, 25 bp, Mus musculus
gtggtgcgaggacgtggagcctact

SEQ ID NO: 959798 - DNA, 25 bp, Mus musculus
gtggtgcgaggaggtggagcctact

SEQ ID NO: 959799 - DNA, 25 bp, Mus musculus
gtggtgcgatggctcctatgacatg

SEQ ID NO: 959800 - DNA, 25 bp, Mus musculus
gtggtgcgatggctgctatgacatg

SEQ ID NO: 959801 - DNA, 25 bp, Mus musculus
gtggtgctcaatcacggaatggaga

SEQ ID NO: 959802 - DNA, 25 bp, Mus musculus
gtggtgctcaatcagggaatggaga

SEQ ID NO: 959803 - DNA, 25 bp, Mus musculus
gtggtgctgccacctgaggaggagc

SEQ ID NO: 959804 - DNA, 25 bp, Mus musculus
gtggtgctgccagctgaggaggagc

SEQ ID NO: 959805 - DNA, 25 bp, Mus musculus
gtggtgctggagataaaggcagatg

SEQ ID NO: 959806 - DNA, 25 bp, Mus musculus
gtggtgctggagcctggtgatttgg

SEQ ID NO: 959807 - DNA, 25 bp, Mus musculus
gtggtgctggagctgtcctgtccat

SEQ ID NO: 959808 - DNA, 25 bp, Mus musculus
gtggtgctggaggtgtcctgtccat

SEQ ID NO: 959809 - DNA, 25 bp, Mus musculus
gtggtgctggagttaaaggcagatg

SEQ ID NO: 959810 - DNA, 25 bp, Mus musculus
gtggtgctggtgcctggtgatttgg

SEQ ID NO: 959811 - DNA, 25 bp, Mus musculus
gtggtggaagagcagacaagtttcc

SEQ ID NO: 959812 - DNA, 25 bp, Mus musculus
gtggtggaagaggagacaagtttcc

SEQ ID NO: 959813 - DNA, 25 bp, Mus musculus
gtggtggaagtgcacgagaagtcca

SEQ ID NO: 959814 - DNA, 25 bp, Mus musculus
gtggtggaagtgcaggagaagtcca

SEQ ID NO: 959815 - DNA, 25 bp, Mus musculus
gtggtggagaaactttgctatgagt

SEQ ID NO: 959816 - DNA, 25 bp, Mus musculus
gtggtggagaaagtttgctatgagt

SEQ ID NO: 959817 - DNA, 25 bp, Mus musculus
gtggtggagaagccttactgctccc

SEQ ID NO: 959818 - DNA, 25 bp, Mus musculus
gtggtggagaaggcttactgctccc

SEQ ID NO: 959819 - DNA, 25 bp, Mus musculus
gtggtggagacacacacgctgttcc

SEQ ID NO: 959820 - DNA, 25 bp, Mus musculus
gtggtggagacacagacgctgttcc

SEQ ID NO: 959821 - DNA, 25 bp, Mus musculus
gtggtggagagacatatgactccta

SEQ ID NO: 959822 - DNA, 25 bp, Mus musculus
gtggtggagagagatatgactccta

SEQ ID NO: 959823 - DNA, 25 bp, Mus musculus
gtggtggagatgcacgacagtgaca

SEQ ID NO: 959824 - DNA, 25 bp, Mus musculus
gtggtggagatgcttgaaaatgata

SEQ ID NO: 959825 - DNA, 25 bp, Mus musculus
gtggtggagatggacgacagtgaca

SEQ ID NO: 959826 - DNA, 25 bp, Mus musculus
gtggtggagatggttgaaaatgata

SEQ ID NO: 959827 - DNA, 25 bp, Mus musculus
gtggtggagcagaccggtcgaggcg

SEQ ID NO: 959828 - DNA, 25 bp, Mus musculus
gtggtggagcagacgggtcgaggcg

SEQ ID NO: 959829 - DNA, 25 bp, Mus musculus
gtggtggccatgctctgggaaggcc

SEQ ID NO: 959830 - DNA, 25 bp, Mus musculus
gtggtggccatggtctgggaaggcc

SEQ ID NO: 959831 - DNA, 25 bp, Mus musculus
gtggtggccgcttggagcctctctg

SEQ ID NO: 959832 - DNA, 25 bp, Mus musculus
gtggtggccggttggagcctctctg

SEQ ID NO: 959833 - DNA, 25 bp, Mus musculus
gtggtggctgacaacccctgccaga

SEQ ID NO: 959834 - DNA, 25 bp, Mus musculus
gtggtggctgactacccctgccaga

SEQ ID NO: 959835 - DNA, 25 bp, Mus musculus
gtggtggctgaggctccagcgggag

SEQ ID NO: 959836 - DNA, 25 bp, Mus musculus
gtggtggctgcccgccatgactgct

SEQ ID NO: 959837 - DNA, 25 bp, Mus musculus
gtggtggctgccggccatgactgct

SEQ ID NO: 959838 - DNA, 25 bp, Mus musculus
gtggtggctgtggctccagcgggag

SEQ ID NO: 959839 - DNA, 25 bp, Mus musculus
gtggtgggctaccacattttgttcg

SEQ ID NO: 959840 - DNA, 25 bp, Mus musculus
gtggtgggctaccactggttgtccc

SEQ ID NO: 959841 - DNA, 25 bp, Mus musculus
gtggtgggctaccagattttgttcg

SEQ ID NO: 959842 - DNA, 25 bp, Mus musculus
gtggtgggctaccagtggttgtccc

SEQ ID NO: 959843 - DNA, 25 bp, Mus musculus
gtggtgtcttcctgcataacctgtg

SEQ ID NO: 959844 - DNA, 25 bp, Mus musculus
gtggtgtcttcctggataacctgtg

SEQ ID NO: 959845 - DNA, 25 bp, Mus musculus
gtggtgtgcgaccacatctgctgct

SEQ ID NO: 959846 - DNA, 25 bp, Mus musculus
gtggtgtgcgaccacgtgtctgcct

SEQ ID NO: 959847 - DNA, 25 bp, Mus musculus
gtggtgtgcgaccagatctgctgct

SEQ ID NO: 959848 - DNA, 25 bp, Mus musculus
gtggtgtgcgaccaggtgtctgcct

SEQ ID NO: 959849 - DNA, 25 bp, Mus musculus
gtggtgtgtccattcgggaagacgg

SEQ ID NO: 959850 - DNA, 25 bp, Mus musculus
gtggtgtgtccattggggaagacgg

SEQ ID NO: 959851 - DNA, 25 bp, Mus musculus
gtggttatctggctatcctagaatg

SEQ ID NO: 959852 - DNA, 25 bp, Mus musculus
gtggttatctgggtatcctagaatg

SEQ ID NO: 959853 - DNA, 25 bp, Mus musculus
gtggttcctacacggctagagcagc

SEQ ID NO: 959854 - DNA, 25 bp, Mus musculus
gtggttcctacagggctagagcagc

SEQ ID NO: 959855 - DNA, 25 bp, Mus musculus
gtggttctagcagctcagactgaag

SEQ ID NO: 959856 - DNA, 25 bp, Mus musculus
gtggttctagctttaaggaccatcc

SEQ ID NO: 959857 - DNA, 25 bp, Mus musculus
gtggttctaggagctcagactgaag

SEQ ID NO: 959858 - DNA, 25 bp, Mus musculus
gtggttctaggtttaaggaccatcc

SEQ ID NO: 959859 - DNA, 25 bp, Mus musculus
gtggttctcaacccaatcagtattt

SEQ ID NO: 959860 - DNA, 25 bp, Mus musculus
gtggttctcaaccctatcagtattt

SEQ ID NO: 959861 - DNA, 25 bp, Mus musculus
gtggttctggataacggtggtaaat

SEQ ID NO: 959862 - DNA, 25 bp, Mus musculus
gtggttctggataagggtggtaaat

SEQ ID NO: 959863 - DNA, 25 bp, Mus musculus
gtggttgaccatcaccggctctccg

SEQ ID NO: 959864 - DNA, 25 bp, Mus musculus
gtggttgaccatcagcggctctccg

SEQ ID NO: 959865 - DNA, 25 bp, Mus musculus
gtggttgattgacaaggagggagag

SEQ ID NO: 959866 - DNA, 25 bp, Mus musculus
gtggttgattgagaaggagggagag

SEQ ID NO: 959867 - DNA, 25 bp, Mus musculus
gtggttgcaggaccacccccaccgc

SEQ ID NO: 959868 - DNA, 25 bp, Mus musculus
gtggttgcaggacggtgaagggcct

SEQ ID NO: 959869 - DNA, 25 bp, Mus musculus
gtggttgcaggagcacccccaccgc

SEQ ID NO: 959870 - DNA, 25 bp, Mus musculus
gtggttgcaggagggtgaagggcct

SEQ ID NO: 959871 - DNA, 25 bp, Mus musculus
gtggttggagatgaagtggtgttga

SEQ ID NO: 959872 - DNA, 25 bp, Mus musculus
gtggttggagatgatgtggtgttga

SEQ ID NO: 959873 - DNA, 25 bp, Mus musculus
gtggttggagcgctacctcagcgtg

SEQ ID NO: 959874 - DNA, 25 bp, Mus musculus
gtggttggagggctacctcagcgtg

SEQ ID NO: 959875 - DNA, 25 bp, Mus musculus
gtggttggtgccgcagtccaggcct

SEQ ID NO: 959876 - DNA, 25 bp, Mus musculus
gtggttggtggcgcagtccaggcct

SEQ ID NO: 959877 - DNA, 25 bp, Mus musculus
gtggtttatatgcattcacatcatt

SEQ ID NO: 959878 - DNA, 25 bp, Mus musculus
gtggtttatatgcttgtgggctttt

SEQ ID NO: 959879 - DNA, 25 bp, Mus musculus
gtggtttatatggattcacatcatt

SEQ ID NO: 959880 - DNA, 25 bp, Mus musculus
gtggtttatatggttgtgggctttt

SEQ ID NO: 959881 - DNA, 25 bp, Mus musculus
gtggtttccaagctgtgagtacttg

SEQ ID NO: 959882 - DNA, 25 bp, Mus musculus
gtggtttccaaggtgtgagtacttg

SEQ ID NO: 959883 - DNA, 25 bp, Mus musculus
gtggtttcctggctggtcctggctg

SEQ ID NO: 959884 - DNA, 25 bp, Mus musculus
gtggtttcctgggtggtcctggctg

SEQ ID NO: 959885 - DNA, 25 bp, Mus musculus
gtggtttgcatgactgacatgctcc

SEQ ID NO: 959886 - DNA, 25 bp, Mus musculus
gtggtttgcatgtctgacatgctcc

SEQ ID NO: 959887 - DNA, 25 bp, Mus musculus
gtgtaaagagaactctttcaagaac

SEQ ID NO: 959888 - DNA, 25 bp, Mus musculus
gtgtaaagagaagtctttcaagaac

SEQ ID NO: 959889 - DNA, 25 bp, Mus musculus
gtgtaaccaaagatgtcgcactggc

SEQ ID NO: 959890 - DNA, 25 bp, Mus musculus
gtgtaaccaaagttgtcgcactggc

SEQ ID NO: 959891 - DNA, 25 bp, Mus musculus
gtgtaatttctgatgaagggggctg

SEQ ID NO: 959892 - DNA, 25 bp, Mus musculus
gtgtaatttctgttgaagggggctg

SEQ ID NO: 959893 - DNA, 25 bp, Mus musculus
gtgtacaaaaagctacgtcatcacc

SEQ ID NO: 959894 - DNA, 25 bp, Mus musculus
gtgtacaaaaaggtacgtcatcacc

SEQ ID NO: 959895 - DNA, 25 bp, Mus musculus
gtgtacaacactccaaccaaccagt

SEQ ID NO: 959896 - DNA, 25 bp, Mus musculus
gtgtacaacactgcaaccaaccagt

SEQ ID NO: 959897 - DNA, 25 bp, Mus musculus
gtgtacagagcaaacgtggagaacg

SEQ ID NO: 959898 - DNA, 25 bp, Mus musculus
gtgtacagagcaaaggtggagaacg

SEQ ID NO: 959899 - DNA, 25 bp, Mus musculus
gtgtacagtacacgcaaatttccag

SEQ ID NO: 959900 - DNA, 25 bp, Mus musculus
gtgtacagtacaggcaaatttccag

SEQ ID NO: 959901 - DNA, 25 bp, Mus musculus
gtgtacggacatctgcacctgggaa

SEQ ID NO: 959902 - DNA, 25 bp, Mus musculus
gtgtacggacatgtgcacctgggaa

SEQ ID NO: 959903 - DNA, 25 bp, Mus musculus
gtgtacggcggacatgaagttggcg

SEQ ID NO: 959904 - DNA, 25 bp, Mus musculus
gtgtacggcggagatgaagttggcg

SEQ ID NO: 959905 - DNA, 25 bp, Mus musculus
gtgtactgcccgcaacccagacatg

SEQ ID NO: 959906 - DNA, 25 bp, Mus musculus
gtgtactgcccggaacccagacatg

SEQ ID NO: 959907 - DNA, 25 bp, Mus musculus
gtgtacttagacctcgagtggaccg

SEQ ID NO: 959908 - DNA, 25 bp, Mus musculus
gtgtacttagacctggagtggaccg

SEQ ID NO: 959909 - DNA, 25 bp, Mus musculus
gtgtacttcaagcgaggcaagtaca

SEQ ID NO: 959910 - DNA, 25 bp, Mus musculus
gtgtacttcaagggaggcaagtaca

SEQ ID NO: 959911 - DNA, 25 bp, Mus musculus
gtgtagaactatttttttgaataag

SEQ ID NO: 959912 - DNA, 25 bp, Mus musculus
gtgtagaactttttttttgaataag

SEQ ID NO: 959913 - DNA, 25 bp, Mus musculus
gtgtagaagccaaccgttctcgtgc

SEQ ID NO: 959914 - DNA, 25 bp, Mus musculus
gtgtagaagccatccgttctcgtgc

SEQ ID NO: 959915 - DNA, 25 bp, Mus musculus
gtgtagcctcagcatgcctggtgtg

SEQ ID NO: 959916 - DNA, 25 bp, Mus musculus
gtgtagcctcaggatgcctggtgtg

SEQ ID NO: 959917 - DNA, 25 bp, Mus musculus
gtgtatacagcaaagcagtcgtact

SEQ ID NO: 959918 - DNA, 25 bp, Mus musculus
gtgtatacaggaaagcagtcgtact

SEQ ID NO: 959919 - DNA, 25 bp, Mus musculus
gtgtatcatctcaactgtttcacat

SEQ ID NO: 959920 - DNA, 25 bp, Mus musculus
gtgtatcatctcaagtgtttcacat

SEQ ID NO: 959921 - DNA, 25 bp, Mus musculus
gtgtatccctgcccacacggaggag

SEQ ID NO: 959922 - DNA, 25 bp, Mus musculus
gtgtatccctgccctcacggaggag

SEQ ID NO: 959923 - DNA, 25 bp, Mus musculus
gtgtatctgcatcccaactcatatt

SEQ ID NO: 959924 - DNA, 25 bp, Mus musculus
gtgtatctgcatccgaactcatatt

SEQ ID NO: 959925 - DNA, 25 bp, Mus musculus
gtgtatgaagagcctggagtcaaag

SEQ ID NO: 959926 - DNA, 25 bp, Mus musculus
gtgtatgaagaggctggagtcaaag

SEQ ID NO: 959927 - DNA, 25 bp, Mus musculus
gtgtatgagaagaacctgagcccac

SEQ ID NO: 959928 - DNA, 25 bp, Mus musculus
gtgtatgagaagaagctgagcccac

SEQ ID NO: 959929 - DNA, 25 bp, Mus musculus
gtgtattaattagacgaggttcgcc

SEQ ID NO: 959930 - DNA, 25 bp, Mus musculus
gtgtattaattagaggaggttcgcc

SEQ ID NO: 959931 - DNA, 25 bp, Mus musculus
gtgtatttccaaatgcagaccacat

SEQ ID NO: 959932 - DNA, 25 bp, Mus musculus
gtgtatttccaattgcagaccacat

SEQ ID NO: 959933 - DNA, 25 bp, Mus musculus
gtgtcaaaagcctatgtccccacag

SEQ ID NO: 959934 - DNA, 25 bp, Mus musculus
gtgtcaaaagcgaagatggaagact

SEQ ID NO: 959935 - DNA, 25 bp, Mus musculus
gtgtcaaaaggctatgtccccacag

SEQ ID NO: 959936 - DNA, 25 bp, Mus musculus
gtgtcaaaagggaagatggaagact

SEQ ID NO: 959937 - DNA, 25 bp, Mus musculus
gtgtcaaccttacacgcagctgcac

SEQ ID NO: 959938 - DNA, 25 bp, Mus musculus
gtgtcaaccttacaggcagctgcac

SEQ ID NO: 959939 - DNA, 25 bp, Mus musculus
gtgtcaaggacacggagtcattccc

SEQ ID NO: 959940 - DNA, 25 bp, Mus musculus
gtgtcaaggacagggagtcattccc

SEQ ID NO: 959941 - DNA, 25 bp, Mus musculus
gtgtcaatcaatcgtgtcccagatg

SEQ ID NO: 959942 - DNA, 25 bp, Mus musculus
gtgtcaatcaatggtgtcccagatg

SEQ ID NO: 959943 - DNA, 25 bp, Mus musculus
gtgtcacaaacaccaatagctgcag

SEQ ID NO: 959944 - DNA, 25 bp, Mus musculus
gtgtcacaaagaccaatagctgcag

SEQ ID NO: 959945 - DNA, 25 bp, Mus musculus
gtgtcaccagtgaacaatttgacaa

SEQ ID NO: 959946 - DNA, 25 bp, Mus musculus
gtgtcaccagtgaagaatttgacaa

SEQ ID NO: 959947 - DNA, 25 bp, Mus musculus
gtgtcacgctacggaatgaagctac

SEQ ID NO: 959948 - DNA, 25 bp, Mus musculus
gtgtcacgctacggtatgaagctac

SEQ ID NO: 959949 - DNA, 25 bp, Mus musculus
gtgtcactgccacaactcggttacc

SEQ ID NO: 959950 - DNA, 25 bp, Mus musculus
gtgtcactgccagaactcggttacc

SEQ ID NO: 959951 - DNA, 25 bp, Mus musculus
gtgtcacttggtcacgtactggatc

SEQ ID NO: 959952 - DNA, 25 bp, Mus musculus
gtgtcacttggtcaggtactggatc

SEQ ID NO: 959953 - DNA, 25 bp, Mus musculus
gtgtcagagaagaatccctgggagg

SEQ ID NO: 959954 - DNA, 25 bp, Mus musculus
gtgtcagagaagcaagcagcggtgg

SEQ ID NO: 959955 - DNA, 25 bp, Mus musculus
gtgtcagagaaggaagcagcggtgg

SEQ ID NO: 959956 - DNA, 25 bp, Mus musculus
gtgtcagagaagtatccctgggagg

SEQ ID NO: 959957 - DNA, 25 bp, Mus musculus
gtgtcagagcagcccaaccgagcaa

SEQ ID NO: 959958 - DNA, 25 bp, Mus musculus
gtgtcagagcaggccaaccgagcaa

SEQ ID NO: 959959 - DNA, 25 bp, Mus musculus
gtgtcagaggagcaaagggcatcag

SEQ ID NO: 959960 - DNA, 25 bp, Mus musculus
gtgtcagaggaggaaagggcatcag

SEQ ID NO: 959961 - DNA, 25 bp, Mus musculus
gtgtcaggagcacattgccagggca

SEQ ID NO: 959962 - DNA, 25 bp, Mus musculus
gtgtcaggagcagattgccagggca

SEQ ID NO: 959963 - DNA, 25 bp, Mus musculus
gtgtcatcagcggtggtctcagtaa

SEQ ID NO: 959964 - DNA, 25 bp, Mus musculus
gtgtcatcaggggtggtctcagtaa

SEQ ID NO: 959965 - DNA, 25 bp, Mus musculus
gtgtcatcgcggcactcagtcttgc

SEQ ID NO: 959966 - DNA, 25 bp, Mus musculus
gtgtcatcgcgggactcagtcttgc

SEQ ID NO: 959967 - DNA, 25 bp, Mus musculus
gtgtcattcattcgcaatggcgtgg

SEQ ID NO: 959968 - DNA, 25 bp, Mus musculus
gtgtcattcattggcaatggcgtgg

SEQ ID NO: 959969 - DNA, 25 bp, Mus musculus
gtgtccagagagatgtgtggccatc

SEQ ID NO: 959970 - DNA, 25 bp, Mus musculus
gtgtccagagagttgtgtggccatc

SEQ ID NO: 959971 - DNA, 25 bp, Mus musculus
gtgtccagagctttgcctgtggcag

SEQ ID NO: 959972 - DNA, 25 bp, Mus musculus
gtgtccagaggtttgcctgtggcag

SEQ ID NO: 959973 - DNA, 25 bp, Mus musculus
gtgtccagcaggccagggagggatt

SEQ ID NO: 959974 - DNA, 25 bp, Mus musculus
gtgtccagcagggcagggagggatt

SEQ ID NO: 959975 - DNA, 25 bp, Mus musculus
gtgtccatattgccaggtacaccat

SEQ ID NO: 959976 - DNA, 25 bp, Mus musculus
gtgtccatattgcctggtacaccat

SEQ ID NO: 959977 - DNA, 25 bp, Mus musculus
gtgtccatgagatgcattctgacgt

SEQ ID NO: 959978 - DNA, 25 bp, Mus musculus
gtgtccatgagatgcgcgttatgct

SEQ ID NO: 959979 - DNA, 25 bp, Mus musculus
gtgtccatgagatgcggcaggcgtt

SEQ ID NO: 959980 - DNA, 25 bp, Mus musculus
gtgtccatgagatggattctgacgt

SEQ ID NO: 959981 - DNA, 25 bp, Mus musculus
gtgtccatgagatgggcgttatgct

SEQ ID NO: 959982 - DNA, 25 bp, Mus musculus
gtgtccatgagatggggcaggcgtt

SEQ ID NO: 959983 - DNA, 25 bp, Mus musculus
gtgtccattgcggaagacgggccct

SEQ ID NO: 959984 - DNA, 25 bp, Mus musculus
gtgtccattggggaagacgggccct

SEQ ID NO: 959985 - DNA, 25 bp, Mus musculus
gtgtccatttcgacttctctaccca

SEQ ID NO: 959986 - DNA, 25 bp, Mus musculus
gtgtccatttcgtcttctctaccca

SEQ ID NO: 959987 - DNA, 25 bp, Mus musculus
gtgtcccaagctatcgttctttggc

SEQ ID NO: 959988 - DNA, 25 bp, Mus musculus
gtgtcccaagctatggttctttggc

SEQ ID NO: 959989 - DNA, 25 bp, Mus musculus
gtgtcccaccaactccagggtgaca

SEQ ID NO: 959990 - DNA, 25 bp, Mus musculus
gtgtcccaccaagtccagggtgaca

SEQ ID NO: 959991 - DNA, 25 bp, Mus musculus
gtgtccctgtcggccgctggcaggg

SEQ ID NO: 959992 - DNA, 25 bp, Mus musculus
gtgtccctgtcggcggctggcaggg

SEQ ID NO: 959993 - DNA, 25 bp, Mus musculus
gtgtccctgtctgtcgccaggaggg

SEQ ID NO: 959994 - DNA, 25 bp, Mus musculus
gtgtccctgtctgtggccaggaggg

SEQ ID NO: 959995 - DNA, 25 bp, Mus musculus
gtgtccgagccacgacgagggatct

SEQ ID NO: 959996 - DNA, 25 bp, Mus musculus
gtgtccgagccaggacgagggatct

SEQ ID NO: 959997 - DNA, 25 bp, Mus musculus
gtgtcctagcagattgtccttctga

SEQ ID NO: 959998 - DNA, 25 bp, Mus musculus
gtgtcctagcagtttgtccttctga

SEQ ID NO: 959999 - DNA, 25 bp, Mus musculus
gtgtcctcatcaccggggaaagcgg

SEQ ID NO: 960000 - DNA, 25 bp, Mus musculus
gtgtcctcatcagcggggaaagcgg

SEQ ID NO: 960001 - DNA, 25 bp, Mus musculus
gtgtcctcctagaacggcctcctca

SEQ ID NO: 960002 - DNA, 25 bp, Mus musculus
gtgtcctcctagaagggcctcctca

SEQ ID NO: 960003 - DNA, 25 bp, Mus musculus
gtgtcctgagaatcccaggcgcggt

SEQ ID NO: 960004 - DNA, 25 bp, Mus musculus
gtgtcctgagcatctttccaacctc

SEQ ID NO: 960005 - DNA, 25 bp, Mus musculus
gtgtcctgaggatctttccaacctc

SEQ ID NO: 960006 - DNA, 25 bp, Mus musculus
gtgtcctgagtatcccaggcgcggt

SEQ ID NO: 960007 - DNA, 25 bp, Mus musculus
gtgtcctgctgacgcgagtaacaag

SEQ ID NO: 960008 - DNA, 25 bp, Mus musculus
gtgtcctgctgaggcgagtaacaag

SEQ ID NO: 960009 - DNA, 25 bp, Mus musculus
gtgtcctggcctcacgagacaacaa

SEQ ID NO: 960010 - DNA, 25 bp, Mus musculus
gtgtcctggcctcaggagacaacaa

SEQ ID NO: 960011 - DNA, 25 bp, Mus musculus
gtgtcctgtgaacacatcaacgaat

SEQ ID NO: 960012 - DNA, 25 bp, Mus musculus
gtgtcctgtgaacacatcaatgagt

SEQ ID NO: 960013 - DNA, 25 bp, Mus musculus
gtgtcctgtgaacaccaagacgagt

SEQ ID NO: 960014 - DNA, 25 bp, Mus musculus
gtgtcctgtgaagacatcaacgaat

SEQ ID NO: 960015 - DNA, 25 bp, Mus musculus
gtgtcctgtgaagacatcaatgagt

SEQ ID NO: 960016 - DNA, 25 bp, Mus musculus
gtgtcctgtgaagaccaagacgagt

SEQ ID NO: 960017 - DNA, 25 bp, Mus musculus
gtgtcctgttcggacgtctcatcgg

SEQ ID NO: 960018 - DNA, 25 bp, Mus musculus
gtgtcctgttcggaggtctcatcgg

SEQ ID NO: 960019 - DNA, 25 bp, Mus musculus
gtgtccttgtcccaccccaagatgg

SEQ ID NO: 960020 - DNA, 25 bp, Mus musculus
gtgtccttgtcccagcccaagatgg

SEQ ID NO: 960021 - DNA, 25 bp, Mus musculus
gtgtcctttcagccccggttcgctg

SEQ ID NO: 960022 - DNA, 25 bp, Mus musculus
gtgtcctttcaggcccggttcgctg

SEQ ID NO: 960023 - DNA, 25 bp, Mus musculus
gtgtcctttgtatcagtcctggaaa

SEQ ID NO: 960024 - DNA, 25 bp, Mus musculus
gtgtcctttgtatctgtcctggaaa

SEQ ID NO: 960025 - DNA, 25 bp, Mus musculus
gtgtcgcaagcacaactgcgtgacg

SEQ ID NO: 960026 - DNA, 25 bp, Mus musculus
gtgtcgcaaggacaactgcgtgacg

SEQ ID NO: 960027 - DNA, 25 bp, Mus musculus
gtgtcgcacgagagctgcctgtagc

SEQ ID NO: 960028 - DNA, 25 bp, Mus musculus
gtgtcgcacgagctggactcacatt

SEQ ID NO: 960029 - DNA, 25 bp, Mus musculus
gtgtcgcacgaggtggactcacatt

SEQ ID NO: 960030 - DNA, 25 bp, Mus musculus
gtgtcgcacgagtgctgcctgtagc

SEQ ID NO: 960031 - DNA, 25 bp, Mus musculus
gtgtcgccagagtggaaggggagta

SEQ ID NO: 960032 - DNA, 25 bp, Mus musculus
gtgtcgccagctcagccatgtcatc

SEQ ID NO: 960033 - DNA, 25 bp, Mus musculus
gtgtcgccaggtcagccatgtcatc

SEQ ID NO: 960034 - DNA, 25 bp, Mus musculus
gtgtcgccagtgtggaaggggagta

SEQ ID NO: 960035 - DNA, 25 bp, Mus musculus
gtgtcgccgccacacagttctgtcc

SEQ ID NO: 960036 - DNA, 25 bp, Mus musculus
gtgtcgccgccacagagttctgtcc

SEQ ID NO: 960037 - DNA, 25 bp, Mus musculus
gtgtcgctcgagttcctgaggatca

SEQ ID NO: 960038 - DNA, 25 bp, Mus musculus
gtgtcgctcgcgtatcaagtctcca

SEQ ID NO: 960039 - DNA, 25 bp, Mus musculus
gtgtcgctcgggtatcaagtctcca

SEQ ID NO: 960040 - DNA, 25 bp, Mus musculus
gtgtcgctcgtgttcctgaggatca

SEQ ID NO: 960041 - DNA, 25 bp, Mus musculus
gtgtcggcggaacacgtaattgctg

SEQ ID NO: 960042 - DNA, 25 bp, Mus musculus
gtgtcggcggaacaggtaattgctg

SEQ ID NO: 960043 - DNA, 25 bp, Mus musculus
gtgtctaaagagaactccaacttct

SEQ ID NO: 960044 - DNA, 25 bp, Mus musculus
gtgtctaaagagaagtccaacttct

SEQ ID NO: 960045 - DNA, 25 bp, Mus musculus
gtgtctaaagcgcttctctgcctag

SEQ ID NO: 960046 - DNA, 25 bp, Mus musculus
gtgtctaaagctaaaacagactagc

SEQ ID NO: 960047 - DNA, 25 bp, Mus musculus
gtgtctaaagggcttctctgcctag

SEQ ID NO: 960048 - DNA, 25 bp, Mus musculus
gtgtctaaaggtaaaacagactagc

SEQ ID NO: 960049 - DNA, 25 bp, Mus musculus
gtgtctacgatacacggtcgagatg

SEQ ID NO: 960050 - DNA, 25 bp, Mus musculus
gtgtctacgatacagggtcgagatg

SEQ ID NO: 960051 - DNA, 25 bp, Mus musculus
gtgtctcagaaacgaagtgcgagcg

SEQ ID NO: 960052 - DNA, 25 bp, Mus musculus
gtgtctcagaaaggaagtgcgagcg

SEQ ID NO: 960053 - DNA, 25 bp, Mus musculus
gtgtctcagaagcttttccaaggct

SEQ ID NO: 960054 - DNA, 25 bp, Mus musculus
gtgtctcagaaggttttccaaggct

SEQ ID NO: 960055 - DNA, 25 bp, Mus musculus
gtgtctccagacatcgagacaacag

SEQ ID NO: 960056 - DNA, 25 bp, Mus musculus
gtgtctccagacatggagacaacag

SEQ ID NO: 960057 - DNA, 25 bp, Mus musculus
gtgtctgaagagcaggtgctgggcc

SEQ ID NO: 960058 - DNA, 25 bp, Mus musculus
gtgtctgaagaggaggtgctgggcc

SEQ ID NO: 960059 - DNA, 25 bp, Mus musculus
gtgtctgaggcgcgccccagcacta

SEQ ID NO: 960060 - DNA, 25 bp, Mus musculus
gtgtctgaggcgcggcccagcacta

SEQ ID NO: 960061 - DNA, 25 bp, Mus musculus
gtgtctgatttaaacgtcatccact

SEQ ID NO: 960062 - DNA, 25 bp, Mus musculus
gtgtctgatttaaaggtcatccact

SEQ ID NO: 960063 - DNA, 25 bp, Mus musculus
gtgtctgctgggatgcgttgctggc

SEQ ID NO: 960064 - DNA, 25 bp, Mus musculus
gtgtctgctgggttgcgttgctggc

SEQ ID NO: 960065 - DNA, 25 bp, Mus musculus
gtgtctggagattcgacttgaagtc

SEQ ID NO: 960066 - DNA, 25 bp, Mus musculus
gtgtctggagtttcgacttgaagtc

SEQ ID NO: 960067 - DNA, 25 bp, Mus musculus
gtgtcttcagaaatgcagctcttga

SEQ ID NO: 960068 - DNA, 25 bp, Mus musculus
gtgtcttcagtaatgcagctcttga

SEQ ID NO: 960069 - DNA, 25 bp, Mus musculus
gtgtcttcctatcacagagtgactc

SEQ ID NO: 960070 - DNA, 25 bp, Mus musculus
gtgtcttcctatcacggctcagttc

SEQ ID NO: 960071 - DNA, 25 bp, Mus musculus
gtgtcttcctatcagagagtgactc

SEQ ID NO: 960072 - DNA, 25 bp, Mus musculus
gtgtcttcctatcagggctcagttc

SEQ ID NO: 960073 - DNA, 25 bp, Mus musculus
gtgtcttcctggataacctgtggag

SEQ ID NO: 960074 - DNA, 25 bp, Mus musculus
gtgtcttcctggttaacctgtggag

SEQ ID NO: 960075 - DNA, 25 bp, Mus musculus
gtgtcttcgtgggacatgcagcagg

SEQ ID NO: 960076 - DNA, 25 bp, Mus musculus
gtgtcttcgtgggagatgcagcagg

SEQ ID NO: 960077 - DNA, 25 bp, Mus musculus
gtgtcttcttatctctgttgaactc

SEQ ID NO: 960078 - DNA, 25 bp, Mus musculus
gtgtcttcttatctgtgttgaactc

SEQ ID NO: 960079 - DNA, 25 bp, Mus musculus
gtgtctttgcggccgtgctggtcac

SEQ ID NO: 960080 - DNA, 25 bp, Mus musculus
gtgtctttgcggctgcctggctgag

SEQ ID NO: 960081 - DNA, 25 bp, Mus musculus
gtgtctttgcgggcgtgctggtcac

SEQ ID NO: 960082 - DNA, 25 bp, Mus musculus
gtgtctttgcgggtgcctggctgag

SEQ ID NO: 960083 - DNA, 25 bp, Mus musculus
gtgtgaaattgccacgttctacaaa

SEQ ID NO: 960084 - DNA, 25 bp, Mus musculus
gtgtgaaattgccaggttctacaaa

SEQ ID NO: 960085 - DNA, 25 bp, Mus musculus
gtgtgaacccaagacacttctctac

SEQ ID NO: 960086 - DNA, 25 bp, Mus musculus
gtgtgaacccaagagacttctctac

SEQ ID NO: 960087 - DNA, 25 bp, Mus musculus
gtgtgaagtggacaagcacggccgg

SEQ ID NO: 960088 - DNA, 25 bp, Mus musculus
gtgtgaagtggagaagcacggccgg

SEQ ID NO: 960089 - DNA, 25 bp, Mus musculus
gtgtgaccaccacactgctccgatg

SEQ ID NO: 960090 - DNA, 25 bp, Mus musculus
gtgtgaccaccacagtgctccgatg

SEQ ID NO: 960091 - DNA, 25 bp, Mus musculus
gtgtgacgaaagctctgtcacctaa

SEQ ID NO: 960092 - DNA, 25 bp, Mus musculus
gtgtgacgaaaggtctgtcacctaa

SEQ ID NO: 960093 - DNA, 25 bp, Mus musculus
gtgtgagaataaccatattgccaat

SEQ ID NO: 960094 - DNA, 25 bp, Mus musculus
gtgtgagaataagcatattgccaat

SEQ ID NO: 960095 - DNA, 25 bp, Mus musculus
gtgtgagagttgacggcgtccaaca

SEQ ID NO: 960096 - DNA, 25 bp, Mus musculus
gtgtgagagttgagtcctacctgct

SEQ ID NO: 960097 - DNA, 25 bp, Mus musculus
gtgtgagagttgtcggcgtccaaca

SEQ ID NO: 960098 - DNA, 25 bp, Mus musculus
gtgtgagagttgtgtcctacctgct

SEQ ID NO: 960099 - DNA, 25 bp, Mus musculus
gtgtgagattgccacattctataag

SEQ ID NO: 960100 - DNA, 25 bp, Mus musculus
gtgtgagattgccagattctataag

SEQ ID NO: 960101 - DNA, 25 bp, Mus musculus
gtgtgagcactgctgtcgtcagcca

SEQ ID NO: 960102 - DNA, 25 bp, Mus musculus
gtgtgagcactggtgtcgtcagcca

SEQ ID NO: 960103 - DNA, 25 bp, Mus musculus
gtgtgagctccgagtcctctgctgc

SEQ ID NO: 960104 - DNA, 25 bp, Mus musculus
gtgtgagctccgtgtcctctgctgc

SEQ ID NO: 960105 - DNA, 25 bp, Mus musculus
gtgtgagctgcaaatgaagcatctg

SEQ ID NO: 960106 - DNA, 25 bp, Mus musculus
gtgtgagctggaaatgaagcatctg

SEQ ID NO: 960107 - DNA, 25 bp, Mus musculus
gtgtgaggacaacagtgtggaaaat

SEQ ID NO: 960108 - DNA, 25 bp, Mus musculus
gtgtgaggacaagagtgtggaaaat

SEQ ID NO: 960109 - DNA, 25 bp, Mus musculus
gtgtgaggtacacgtgtcggctctg

SEQ ID NO: 960110 - DNA, 25 bp, Mus musculus
gtgtgaggtacaggtgtcggctctg

SEQ ID NO: 960111 - DNA, 25 bp, Mus musculus
gtgtgagtctgacactcggacctat

SEQ ID NO: 960112 - DNA, 25 bp, Mus musculus
gtgtgagtctgagactcggacctat

SEQ ID NO: 960113 - DNA, 25 bp, Mus musculus
gtgtgatgcaccgacacatcaagcc

SEQ ID NO: 960114 - DNA, 25 bp, Mus musculus
gtgtgatgcaccgagacatcaagcc

SEQ ID NO: 960115 - DNA, 25 bp, Mus musculus
gtgtgatggtcacgaagcctgctgc

SEQ ID NO: 960116 - DNA, 25 bp, Mus musculus
gtgtgatggtcaggaagcctgctgc

SEQ ID NO: 960117 - DNA, 25 bp, Mus musculus
gtgtgatttgcgcaaatccctcttc

SEQ ID NO: 960118 - DNA, 25 bp, Mus musculus
gtgtgatttgcggaaatccctcttc

SEQ ID NO: 960119 - DNA, 25 bp, Mus musculus
gtgtgcaaccagctagaatgtcatc

SEQ ID NO: 960120 - DNA, 25 bp, Mus musculus
gtgtgcaaccaggtagaatgtcatc

SEQ ID NO: 960121 - DNA, 25 bp, Mus musculus
gtgtgcacatcctccggactctaat

SEQ ID NO: 960122 - DNA, 25 bp, Mus musculus
gtgtgcacatcctcgggactctaat

SEQ ID NO: 960123 - DNA, 25 bp, Mus musculus
gtgtgcagaatgactcacagatctt

SEQ ID NO: 960124 - DNA, 25 bp, Mus musculus
gtgtgcagaatgtctcacagatctt

SEQ ID NO: 960125 - DNA, 25 bp, Mus musculus
gtgtgcagagcttctcacacagcag

SEQ ID NO: 960126 - DNA, 25 bp, Mus musculus
gtgtgcagaggttctcacacagcag

SEQ ID NO: 960127 - DNA, 25 bp, Mus musculus
gtgtgcagcgcggagagttagattt

SEQ ID NO: 960128 - DNA, 25 bp, Mus musculus
gtgtgcagcggggagagttagattt

SEQ ID NO: 960129 - DNA, 25 bp, Mus musculus
gtgtgcagctaccgacactactgct

SEQ ID NO: 960130 - DNA, 25 bp, Mus musculus
gtgtgcagctacggacactactgct

SEQ ID NO: 960131 - DNA, 25 bp, Mus musculus
gtgtgcatacggatcaggagattgc

SEQ ID NO: 960132 - DNA, 25 bp, Mus musculus
gtgtgcatacggatgaggagattgc

SEQ ID NO: 960133 - DNA, 25 bp, Mus musculus
gtgtgcatccctctcgcctggttcc

SEQ ID NO: 960134 - DNA, 25 bp, Mus musculus
gtgtgcatccctctggcctggttcc

SEQ ID NO: 960135 - DNA, 25 bp, Mus musculus
gtgtgcattggacacattgtccttc

SEQ ID NO: 960136 - DNA, 25 bp, Mus musculus
gtgtgcattggacagattgtccttc

SEQ ID NO: 960137 - DNA, 25 bp, Mus musculus
gtgtgccagccacgtgggcatgaca

SEQ ID NO: 960138 - DNA, 25 bp, Mus musculus
gtgtgccagccaggtgggcatgaca

SEQ ID NO: 960139 - DNA, 25 bp, Mus musculus
gtgtgccagctgcccgactgccctc

SEQ ID NO: 960140 - DNA, 25 bp, Mus musculus
gtgtgccagctgccggactgccctc

SEQ ID NO: 960141 - DNA, 25 bp, Mus musculus
gtgtgcccagcaccctgagctcagt

SEQ ID NO: 960142 - DNA, 25 bp, Mus musculus
gtgtgcccagcagaaacatcctaag

SEQ ID NO: 960143 - DNA, 25 bp, Mus musculus
gtgtgcccagcccagtatggaatcc

SEQ ID NO: 960144 - DNA, 25 bp, Mus musculus
gtgtgcccaggaccctgagctcagt

SEQ ID NO: 960145 - DNA, 25 bp, Mus musculus
gtgtgcccaggagaaacatcctaag

SEQ ID NO: 960146 - DNA, 25 bp, Mus musculus
gtgtgcccaggccagtatggaatcc

SEQ ID NO: 960147 - DNA, 25 bp, Mus musculus
gtgtgccgaggaggcgcgtgctggt

SEQ ID NO: 960148 - DNA, 25 bp, Mus musculus
gtgtgccgaggaggggcgtgctggt

SEQ ID NO: 960149 - DNA, 25 bp, Mus musculus
gtgtgcctctctgctaggtttattc

SEQ ID NO: 960150 - DNA, 25 bp, Mus musculus
gtgtgcctctgtgctaggtttattc

SEQ ID NO: 960151 - DNA, 25 bp, Mus musculus
gtgtgcctgagccgaggactggcta

SEQ ID NO: 960152 - DNA, 25 bp, Mus musculus
gtgtgcctgagccggctagctgtgg

SEQ ID NO: 960153 - DNA, 25 bp, Mus musculus
gtgtgcctgagcggaggactggcta

SEQ ID NO: 960154 - DNA, 25 bp, Mus musculus
gtgtgcctgagcgggctagctgtgg

SEQ ID NO: 960155 - DNA, 25 bp, Mus musculus
gtgtgcgaagatgtggatgagtgca

SEQ ID NO: 960156 - DNA, 25 bp, Mus musculus
gtgtgcgaagttgtggatgagtgca

SEQ ID NO: 960157 - DNA, 25 bp, Mus musculus
gtgtgcgaccagatctgctgcttac

SEQ ID NO: 960158 - DNA, 25 bp, Mus musculus
gtgtgcgaccagctgtctgcctgta

SEQ ID NO: 960159 - DNA, 25 bp, Mus musculus
gtgtgcgaccaggtgtctgcctgta

SEQ ID NO: 960160 - DNA, 25 bp, Mus musculus
gtgtgcgaccagttctgctgcttac

SEQ ID NO: 960161 - DNA, 25 bp, Mus musculus
gtgtgcgcatagagcctcgacttct

SEQ ID NO: 960162 - DNA, 25 bp, Mus musculus
gtgtgcgcatagtgcctcgacttct

SEQ ID NO: 960163 - DNA, 25 bp, Mus musculus
gtgtgcgcctctgcccgtccaggga

SEQ ID NO: 960164 - DNA, 25 bp, Mus musculus
gtgtgcgcctgtgcccgtccaggga

SEQ ID NO: 960165 - DNA, 25 bp, Mus musculus
gtgtgcggagccaggagctaacatg

SEQ ID NO: 960166 - DNA, 25 bp, Mus musculus
gtgtgcggaggcaggagctaacatg

SEQ ID NO: 960167 - DNA, 25 bp, Mus musculus
gtgtgcggcaagctgttcaatgctc

SEQ ID NO: 960168 - DNA, 25 bp, Mus musculus
gtgtgcggcaaggtgttcaatgctc

SEQ ID NO: 960169 - DNA, 25 bp, Mus musculus
gtgtgcgtgtaacacatgctccatc

SEQ ID NO: 960170 - DNA, 25 bp, Mus musculus
gtgtgcgtgtaacacgggctcctta

SEQ ID NO: 960171 - DNA, 25 bp, Mus musculus
gtgtgcgtgtaacagatgctccatc

SEQ ID NO: 960172 - DNA, 25 bp, Mus musculus
gtgtgcgtgtaacaggggctcctta

SEQ ID NO: 960173 - DNA, 25 bp, Mus musculus
gtgtgctagacacgtggaaggctct

SEQ ID NO: 960174 - DNA, 25 bp, Mus musculus
gtgtgctagacaggtggaaggctct

SEQ ID NO: 960175 - DNA, 25 bp, Mus musculus
gtgtgctcagaacagcaaagtccaa

SEQ ID NO: 960176 - DNA, 25 bp, Mus musculus
gtgtgctcagaagagcaaagtccaa

SEQ ID NO: 960177 - DNA, 25 bp, Mus musculus
gtgtgctgctcaaagaggtcctccg

SEQ ID NO: 960178 - DNA, 25 bp, Mus musculus
gtgtgctgctcatagaggtcctccg

SEQ ID NO: 960179 - DNA, 25 bp, Mus musculus
gtgtgcttctgtagaaggggtgagc

SEQ ID NO: 960180 - DNA, 25 bp, Mus musculus
gtgtgcttctgttgaaggggtgagc

SEQ ID NO: 960181 - DNA, 25 bp, Mus musculus
gtgtgctttgccaacgctgaactca

SEQ ID NO: 960182 - DNA, 25 bp, Mus musculus
gtgtgctttgccaaggctgaactca

SEQ ID NO: 960183 - DNA, 25 bp, Mus musculus
gtgtggaacatgaaccccgtgtgcc

SEQ ID NO: 960184 - DNA, 25 bp, Mus musculus
gtgtggaacatgaagcccgtgtgcc

SEQ ID NO: 960185 - DNA, 25 bp, Mus musculus
gtgtggaagaacccctcagcagccc

SEQ ID NO: 960186 - DNA, 25 bp, Mus musculus
gtgtggaagatcccctcagcagccc

SEQ ID NO: 960187 - DNA, 25 bp, Mus musculus
gtgtggacaaggaacactttctctg

SEQ ID NO: 960188 - DNA, 25 bp, Mus musculus
gtgtggacaaggaacgttctgagcc

SEQ ID NO: 960189 - DNA, 25 bp, Mus musculus
gtgtggacaaggaagactttctctg

SEQ ID NO: 960190 - DNA, 25 bp, Mus musculus
gtgtggacaaggaaggttctgagcc

SEQ ID NO: 960191 - DNA, 25 bp, Mus musculus
gtgtggagcagttcactgaagccag

SEQ ID NO: 960192 - DNA, 25 bp, Mus musculus
gtgtggagcagttctctgaagccag

SEQ ID NO: 960193 - DNA, 25 bp, Mus musculus
gtgtggatcaagccggaagaccaac

SEQ ID NO: 960194 - DNA, 25 bp, Mus musculus
gtgtggatcaaggcggaagaccaac

SEQ ID NO: 960195 - DNA, 25 bp, Mus musculus
gtgtggcaagcttggtgctctcttt

SEQ ID NO: 960196 - DNA, 25 bp, Mus musculus
gtgtggcaaggttggtgctctcttt

SEQ ID NO: 960197 - DNA, 25 bp, Mus musculus
gtgtggccttgcagactatgccgac

SEQ ID NO: 960198 - DNA, 25 bp, Mus musculus
gtgtggccttgcagtctatgccgac

SEQ ID NO: 960199 - DNA, 25 bp, Mus musculus
gtgtggcttgctacctggaatggaa

SEQ ID NO: 960200 - DNA, 25 bp, Mus musculus
gtgtggcttggtacctggaatggaa

SEQ ID NO: 960201 - DNA, 25 bp, Mus musculus
gtgtgggaacagctggaaggtaggc

SEQ ID NO: 960202 - DNA, 25 bp, Mus musculus
gtgtgggaacaggtggaaggtaggc

SEQ ID NO: 960203 - DNA, 25 bp, Mus musculus
gtgtgggacaagcttttgagcatta

SEQ ID NO: 960204 - DNA, 25 bp, Mus musculus
gtgtgggacaaggttttgagcatta

SEQ ID NO: 960205 - DNA, 25 bp, Mus musculus
gtgtgggagagacgcaccatgacaa

SEQ ID NO: 960206 - DNA, 25 bp, Mus musculus
gtgtgggagagaggcaccatgacaa

SEQ ID NO: 960207 - DNA, 25 bp, Mus musculus
gtgtgggctccaagtgcctgtggac

SEQ ID NO: 960208 - DNA, 25 bp, Mus musculus
gtgtgggctccatgtgcctgtggac

SEQ ID NO: 960209 - DNA, 25 bp, Mus musculus
gtgtgggctgctaccctctgccctg

SEQ ID NO: 960210 - DNA, 25 bp, Mus musculus
gtgtgggctggtaccctctgccctg

SEQ ID NO: 960211 - DNA, 25 bp, Mus musculus
gtgtgggtgaagcacgagtggcatg

SEQ ID NO: 960212 - DNA, 25 bp, Mus musculus
gtgtgggtgaagcaggagtggcatg

SEQ ID NO: 960213 - DNA, 25 bp, Mus musculus
gtgtggtctcggcggcccttcggag

SEQ ID NO: 960214 - DNA, 25 bp, Mus musculus
gtgtggtctcgggggcccttcggag

SEQ ID NO: 960215 - DNA, 25 bp, Mus musculus
gtgtggtgccagcactggatcccag

SEQ ID NO: 960216 - DNA, 25 bp, Mus musculus
gtgtggtgccaggactggatcccag

SEQ ID NO: 960217 - DNA, 25 bp, Mus musculus
gtgtggtggccgcttggagcctctc

SEQ ID NO: 960218 - DNA, 25 bp, Mus musculus
gtgtggtggccggttggagcctctc

SEQ ID NO: 960219 - DNA, 25 bp, Mus musculus
gtgtgtaaacaaactcctggaagtg

SEQ ID NO: 960220 - DNA, 25 bp, Mus musculus
gtgtgtaaacaatctcctggaagtg

SEQ ID NO: 960221 - DNA, 25 bp, Mus musculus
gtgtgtacagaacgttacacaggga

SEQ ID NO: 960222 - DNA, 25 bp, Mus musculus
gtgtgtacagaaggttacacaggga

SEQ ID NO: 960223 - DNA, 25 bp, Mus musculus
gtgtgtccattgcggaagacgggcc

SEQ ID NO: 960224 - DNA, 25 bp, Mus musculus
gtgtgtccattggggaagacgggcc

SEQ ID NO: 960225 - DNA, 25 bp, Mus musculus
gtgtgtcctgtgaacacatcaacga

SEQ ID NO: 960226 - DNA, 25 bp, Mus musculus
gtgtgtcctgtgaacacatcaatga

SEQ ID NO: 960227 - DNA, 25 bp, Mus musculus
gtgtgtcctgtgaacaccaagacga

SEQ ID NO: 960228 - DNA, 25 bp, Mus musculus
gtgtgtcctgtgaagacatcaacga

SEQ ID NO: 960229 - DNA, 25 bp, Mus musculus
gtgtgtcctgtgaagacatcaatga

SEQ ID NO: 960230 - DNA, 25 bp, Mus musculus
gtgtgtcctgtgaagaccaagacga

SEQ ID NO: 960231 - DNA, 25 bp, Mus musculus
gtgtgtcgaaggcctatggatttgt

SEQ ID NO: 960232 - DNA, 25 bp, Mus musculus
gtgtgtcgaagggctatggatttgt

SEQ ID NO: 960233 - DNA, 25 bp, Mus musculus
gtgtgtcgagcagatggtgtctacc

SEQ ID NO: 960234 - DNA, 25 bp, Mus musculus
gtgtgtcgaggagatggtgtctacc

SEQ ID NO: 960235 - DNA, 25 bp, Mus musculus
gtgtgtctcgctaacatttgccggt

SEQ ID NO: 960236 - DNA, 25 bp, Mus musculus
gtgtgtctcggtaacatttgccggt

SEQ ID NO: 960237 - DNA, 25 bp, Mus musculus
gtgtgtgaagcaaggagaactcatg

SEQ ID NO: 960238 - DNA, 25 bp, Mus musculus
gtgtgtgaaggaaggagaactcatg

SEQ ID NO: 960239 - DNA, 25 bp, Mus musculus
gtgtgtgacttaccccaggagttaa

SEQ ID NO: 960240 - DNA, 25 bp, Mus musculus
gtgtgtgacttacgtaggtgagcct

SEQ ID NO: 960241 - DNA, 25 bp, Mus musculus
gtgtgtgacttagcccaggagttaa

SEQ ID NO: 960242 - DNA, 25 bp, Mus musculus
gtgtgtgacttaggtaggtgagcct

SEQ ID NO: 960243 - DNA, 25 bp, Mus musculus
gtgtgtgagtctgacactcggacct

SEQ ID NO: 960244 - DNA, 25 bp, Mus musculus
gtgtgtgagtctgagactcggacct

SEQ ID NO: 960245 - DNA, 25 bp, Mus musculus
gtgtgtgattaaccctctggactat

SEQ ID NO: 960246 - DNA, 25 bp, Mus musculus
gtgtgtgattaagcctctggactat

SEQ ID NO: 960247 - DNA, 25 bp, Mus musculus
gtgtgtgcaaatcacccaggatgta

SEQ ID NO: 960248 - DNA, 25 bp, Mus musculus
gtgtgtgcaaatgacccaggatgta

SEQ ID NO: 960249 - DNA, 25 bp, Mus musculus
gtgtgtgcagcctatttcaggttca

SEQ ID NO: 960250 - DNA, 25 bp, Mus musculus
gtgtgtgcagcgcggagagttagat

SEQ ID NO: 960251 - DNA, 25 bp, Mus musculus
gtgtgtgcagcggggagagttagat

SEQ ID NO: 960252 - DNA, 25 bp, Mus musculus
gtgtgtgcaggctatttcaggttca

SEQ ID NO: 960253 - DNA, 25 bp, Mus musculus
gtgtgtgcccgtcgtatcgatgttg

SEQ ID NO: 960254 - DNA, 25 bp, Mus musculus
gtgtgtgcccgtggtatcgatgttg

SEQ ID NO: 960255 - DNA, 25 bp, Mus musculus
gtgtgtggaggccggtatgatcgca

SEQ ID NO: 960256 - DNA, 25 bp, Mus musculus
gtgtgtggaggcgggtatgatcgca

SEQ ID NO: 960257 - DNA, 25 bp, Mus musculus
gtgtgtgtggaggccggtatgatcg

SEQ ID NO: 960258 - DNA, 25 bp, Mus musculus
gtgtgtgtggaggcgggtatgatcg

SEQ ID NO: 960259 - DNA, 25 bp, Mus musculus
gtgtgtgtgtccgcgcgcaagcgcg

SEQ ID NO: 960260 - DNA, 25 bp, Mus musculus
gtgtgtgtgtgcgcgcgcaagcgcg

SEQ ID NO: 960261 - DNA, 25 bp, Mus musculus
gtgtgtgtgtgtccgcgcgcaagcg

SEQ ID NO: 960262 - DNA, 25 bp, Mus musculus
gtgtgtgtgtgtgcgcgcgcaagcg

SEQ ID NO: 960263 - DNA, 25 bp, Mus musculus
gtgtgtgttattcgactctgggctt

SEQ ID NO: 960264 - DNA, 25 bp, Mus musculus
gtgtgtgttattggactctgggctt

SEQ ID NO: 960265 - DNA, 25 bp, Mus musculus
gtgtgttaagccatcaaacaatgaa

SEQ ID NO: 960266 - DNA, 25 bp, Mus musculus
gtgtgttaagcttaccaacatatcc

SEQ ID NO: 960267 - DNA, 25 bp, Mus musculus
gtgtgttaaggcatcaaacaatgaa

SEQ ID NO: 960268 - DNA, 25 bp, Mus musculus
gtgtgttaaggttaccaacatatcc

SEQ ID NO: 960269 - DNA, 25 bp, Mus musculus
gtgtgttataagcaatgcccacaac

SEQ ID NO: 960270 - DNA, 25 bp, Mus musculus
gtgtgttataaggaatgcccacaac

SEQ ID NO: 960271 - DNA, 25 bp, Mus musculus
gtgtgttcctgccacactgggtttg

SEQ ID NO: 960272 - DNA, 25 bp, Mus musculus
gtgtgttcctgccagactgggtttg

SEQ ID NO: 960273 - DNA, 25 bp, Mus musculus
gtgtgttctgtacattcgagtaaga

SEQ ID NO: 960274 - DNA, 25 bp, Mus musculus
gtgtgttctgtagattcgagtaaga

SEQ ID NO: 960275 - DNA, 25 bp, Mus musculus
gtgtgtttggagaacccagattcca

SEQ ID NO: 960276 - DNA, 25 bp, Mus musculus
gtgtgtttggagtacccagattcca

SEQ ID NO: 960277 - DNA, 25 bp, Mus musculus
gtgttaaaagacatcactcaagaga

SEQ ID NO: 960278 - DNA, 25 bp, Mus musculus
gtgttaaaagtcatcactcaagaga

SEQ ID NO: 960279 - DNA, 25 bp, Mus musculus
gtgttaagattccgtggtatatttg

SEQ ID NO: 960280 - DNA, 25 bp, Mus musculus
gtgttaagattcggtggtatatttg

SEQ ID NO: 960281 - DNA, 25 bp, Mus musculus
gtgttacaagagacttgcagcacca

SEQ ID NO: 960282 - DNA, 25 bp, Mus musculus
gtgttacaagagttggtgaaaagac

SEQ ID NO: 960283 - DNA, 25 bp, Mus musculus
gtgttacaagcagagacttgcagca

SEQ ID NO: 960284 - DNA, 25 bp, Mus musculus
gtgttacaaggagagacttgcagca

SEQ ID NO: 960285 - DNA, 25 bp, Mus musculus
gtgttacaagtgacttgcagcacca

SEQ ID NO: 960286 - DNA, 25 bp, Mus musculus
gtgttacaagtgttggtgaaaagac

SEQ ID NO: 960287 - DNA, 25 bp, Mus musculus
gtgttactatccttcctgtgggact

SEQ ID NO: 960288 - DNA, 25 bp, Mus musculus
gtgttactatgcttcctgtgggact

SEQ ID NO: 960289 - DNA, 25 bp, Mus musculus
gtgttagaacagatcccagaaatct

SEQ ID NO: 960290 - DNA, 25 bp, Mus musculus
gtgttagaacagttcccagaaatct

SEQ ID NO: 960291 - DNA, 25 bp, Mus musculus
gtgttataaagaaacaagatcatca

SEQ ID NO: 960292 - DNA, 25 bp, Mus musculus
gtgttataaagaaagaagatcatca

SEQ ID NO: 960293 - DNA, 25 bp, Mus musculus
gtgttataagcaatgcccacaactg

SEQ ID NO: 960294 - DNA, 25 bp, Mus musculus
gtgttataaggaatgcccacaactg

SEQ ID NO: 960295 - DNA, 25 bp, Mus musculus
gtgttatcagaacccccaacttgaa

SEQ ID NO: 960296 - DNA, 25 bp, Mus musculus
gtgttatcagaagccccaacttgaa

SEQ ID NO: 960297 - DNA, 25 bp, Mus musculus
gtgttattgcagcattcatggcatt

SEQ ID NO: 960298 - DNA, 25 bp, Mus musculus
gtgttattgcaggattcatggcatt

SEQ ID NO: 960299 - DNA, 25 bp, Mus musculus
gtgttcaaagagaccttcagtccgg

SEQ ID NO: 960300 - DNA, 25 bp, Mus musculus
gtgttcaaagtgaccttcagtccgg

SEQ ID NO: 960301 - DNA, 25 bp, Mus musculus
gtgttcaaggagaacaagaaaaagt

SEQ ID NO: 960302 - DNA, 25 bp, Mus musculus
gtgttcaaggagaagaagaaaaagt

SEQ ID NO: 960303 - DNA, 25 bp, Mus musculus
gtgttcacggcaatgacatcacgct

SEQ ID NO: 960304 - DNA, 25 bp, Mus musculus
gtgttcacggcattgacatcacgct

SEQ ID NO: 960305 - DNA, 25 bp, Mus musculus
gtgttcagcccacacacagctgtgg

SEQ ID NO: 960306 - DNA, 25 bp, Mus musculus
gtgttcagcccagacacagctgtgg

SEQ ID NO: 960307 - DNA, 25 bp, Mus musculus
gtgttcagtactcacctagttacag

SEQ ID NO: 960308 - DNA, 25 bp, Mus musculus
gtgttcagtactcagctagttacag

SEQ ID NO: 960309 - DNA, 25 bp, Mus musculus
gtgttcatgcacaacatgccacgcc

SEQ ID NO: 960310 - DNA, 25 bp, Mus musculus
gtgttcatgcacaagatgccacgcc

SEQ ID NO: 960311 - DNA, 25 bp, Mus musculus
gtgttcatggagcacgttcatcgag

SEQ ID NO: 960312 - DNA, 25 bp, Mus musculus
gtgttcatggagcaggttcatcgag

SEQ ID NO: 960313 - DNA, 25 bp, Mus musculus
gtgttccaacgaaactgttcaatgt

SEQ ID NO: 960314 - DNA, 25 bp, Mus musculus
gtgttccaacgaaagtgttcaatgt

SEQ ID NO: 960315 - DNA, 25 bp, Mus musculus
gtgttcctgccacactgggtttgtc

SEQ ID NO: 960316 - DNA, 25 bp, Mus musculus
gtgttcctgccagactgggtttgtc

SEQ ID NO: 960317 - DNA, 25 bp, Mus musculus
gtgttcctggctcttgctttctcca

SEQ ID NO: 960318 - DNA, 25 bp, Mus musculus
gtgttcctgggtcttgctttctcca

SEQ ID NO: 960319 - DNA, 25 bp, Mus musculus
gtgttcgccaccaacgatgctgtgg

SEQ ID NO: 960320 - DNA, 25 bp, Mus musculus
gtgttcgccaccaaggatgctgtgg

SEQ ID NO: 960321 - DNA, 25 bp, Mus musculus
gtgttcggtgcagacccaccatgcc

SEQ ID NO: 960322 - DNA, 25 bp, Mus musculus
gtgttcggtgcagagccaccatgcc

SEQ ID NO: 960323 - DNA, 25 bp, Mus musculus
gtgttctgttcttattttccttcac

SEQ ID NO: 960324 - DNA, 25 bp, Mus musculus
gtgttctgttgttattttccttcac

SEQ ID NO: 960325 - DNA, 25 bp, Mus musculus
gtgttcttccacaacgaggtgtgtg

SEQ ID NO: 960326 - DNA, 25 bp, Mus musculus
gtgttcttccacaaggaggtgtgtg

SEQ ID NO: 960327 - DNA, 25 bp, Mus musculus
gtgttcttcccaccctcctggtgga

SEQ ID NO: 960328 - DNA, 25 bp, Mus musculus
gtgttcttcccagcctcctggtgga

SEQ ID NO: 960329 - DNA, 25 bp, Mus musculus
gtgttgaatctgagaattatatcca

SEQ ID NO: 960330 - DNA, 25 bp, Mus musculus
gtgttgaatctgtgaattatatcca

SEQ ID NO: 960331 - DNA, 25 bp, Mus musculus
gtgttgcataacaacttttggcaag

SEQ ID NO: 960332 - DNA, 25 bp, Mus musculus
gtgttgcataacaagttttggcaag

SEQ ID NO: 960333 - DNA, 25 bp, Mus musculus
gtgttgctgaagaacgatgtggatg

SEQ ID NO: 960334 - DNA, 25 bp, Mus musculus
gtgttgctgaagaaggatgtggatg

SEQ ID NO: 960335 - DNA, 25 bp, Mus musculus
gtgttgctggatgagtattggagaa

SEQ ID NO: 960336 - DNA, 25 bp, Mus musculus
gtgttgctggctgccatgcctatga

SEQ ID NO: 960337 - DNA, 25 bp, Mus musculus
gtgttgctggctggattgccttttg

SEQ ID NO: 960338 - DNA, 25 bp, Mus musculus
gtgttgctgggtgccatgcctatga

SEQ ID NO: 960339 - DNA, 25 bp, Mus musculus
gtgttgctgggtggattgccttttg

SEQ ID NO: 960340 - DNA, 25 bp, Mus musculus
gtgttgctggttgagtattggagaa

SEQ ID NO: 960341 - DNA, 25 bp, Mus musculus
gtgttggctcagcagggtgtgaaga

SEQ ID NO: 960342 - DNA, 25 bp, Mus musculus
gtgttggctcaggagggtgtgaaga

SEQ ID NO: 960343 - DNA, 25 bp, Mus musculus
gtgttggtcgcctctctgcctttca

SEQ ID NO: 960344 - DNA, 25 bp, Mus musculus
gtgttggtcgcgggggttctactgt

SEQ ID NO: 960345 - DNA, 25 bp, Mus musculus
gtgttggtcggctctctgcctttca

SEQ ID NO: 960346 - DNA, 25 bp, Mus musculus
gtgttggtcgggggggttctactgt

SEQ ID NO: 960347 - DNA, 25 bp, Mus musculus
gtgttgtcctggcagatggaagtac

SEQ ID NO: 960348 - DNA, 25 bp, Mus musculus
gtgttgtcctgggagatggaagtac

SEQ ID NO: 960349 - DNA, 25 bp, Mus musculus
gtgttgtgagcagtccatgaagatt

SEQ ID NO: 960350 - DNA, 25 bp, Mus musculus
gtgttgtgaggagtccatgaagatt

SEQ ID NO: 960351 - DNA, 25 bp, Mus musculus
gtgtttatcaatacacatctccaga

SEQ ID NO: 960352 - DNA, 25 bp, Mus musculus
gtgtttatcattacacatctccaga

SEQ ID NO: 960353 - DNA, 25 bp, Mus musculus
gtgtttatgacaccttttggaatga

SEQ ID NO: 960354 - DNA, 25 bp, Mus musculus
gtgtttatgacagcttttggaatga

SEQ ID NO: 960355 - DNA, 25 bp, Mus musculus
gtgtttcaaaagccattgcgctccc

SEQ ID NO: 960356 - DNA, 25 bp, Mus musculus
gtgtttcaaaagctctcttctccct

SEQ ID NO: 960357 - DNA, 25 bp, Mus musculus
gtgtttcaaaaggcattgcgctccc

SEQ ID NO: 960358 - DNA, 25 bp, Mus musculus
gtgtttcaaaaggtctcttctccct

SEQ ID NO: 960359 - DNA, 25 bp, Mus musculus
gtgtttcgtcatgacatcaaggaca

SEQ ID NO: 960360 - DNA, 25 bp, Mus musculus
gtgtttcgtcatgagatcaaggaca

SEQ ID NO: 960361 - DNA, 25 bp, Mus musculus
gtgtttctggtgaacattatgggac

SEQ ID NO: 960362 - DNA, 25 bp, Mus musculus
gtgtttctggtgaagattatgggac

SEQ ID NO: 960363 - DNA, 25 bp, Mus musculus
gtgtttgacaagcatgggaatggtt

SEQ ID NO: 960364 - DNA, 25 bp, Mus musculus
gtgtttgacaaggatgggaatggtt

SEQ ID NO: 960365 - DNA, 25 bp, Mus musculus
gtgtttgacatggcaacagaagttg

SEQ ID NO: 960366 - DNA, 25 bp, Mus musculus
gtgtttgacatggctacagaagttg

SEQ ID NO: 960367 - DNA, 25 bp, Mus musculus
gtgtttgcatgctacgagatgtacg

SEQ ID NO: 960368 - DNA, 25 bp, Mus musculus
gtgtttgcatgctaggagatgtacg

SEQ ID NO: 960369 - DNA, 25 bp, Mus musculus
gtgtttggacggagtgccggactcc

SEQ ID NO: 960370 - DNA, 25 bp, Mus musculus
gtgtttggacggtgtgccggactcc

SEQ ID NO: 960371 - DNA, 25 bp, Mus musculus
gtgtttggagaacccagattccaaa

SEQ ID NO: 960372 - DNA, 25 bp, Mus musculus
gtgtttggagtacccagattccaaa

SEQ ID NO: 960373 - DNA, 25 bp, Mus musculus
gtgtttgtagacccatccctgacgg

SEQ ID NO: 960374 - DNA, 25 bp, Mus musculus
gtgtttgtagtcccatccctgacgg

SEQ ID NO: 960375 - DNA, 25 bp, Mus musculus
gtgtttgtcagtgacctttctgtca

SEQ ID NO: 960376 - DNA, 25 bp, Mus musculus
gtgtttgtcagtgagctttctgtca

SEQ ID NO: 960377 - DNA, 25 bp, Mus musculus
gtgtttgtgcagccggccctggccc

SEQ ID NO: 960378 - DNA, 25 bp, Mus musculus
gtgtttgtgcaggcggccctggccc

SEQ ID NO: 960379 - DNA, 25 bp, Mus musculus
gtgttttactacaacgaagctgccc

SEQ ID NO: 960380 - DNA, 25 bp, Mus musculus
gtgttttactacaaggaagctgccc

SEQ ID NO: 960381 - DNA, 25 bp, Mus musculus
gtgttttaggtcgacaatccttaga

SEQ ID NO: 960382 - DNA, 25 bp, Mus musculus
gtgttttaggtcgagaatccttaga

SEQ ID NO: 960383 - DNA, 25 bp, Mus musculus
gtgttttcaacactgacgaagagcg

SEQ ID NO: 960384 - DNA, 25 bp, Mus musculus
gtgttttcaacagtgacgaagagcg

SEQ ID NO: 960385 - DNA, 25 bp, Mus musculus
gtgttttcagatgtccctggtagat

SEQ ID NO: 960386 - DNA, 25 bp, Mus musculus
gtgttttcagttgtccctggtagat

SEQ ID NO: 960387 - DNA, 25 bp, Mus musculus
gtgttttgtgaacagtacccagtat

SEQ ID NO: 960388 - DNA, 25 bp, Mus musculus
gtgttttgtgaaccctggatggtgg

SEQ ID NO: 960389 - DNA, 25 bp, Mus musculus
gtgttttgtgaagagtacccagtat

SEQ ID NO: 960390 - DNA, 25 bp, Mus musculus
gtgttttgtgaagcctggatggtgg

SEQ ID NO: 960391 - DNA, 25 bp, Mus musculus
gtgtttttgcagaatgtgtgctgtg

SEQ ID NO: 960392 - DNA, 25 bp, Mus musculus
gtgtttttgcagtatgtgtgctgtg

SEQ ID NO: 960393 - DNA, 25 bp, Mus musculus
gttaaaacagagccgtgtgacaggc

SEQ ID NO: 960394 - DNA, 25 bp, Mus musculus
gttaaaacagaggcgtgtgacaggc

SEQ ID NO: 960395 - DNA, 25 bp, Mus musculus
gttaaaactgccaacgtcacccctg

SEQ ID NO: 960396 - DNA, 25 bp, Mus musculus
gttaaaactgccaaggtcacccctg

SEQ ID NO: 960397 - DNA, 25 bp, Mus musculus
gttaaagccaagcgccattctctta

SEQ ID NO: 960398 - DNA, 25 bp, Mus musculus
gttaaagccaagggccattctctta

SEQ ID NO: 960399 - DNA, 25 bp, Mus musculus
gttaaaggaatccagacgggtgctg

SEQ ID NO: 960400 - DNA, 25 bp, Mus musculus
gttaaaggaatcgagacgggtgctg

SEQ ID NO: 960401 - DNA, 25 bp, Mus musculus
gttaaaggagaaccaggtgaacgtg

SEQ ID NO: 960402 - DNA, 25 bp, Mus musculus
gttaaaggagaagcaggtgaacgtg

SEQ ID NO: 960403 - DNA, 25 bp, Mus musculus
gttaaatgtgaaattgaacacaagg

SEQ ID NO: 960404 - DNA, 25 bp, Mus musculus
gttaaatgtgaatttgaacacaagg

SEQ ID NO: 960405 - DNA, 25 bp, Mus musculus
gttaacaggccaaggatgcccgggt

SEQ ID NO: 960406 - DNA, 25 bp, Mus musculus
gttaacaggccatggatgcccgggt

SEQ ID NO: 960407 - DNA, 25 bp, Mus musculus
gttaactggcaacgattttcaccag

SEQ ID NO: 960408 - DNA, 25 bp, Mus musculus
gttaactggcaaggattttcaccag

SEQ ID NO: 960409 - DNA, 25 bp, Mus musculus
gttaagagagctaatagaattgcct

SEQ ID NO: 960410 - DNA, 25 bp, Mus musculus
gttaagagaggtaatagaattgcct

SEQ ID NO: 960411 - DNA, 25 bp, Mus musculus
gttaagcagatcaccgtacggttct

SEQ ID NO: 960412 - DNA, 25 bp, Mus musculus
gttaagcagatcacggtacggttct

SEQ ID NO: 960413 - DNA, 25 bp, Mus musculus
gttaaggaacagcctttcatgctgc

SEQ ID NO: 960414 - DNA, 25 bp, Mus musculus
gttaaggaacaggctttcatgctgc

SEQ ID NO: 960415 - DNA, 25 bp, Mus musculus
gttaaggaaggcgacggtgctgacc

SEQ ID NO: 960416 - DNA, 25 bp, Mus musculus
gttaaggaaggcgagggtgctgacc

SEQ ID NO: 960417 - DNA, 25 bp, Mus musculus
gttaaggatgccatcaatccaagca

SEQ ID NO: 960418 - DNA, 25 bp, Mus musculus
gttaaggatgccatgaatccaagca

SEQ ID NO: 960419 - DNA, 25 bp, Mus musculus
gttaatcacaaaaaaataattggcc

SEQ ID NO: 960420 - DNA, 25 bp, Mus musculus
gttaatcacaaaaatataattggcc

SEQ ID NO: 960421 - DNA, 25 bp, Mus musculus
gttaatcagaagcgctgttatgatc

SEQ ID NO: 960422 - DNA, 25 bp, Mus musculus
gttaatcagaagggctgttatgatc

SEQ ID NO: 960423 - DNA, 25 bp, Mus musculus
gttaatcagcaacatggaagccctc

SEQ ID NO: 960424 - DNA, 25 bp, Mus musculus
gttaatcagcaagatggaagccctc

SEQ ID NO: 960425 - DNA, 25 bp, Mus musculus
gttaatgacactgacaatgagatgg

SEQ ID NO: 960426 - DNA, 25 bp, Mus musculus
gttaatgacactgagaatgagatgg

SEQ ID NO: 960427 - DNA, 25 bp, Mus musculus
gttaatgagaagcgagccttctggg

SEQ ID NO: 960428 - DNA, 25 bp, Mus musculus
gttaatgagaagggagccttctggg

SEQ ID NO: 960429 - DNA, 25 bp, Mus musculus
gttaatggagctgttccctggccat

SEQ ID NO: 960430 - DNA, 25 bp, Mus musculus
gttaatggaggtgttccctggccat

SEQ ID NO: 960431 - DNA, 25 bp, Mus musculus
gttaattcagctagaagacgaaatc

SEQ ID NO: 960432 - DNA, 25 bp, Mus musculus
gttaattcaggtagaagacgaaatc

SEQ ID NO: 960433 - DNA, 25 bp, Mus musculus
gttacaattacacgggatttgacat

SEQ ID NO: 960434 - DNA, 25 bp, Mus musculus
gttacaattacaggggatttgacat

SEQ ID NO: 960435 - DNA, 25 bp, Mus musculus
gttacacacacacgattggagagct

SEQ ID NO: 960436 - DNA, 25 bp, Mus musculus
gttacacacacaggattggagagct

SEQ ID NO: 960437 - DNA, 25 bp, Mus musculus
gttacagaaatcgacctgaggaaac

SEQ ID NO: 960438 - DNA, 25 bp, Mus musculus
gttacagaaatcgagctgaggaaac

SEQ ID NO: 960439 - DNA, 25 bp, Mus musculus
gttacagagaagtcataaagcttcc

SEQ ID NO: 960440 - DNA, 25 bp, Mus musculus
gttacagagatgtcataaagcttcc

SEQ ID NO: 960441 - DNA, 25 bp, Mus musculus
gttacagaggatcccctattaagtc

SEQ ID NO: 960442 - DNA, 25 bp, Mus musculus
gttacagaggatgccctattaagtc

SEQ ID NO: 960443 - DNA, 25 bp, Mus musculus
gttacagctaaagacaatggactcg

SEQ ID NO: 960444 - DNA, 25 bp, Mus musculus
gttacagctaaagagaatggactcg

SEQ ID NO: 960445 - DNA, 25 bp, Mus musculus
gttacagcttcgctcggtggatgtg

SEQ ID NO: 960446 - DNA, 25 bp, Mus musculus
gttacagcttcgctgggtggatgtg

SEQ ID NO: 960447 - DNA, 25 bp, Mus musculus
gttacagttaagtactcttttcaca

SEQ ID NO: 960448 - DNA, 25 bp, Mus musculus
gttacagttaagtagtcttttcaca

SEQ ID NO: 960449 - DNA, 25 bp, Mus musculus
gttacatccctctgcatcggttaag

SEQ ID NO: 960450 - DNA, 25 bp, Mus musculus
gttacatccctctgctgaattccaa

SEQ ID NO: 960451 - DNA, 25 bp, Mus musculus
gttacatccctctggatcggttaag

SEQ ID NO: 960452 - DNA, 25 bp, Mus musculus
gttacatccctctggtgaattccaa

SEQ ID NO: 960453 - DNA, 25 bp, Mus musculus
gttaccacagcacaacaacaggctg

SEQ ID NO: 960454 - DNA, 25 bp, Mus musculus
gttaccacaggacaacaacaggctg

SEQ ID NO: 960455 - DNA, 25 bp, Mus musculus
gttaccaccattttcgaagaaccat

SEQ ID NO: 960456 - DNA, 25 bp, Mus musculus
gttaccaccattttggaagaaccat

SEQ ID NO: 960457 - DNA, 25 bp, Mus musculus
gttaccagtgttacaggattcaact

SEQ ID NO: 960458 - DNA, 25 bp, Mus musculus
gttaccagtgttactggattcaact

SEQ ID NO: 960459 - DNA, 25 bp, Mus musculus
gttaccatgcaacaccctgctgttc

SEQ ID NO: 960460 - DNA, 25 bp, Mus musculus
gttaccatgcaacagcctgctgttc

SEQ ID NO: 960461 - DNA, 25 bp, Mus musculus
gttacgatgaagactgccaaagtgg

SEQ ID NO: 960462 - DNA, 25 bp, Mus musculus
gttacgatgaagcctgtcatggtat

SEQ ID NO: 960463 - DNA, 25 bp, Mus musculus
gttacgatgaaggctgtcatggtat

SEQ ID NO: 960464 - DNA, 25 bp, Mus musculus
gttacgatgaagtctgccaaagtgg

SEQ ID NO: 960465 - DNA, 25 bp, Mus musculus
gttacgcttgaacttcatcctgctc

SEQ ID NO: 960466 - DNA, 25 bp, Mus musculus
gttacgcttgtacttcatcctgctc

SEQ ID NO: 960467 - DNA, 25 bp, Mus musculus
gttacggaggacccgagtcagaact

SEQ ID NO: 960468 - DNA, 25 bp, Mus musculus
gttacggagggcagtaaatcgtcct

SEQ ID NO: 960469 - DNA, 25 bp, Mus musculus
gttacggagggctgtaaatcgtcct

SEQ ID NO: 960470 - DNA, 25 bp, Mus musculus
gttacggaggtcccgagtcagaact

SEQ ID NO: 960471 - DNA, 25 bp, Mus musculus
gttactaaagcatgactatgaagcc

SEQ ID NO: 960472 - DNA, 25 bp, Mus musculus
gttactaaaggatgactatgaagcc

SEQ ID NO: 960473 - DNA, 25 bp, Mus musculus
gttactatcaaactattctgcagat

SEQ ID NO: 960474 - DNA, 25 bp, Mus musculus
gttactatcaaagtattctgcagat

SEQ ID NO: 960475 - DNA, 25 bp, Mus musculus
gttactatgaacttaatatggctat

SEQ ID NO: 960476 - DNA, 25 bp, Mus musculus
gttactatgaactttatatggctat

SEQ ID NO: 960477 - DNA, 25 bp, Mus musculus
gttactcacttgaaccccatctctg

SEQ ID NO: 960478 - DNA, 25 bp, Mus musculus
gttactcacttgaagcccatctctg

SEQ ID NO: 960479 - DNA, 25 bp, Mus musculus
gttactccagagaacgtctgtgcaa

SEQ ID NO: 960480 - DNA, 25 bp, Mus musculus
gttactccagagaaggtctgtgcaa

SEQ ID NO: 960481 - DNA, 25 bp, Mus musculus
gttactctgggcaccctaataattt

SEQ ID NO: 960482 - DNA, 25 bp, Mus musculus
gttactctgggcacgctaataattt

SEQ ID NO: 960483 - DNA, 25 bp, Mus musculus
gttactgagaagctcctggcggctg

SEQ ID NO: 960484 - DNA, 25 bp, Mus musculus
gttactgagaaggtcctggcggctg

SEQ ID NO: 960485 - DNA, 25 bp, Mus musculus
gttactgcagcgagaagagtccccg

SEQ ID NO: 960486 - DNA, 25 bp, Mus musculus
gttactgcagggagaagagtccccg

SEQ ID NO: 960487 - DNA, 25 bp, Mus musculus
gttactgcagtgcatgagtcgggta

SEQ ID NO: 960488 - DNA, 25 bp, Mus musculus
gttactgcagtggatgagtcgggta

SEQ ID NO: 960489 - DNA, 25 bp, Mus musculus
gttactgggcagctgtctgtgctgg

SEQ ID NO: 960490 - DNA, 25 bp, Mus musculus
gttactgggcaggtgtctgtgctgg

SEQ ID NO: 960491 - DNA, 25 bp, Mus musculus
gttactgtgagaaaaattgtcagaa

SEQ ID NO: 960492 - DNA, 25 bp, Mus musculus
gttactgtgagataaattgtcagaa

SEQ ID NO: 960493 - DNA, 25 bp, Mus musculus
gttagaaaagagtatgctgtcaagg

SEQ ID NO: 960494 - DNA, 25 bp, Mus musculus
gttagaaaagcatccgcagacatcc

SEQ ID NO: 960495 - DNA, 25 bp, Mus musculus
gttagaaaagccatctgtggcaagg

SEQ ID NO: 960496 - DNA, 25 bp, Mus musculus
gttagaaaaggatccgcagacatcc

SEQ ID NO: 960497 - DNA, 25 bp, Mus musculus
gttagaaaaggcatctgtggcaagg

SEQ ID NO: 960498 - DNA, 25 bp, Mus musculus
gttagaaaagtgtatgctgtcaagg

SEQ ID NO: 960499 - DNA, 25 bp, Mus musculus
gttagaacagatcccagaaatctgg

SEQ ID NO: 960500 - DNA, 25 bp, Mus musculus
gttagaacagttcccagaaatctgg

SEQ ID NO: 960501 - DNA, 25 bp, Mus musculus
gttagaagctctcaatgacaaaaag

SEQ ID NO: 960502 - DNA, 25 bp, Mus musculus
gttagaagctctgaatgacaaaaag

SEQ ID NO: 960503 - DNA, 25 bp, Mus musculus
gttagacaggctaaccaactcacca

SEQ ID NO: 960504 - DNA, 25 bp, Mus musculus
gttagacaggctaagcaactcacca

SEQ ID NO: 960505 - DNA, 25 bp, Mus musculus
gttagacattggatgccgccttgga

SEQ ID NO: 960506 - DNA, 25 bp, Mus musculus
gttagacattggctgcggttctggg

SEQ ID NO: 960507 - DNA, 25 bp, Mus musculus
gttagacattgggtgcggttctggg

SEQ ID NO: 960508 - DNA, 25 bp, Mus musculus
gttagacattggttgccgccttgga

SEQ ID NO: 960509 - DNA, 25 bp, Mus musculus
gttagactcagacgagctgtgattg

SEQ ID NO: 960510 - DNA, 25 bp, Mus musculus
gttagactcagactcataaggtcac

SEQ ID NO: 960511 - DNA, 25 bp, Mus musculus
gttagactcagaggagctgtgattg

SEQ ID NO: 960512 - DNA, 25 bp, Mus musculus
gttagactcagagtcataaggtcac

SEQ ID NO: 960513 - DNA, 25 bp, Mus musculus
gttagagcaaccgaagaagcccaag

SEQ ID NO: 960514 - DNA, 25 bp, Mus musculus
gttagagcaagcgaagaagcccaag

SEQ ID NO: 960515 - DNA, 25 bp, Mus musculus
gttagatcagcctgctttctcccac

SEQ ID NO: 960516 - DNA, 25 bp, Mus musculus
gttagatcagcggggctttgcccca

SEQ ID NO: 960517 - DNA, 25 bp, Mus musculus
gttagatcaggctgctttctcccac

SEQ ID NO: 960518 - DNA, 25 bp, Mus musculus
gttagatcaggggggctttgcccca

SEQ ID NO: 960519 - DNA, 25 bp, Mus musculus
gttagcagtcaaaatatggactaat

SEQ ID NO: 960520 - DNA, 25 bp, Mus musculus
gttagcagtcaaactcagcaacagc

SEQ ID NO: 960521 - DNA, 25 bp, Mus musculus
gttagcagtcaatatatggactaat

SEQ ID NO: 960522 - DNA, 25 bp, Mus musculus
gttagcagtcaatctcagcaacagc

SEQ ID NO: 960523 - DNA, 25 bp, Mus musculus
gttagccagctccacagtgtggacc

SEQ ID NO: 960524 - DNA, 25 bp, Mus musculus
gttagccagctccagagtgtggacc

SEQ ID NO: 960525 - DNA, 25 bp, Mus musculus
gttaggaaagcaaagcactgccacc

SEQ ID NO: 960526 - DNA, 25 bp, Mus musculus
gttaggaaaggaaagcactgccacc

SEQ ID NO: 960527 - DNA, 25 bp, Mus musculus
gttaggatcgcaccagagtatatgc

SEQ ID NO: 960528 - DNA, 25 bp, Mus musculus
gttaggatcggaccagagtatatgc

SEQ ID NO: 960529 - DNA, 25 bp, Mus musculus
gttagtgacccaccaaatgtgggtt

SEQ ID NO: 960530 - DNA, 25 bp, Mus musculus
gttagtgacccagcaaatgtgggtt

SEQ ID NO: 960531 - DNA, 25 bp, Mus musculus
gttataaagaaacaagatcatcaaa

SEQ ID NO: 960532 - DNA, 25 bp, Mus musculus
gttataaagaaagaagatcatcaaa

SEQ ID NO: 960533 - DNA, 25 bp, Mus musculus
gttataacatttcatgtgactggac

SEQ ID NO: 960534 - DNA, 25 bp, Mus musculus
gttataacatttgatgtgactggac

SEQ ID NO: 960535 - DNA, 25 bp, Mus musculus
gttataagagcgagaggaggggaaa

SEQ ID NO: 960536 - DNA, 25 bp, Mus musculus
gttataagagcgtgaggaggggaaa

SEQ ID NO: 960537 - DNA, 25 bp, Mus musculus
gttataccagcactgagcttgctgg

SEQ ID NO: 960538 - DNA, 25 bp, Mus musculus
gttataccaggactgagcttgctgg

SEQ ID NO: 960539 - DNA, 25 bp, Mus musculus
gttatacctccgccttatacaactg

SEQ ID NO: 960540 - DNA, 25 bp, Mus musculus
gttatacctccggcttatacaactg

SEQ ID NO: 960541 - DNA, 25 bp, Mus musculus
gttatatcagagtggtgatgtatga

SEQ ID NO: 960542 - DNA, 25 bp, Mus musculus
gttatatcagtgtggtgatgtatga

SEQ ID NO: 960543 - DNA, 25 bp, Mus musculus
gttatcaaagagcatgtctcggaac

SEQ ID NO: 960544 - DNA, 25 bp, Mus musculus
gttatcaaagaggatgtctcggaac

SEQ ID NO: 960545 - DNA, 25 bp, Mus musculus
gttatcaatgcacattttcccttcc

SEQ ID NO: 960546 - DNA, 25 bp, Mus musculus
gttatcaatgcagattttcccttcc

SEQ ID NO: 960547 - DNA, 25 bp, Mus musculus
gttatcaccacgtacgtggttatga

SEQ ID NO: 960548 - DNA, 25 bp, Mus musculus
gttatcaccaggtacgtggttatga

SEQ ID NO: 960549 - DNA, 25 bp, Mus musculus
gttatcccctatgtcagatacatca

SEQ ID NO: 960550 - DNA, 25 bp, Mus musculus
gttatcccctttgtcagatacatca

SEQ ID NO: 960551 - DNA, 25 bp, Mus musculus
gttatgattactgcaattgagaagc

SEQ ID NO: 960552 - DNA, 25 bp, Mus musculus
gttatgattagtgcaattgagaagc

SEQ ID NO: 960553 - DNA, 25 bp, Mus musculus
gttatgcacacacggacctgaagcc

SEQ ID NO: 960554 - DNA, 25 bp, Mus musculus
gttatgcacacagggacctgaagcc

SEQ ID NO: 960555 - DNA, 25 bp, Mus musculus
gttatgcacggagacatgcttttac

SEQ ID NO: 960556 - DNA, 25 bp, Mus musculus
gttatgcacggagagatgcttttac

SEQ ID NO: 960557 - DNA, 25 bp, Mus musculus
gttatgcagatacgtagccgagaga

SEQ ID NO: 960558 - DNA, 25 bp, Mus musculus
gttatgcagataggtagccgagaga

SEQ ID NO: 960559 - DNA, 25 bp, Mus musculus
gttatgccagacaggatttgcacaa

SEQ ID NO: 960560 - DNA, 25 bp, Mus musculus
gttatgccagtcaggatttgcacaa

SEQ ID NO: 960561 - DNA, 25 bp, Mus musculus
gttatggatcgctccacagacattg

SEQ ID NO: 960562 - DNA, 25 bp, Mus musculus
gttatggatcgctcgacagacattg

SEQ ID NO: 960563 - DNA, 25 bp, Mus musculus
gttatgtcaggacttcaccttttcc

SEQ ID NO: 960564 - DNA, 25 bp, Mus musculus
gttatgtcaggagttcaccttttcc

SEQ ID NO: 960565 - DNA, 25 bp, Mus musculus
gttatgtggaagcctggattcttta

SEQ ID NO: 960566 - DNA, 25 bp, Mus musculus
gttatgtggaaggctggattcttta

SEQ ID NO: 960567 - DNA, 25 bp, Mus musculus
gttattagaaaaatcataaactttg

SEQ ID NO: 960568 - DNA, 25 bp, Mus musculus
gttattagaaaaatgataaactttg

SEQ ID NO: 960569 - DNA, 25 bp, Mus musculus
gttattctggagaccccacccaaag

SEQ ID NO: 960570 - DNA, 25 bp, Mus musculus
gttattctggagtccccacccaaag

SEQ ID NO: 960571 - DNA, 25 bp, Mus musculus
gttattgaaaggctatgaatctcca

SEQ ID NO: 960572 - DNA, 25 bp, Mus musculus
gttattgaaagggtatgaatctcca

SEQ ID NO: 960573 - DNA, 25 bp, Mus musculus
gttattgatttgcccccatcaagaa

SEQ ID NO: 960574 - DNA, 25 bp, Mus musculus
gttattgatttggccccatcaagaa

SEQ ID NO: 960575 - DNA, 25 bp, Mus musculus
gttattgcagcattcatggcattcc

SEQ ID NO: 960576 - DNA, 25 bp, Mus musculus
gttattgcaggattcatggcattcc

SEQ ID NO: 960577 - DNA, 25 bp, Mus musculus
gttattgtggattctcaaacaagga

SEQ ID NO: 960578 - DNA, 25 bp, Mus musculus
gttattgtggtttctcaaacaagga

SEQ ID NO: 960579 - DNA, 25 bp, Mus musculus
gttattttaagacatcctggacctg

SEQ ID NO: 960580 - DNA, 25 bp, Mus musculus
gttattttaagagatcctggacctg

SEQ ID NO: 960581 - DNA, 25 bp, Mus musculus
gttcaaacacaacttggaaatctac

SEQ ID NO: 960582 - DNA, 25 bp, Mus musculus
gttcaaacacaagttggaaatctac

SEQ ID NO: 960583 - DNA, 25 bp, Mus musculus
gttcaaacagacgtggatggataac

SEQ ID NO: 960584 - DNA, 25 bp, Mus musculus
gttcaaacagctctatgaactggat

SEQ ID NO: 960585 - DNA, 25 bp, Mus musculus
gttcaaacaggtctatgaactggat

SEQ ID NO: 960586 - DNA, 25 bp, Mus musculus
gttcaaacagtcgtggatggataac

SEQ ID NO: 960587 - DNA, 25 bp, Mus musculus
gttcaaaccaagagtggcctccctc

SEQ ID NO: 960588 - DNA, 25 bp, Mus musculus
gttcaaaccaagtgtggcctccctc

SEQ ID NO: 960589 - DNA, 25 bp, Mus musculus
gttcaaatcccaagttccgtgagga

SEQ ID NO: 960590 - DNA, 25 bp, Mus musculus
gttcaaatcccatgttccgtgagga

SEQ ID NO: 960591 - DNA, 25 bp, Mus musculus
gttcaaccagctggtgatctttgtg

SEQ ID NO: 960592 - DNA, 25 bp, Mus musculus
gttcaaccaggtggtgatctttgtg

SEQ ID NO: 960593 - DNA, 25 bp, Mus musculus
gttcaaccggcagaatttgccagga

SEQ ID NO: 960594 - DNA, 25 bp, Mus musculus
gttcaaccgggacaggtctgctctg

SEQ ID NO: 960595 - DNA, 25 bp, Mus musculus
gttcaaccgggaccaggaggacagg

SEQ ID NO: 960596 - DNA, 25 bp, Mus musculus
gttcaaccgggaccattctcagagc

SEQ ID NO: 960597 - DNA, 25 bp, Mus musculus
gttcaaccgggagaatttgccagga

SEQ ID NO: 960598 - DNA, 25 bp, Mus musculus
gttcaaccgggagaggtctgctctg

SEQ ID NO: 960599 - DNA, 25 bp, Mus musculus
gttcaaccgggagcaggaggacagg

SEQ ID NO: 960600 - DNA, 25 bp, Mus musculus
gttcaaccgggagcattctcagagc

SEQ ID NO: 960601 - DNA, 25 bp, Mus musculus
gttcaactgtgaccgacaggtacaa

SEQ ID NO: 960602 - DNA, 25 bp, Mus musculus
gttcaactgtgagcgacaggtacaa

SEQ ID NO: 960603 - DNA, 25 bp, Mus musculus
gttcaaggagaacaagaaaaagtca

SEQ ID NO: 960604 - DNA, 25 bp, Mus musculus
gttcaaggagaagaagaaaaagtca

SEQ ID NO: 960605 - DNA, 25 bp, Mus musculus
gttcaagggctcttcctgttccggg

SEQ ID NO: 960606 - DNA, 25 bp, Mus musculus
gttcaagggctcttcggcagcgctc

SEQ ID NO: 960607 - DNA, 25 bp, Mus musculus
gttcaagggctcttgctgttccggg

SEQ ID NO: 960608 - DNA, 25 bp, Mus musculus
gttcaagggctcttgggcagcgctc

SEQ ID NO: 960609 - DNA, 25 bp, Mus musculus
gttcaataagacggtgcaggtgccc

SEQ ID NO: 960610 - DNA, 25 bp, Mus musculus
gttcaataagtcggtgcaggtgccc

SEQ ID NO: 960611 - DNA, 25 bp, Mus musculus
gttcaatggcaaagttaccaatcag

SEQ ID NO: 960612 - DNA, 25 bp, Mus musculus
gttcaatggcaatgttaccaatcag

SEQ ID NO: 960613 - DNA, 25 bp, Mus musculus
gttcaatggccacaagcaccaagaa

SEQ ID NO: 960614 - DNA, 25 bp, Mus musculus
gttcaatggccacgtcaggagttta

SEQ ID NO: 960615 - DNA, 25 bp, Mus musculus
gttcaatggccagaagcaccaagaa

SEQ ID NO: 960616 - DNA, 25 bp, Mus musculus
gttcaatggccaggtcaggagttta

SEQ ID NO: 960617 - DNA, 25 bp, Mus musculus
gttcacaattggagaccacagccgc

SEQ ID NO: 960618 - DNA, 25 bp, Mus musculus
gttcacaattggtgaccacagccgc

SEQ ID NO: 960619 - DNA, 25 bp, Mus musculus
gttcacacagcagtgccaggaggta

SEQ ID NO: 960620 - DNA, 25 bp, Mus musculus
gttcacacaggagtgccaggaggta

SEQ ID NO: 960621 - DNA, 25 bp, Mus musculus
gttcacacctaacatggaacagcta

SEQ ID NO: 960622 - DNA, 25 bp, Mus musculus
gttcacacctaacattgagcagcta

SEQ ID NO: 960623 - DNA, 25 bp, Mus musculus
gttcacacctaagatggaacagcta

SEQ ID NO: 960624 - DNA, 25 bp, Mus musculus
gttcacacctaagattgagcagcta

SEQ ID NO: 960625 - DNA, 25 bp, Mus musculus
gttcacagagatcccagaaaccggc

SEQ ID NO: 960626 - DNA, 25 bp, Mus musculus
gttcacagagctccagaaagcagtg

SEQ ID NO: 960627 - DNA, 25 bp, Mus musculus
gttcacagaggtccagaaagcagtg

SEQ ID NO: 960628 - DNA, 25 bp, Mus musculus
gttcacagagttcccagaaaccggc

SEQ ID NO: 960629 - DNA, 25 bp, Mus musculus
gttcacatggaaaacgatttgaccg

SEQ ID NO: 960630 - DNA, 25 bp, Mus musculus
gttcacatggaaaaggatttgaccg

SEQ ID NO: 960631 - DNA, 25 bp, Mus musculus
gttcaccaagactggccgtgtggtc

SEQ ID NO: 960632 - DNA, 25 bp, Mus musculus
gttcaccaagatatttatcaacaac

SEQ ID NO: 960633 - DNA, 25 bp, Mus musculus
gttcaccaagtctggccgtgtggtc

SEQ ID NO: 960634 - DNA, 25 bp, Mus musculus
gttcaccaagttatttatcaacaac

SEQ ID NO: 960635 - DNA, 25 bp, Mus musculus
gttcaccacacacacagaggagctg

SEQ ID NO: 960636 - DNA, 25 bp, Mus musculus
gttcaccacacagacagaggagctg

SEQ ID NO: 960637 - DNA, 25 bp, Mus musculus
gttcaccagtgagccggccccacac

SEQ ID NO: 960638 - DNA, 25 bp, Mus musculus
gttcaccagtgagcgggccccacac

SEQ ID NO: 960639 - DNA, 25 bp, Mus musculus
gttcacccagcctatggtgtgcagt

SEQ ID NO: 960640 - DNA, 25 bp, Mus musculus
gttcacccaggctatggtgtgcagt

SEQ ID NO: 960641 - DNA, 25 bp, Mus musculus
gttcacgaagcagacgctgaggagc

SEQ ID NO: 960642 - DNA, 25 bp, Mus musculus
gttcacgaagcagaggctgaggagc

SEQ ID NO: 960643 - DNA, 25 bp, Mus musculus
gttcacgcggcacgctcacctgcgg

SEQ ID NO: 960644 - DNA, 25 bp, Mus musculus
gttcacgcggcaggctcacctgcgg

SEQ ID NO: 960645 - DNA, 25 bp, Mus musculus
gttcacggcaatgacatcacgctga

SEQ ID NO: 960646 - DNA, 25 bp, Mus musculus
gttcacggcattgacatcacgctga

SEQ ID NO: 960647 - DNA, 25 bp, Mus musculus
gttcacggtcattacaccacttcct

SEQ ID NO: 960648 - DNA, 25 bp, Mus musculus
gttcacggtcattagaccacttcct

SEQ ID NO: 960649 - DNA, 25 bp, Mus musculus
gttcactcagagccagccatggaac

SEQ ID NO: 960650 - DNA, 25 bp, Mus musculus
gttcactcagaggcagccatggaac

SEQ ID NO: 960651 - DNA, 25 bp, Mus musculus
gttcactccaatgatggcactcaga

SEQ ID NO: 960652 - DNA, 25 bp, Mus musculus
gttcactccattgatggcactcaga

SEQ ID NO: 960653 - DNA, 25 bp, Mus musculus
gttcacttccttcactgtgtactgc

SEQ ID NO: 960654 - DNA, 25 bp, Mus musculus
gttcacttccttcagtgtgtactgc

SEQ ID NO: 960655 - DNA, 25 bp, Mus musculus
gttcacttgcagacgagcaaaagac

SEQ ID NO: 960656 - DNA, 25 bp, Mus musculus
gttcacttgcagctgttgtttgtgg

SEQ ID NO: 960657 - DNA, 25 bp, Mus musculus
gttcacttgcaggtgttgtttgtgg

SEQ ID NO: 960658 - DNA, 25 bp, Mus musculus
gttcacttgcagtcgagcaaaagac

SEQ ID NO: 960659 - DNA, 25 bp, Mus musculus
gttcagaaaatcttagtcttcagtt

SEQ ID NO: 960660 - DNA, 25 bp, Mus musculus
gttcagaaaatctttgtcttcagtt

SEQ ID NO: 960661 - DNA, 25 bp, Mus musculus
gttcagatgagcctcgcacagctgc

SEQ ID NO: 960662 - DNA, 25 bp, Mus musculus
gttcagatgagcctggcacagctgc

SEQ ID NO: 960663 - DNA, 25 bp, Mus musculus
gttcagcagccacctggcagccacc

SEQ ID NO: 960664 - DNA, 25 bp, Mus musculus
gttcagcagccagctggcagccacc

SEQ ID NO: 960665 - DNA, 25 bp, Mus musculus
gttcagccaggacggagcggacatg

SEQ ID NO: 960666 - DNA, 25 bp, Mus musculus
gttcagccaggagggagcggacatg

SEQ ID NO: 960667 - DNA, 25 bp, Mus musculus
gttcagccctgccgacgtgtgtccc

SEQ ID NO: 960668 - DNA, 25 bp, Mus musculus
gttcagccctgcggacgtgtgtccc

SEQ ID NO: 960669 - DNA, 25 bp, Mus musculus
gttcagcctactcggttccaggagt

SEQ ID NO: 960670 - DNA, 25 bp, Mus musculus
gttcagcctactgggttccaggagt

SEQ ID NO: 960671 - DNA, 25 bp, Mus musculus
gttcaggaagatcaagccaaagaac

SEQ ID NO: 960672 - DNA, 25 bp, Mus musculus
gttcaggaagatcaagccaaagaat

SEQ ID NO: 960673 - DNA, 25 bp, Mus musculus
gttcaggaagatcatgccaaagaac

SEQ ID NO: 960674 - DNA, 25 bp, Mus musculus
gttcaggaagatcatgccaaagaat

SEQ ID NO: 960675 - DNA, 25 bp, Mus musculus
gttcaggagaatgtcgacatcagca

SEQ ID NO: 960676 - DNA, 25 bp, Mus musculus
gttcaggagaatgtggacatcagca

SEQ ID NO: 960677 - DNA, 25 bp, Mus musculus
gttcaggatgtcgacgtacggtcag

SEQ ID NO: 960678 - DNA, 25 bp, Mus musculus
gttcaggatgtcgaggtacggtcag

SEQ ID NO: 960679 - DNA, 25 bp, Mus musculus
gttcaggcctttcacagacgaagag

SEQ ID NO: 960680 - DNA, 25 bp, Mus musculus
gttcaggcctttcagagacgaagag

SEQ ID NO: 960681 - DNA, 25 bp, Mus musculus
gttcagtactcacctagttacagcc

SEQ ID NO: 960682 - DNA, 25 bp, Mus musculus
gttcagtactcagctagttacagcc

SEQ ID NO: 960683 - DNA, 25 bp, Mus musculus
gttcagtcagatcatgactcaggca

SEQ ID NO: 960684 - DNA, 25 bp, Mus musculus
gttcagtcagatgatgactcaggca

SEQ ID NO: 960685 - DNA, 25 bp, Mus musculus
gttcagtgcgcacgctgatgcagac

SEQ ID NO: 960686 - DNA, 25 bp, Mus musculus
gttcagtgcgcaggctgatgcagac

SEQ ID NO: 960687 - DNA, 25 bp, Mus musculus
gttcatcaaagcagcaattggttgt

SEQ ID NO: 960688 - DNA, 25 bp, Mus musculus
gttcatcaaagctgcaattggttgt

SEQ ID NO: 960689 - DNA, 25 bp, Mus musculus
gttcatcaagcagattggatacact

SEQ ID NO: 960690 - DNA, 25 bp, Mus musculus
gttcatcaaggagattggatacact

SEQ ID NO: 960691 - DNA, 25 bp, Mus musculus
gttcatcacgactgtgcaacagcgt

SEQ ID NO: 960692 - DNA, 25 bp, Mus musculus
gttcatcacgtctgtgcaacagcgt

SEQ ID NO: 960693 - DNA, 25 bp, Mus musculus
gttcatccgacacaagcgccgtggg

SEQ ID NO: 960694 - DNA, 25 bp, Mus musculus
gttcatccgacagaagcgccgtggg

SEQ ID NO: 960695 - DNA, 25 bp, Mus musculus
gttcatccggaaaatgacccgctca

SEQ ID NO: 960696 - DNA, 25 bp, Mus musculus
gttcatccggtaaatgacccgctca

SEQ ID NO: 960697 - DNA, 25 bp, Mus musculus
gttcatcctgactatgcggcgcagg

SEQ ID NO: 960698 - DNA, 25 bp, Mus musculus
gttcatcctgccagagactatgcgg

SEQ ID NO: 960699 - DNA, 25 bp, Mus musculus
gttcatcctggcagagactatgcgg

SEQ ID NO: 960700 - DNA, 25 bp, Mus musculus
gttcatcctgtctatgcggcgcagg

SEQ ID NO: 960701 - DNA, 25 bp, Mus musculus
gttcatcgagcacctgaagaagtac

SEQ ID NO: 960702 - DNA, 25 bp, Mus musculus
gttcatcgaggacctgaagaagtac

SEQ ID NO: 960703 - DNA, 25 bp, Mus musculus
gttcatctgtttcaaatcccagaaa

SEQ ID NO: 960704 - DNA, 25 bp, Mus musculus
gttcatctgtttcaagaagatctgc

SEQ ID NO: 960705 - DNA, 25 bp, Mus musculus
gttcatctgtttcatatcccagaaa

SEQ ID NO: 960706 - DNA, 25 bp, Mus musculus
gttcatctgtttcatgaagatctgc

SEQ ID NO: 960707 - DNA, 25 bp, Mus musculus
gttcatgaagcaagcgggtgcagct

SEQ ID NO: 960708 - DNA, 25 bp, Mus musculus
gttcatgaagcaggatttcgatgtg

SEQ ID NO: 960709 - DNA, 25 bp, Mus musculus
gttcatgaaggaagcgggtgcagct

SEQ ID NO: 960710 - DNA, 25 bp, Mus musculus
gttcatgaaggaggatttcgatgtg

SEQ ID NO: 960711 - DNA, 25 bp, Mus musculus
gttcatgacaagagggccaatccga

SEQ ID NO: 960712 - DNA, 25 bp, Mus musculus
gttcatgacaagtgggccaatccga

SEQ ID NO: 960713 - DNA, 25 bp, Mus musculus
gttcatgcaagaacctatggagatc

SEQ ID NO: 960714 - DNA, 25 bp, Mus musculus
gttcatgcaagatcctatggagatc

SEQ ID NO: 960715 - DNA, 25 bp, Mus musculus
gttcatgcacaacatgccacgcctg

SEQ ID NO: 960716 - DNA, 25 bp, Mus musculus
gttcatgcacaagatgccacgcctg

SEQ ID NO: 960717 - DNA, 25 bp, Mus musculus
gttcatggagcacgttcatcgaggc

SEQ ID NO: 960718 - DNA, 25 bp, Mus musculus
gttcatggagcaggttcatcgaggc

SEQ ID NO: 960719 - DNA, 25 bp, Mus musculus
gttcattcgaattgcgcggcggcca

SEQ ID NO: 960720 - DNA, 25 bp, Mus musculus
gttcattcgaattgggcggcggcca

SEQ ID NO: 960721 - DNA, 25 bp, Mus musculus
gttcattttgaaacacgagaagccc

SEQ ID NO: 960722 - DNA, 25 bp, Mus musculus
gttcattttgaatcacgagaagccc

SEQ ID NO: 960723 - DNA, 25 bp, Mus musculus
gttccaacgaaactgttcaatgtgg

SEQ ID NO: 960724 - DNA, 25 bp, Mus musculus
gttccaacgaaagtgttcaatgtgg

SEQ ID NO: 960725 - DNA, 25 bp, Mus musculus
gttccaactgtctaaattgatcagg

SEQ ID NO: 960726 - DNA, 25 bp, Mus musculus
gttccaactgtctatattgatcagg

SEQ ID NO: 960727 - DNA, 25 bp, Mus musculus
gttccaagaaagctgcttacagaca

SEQ ID NO: 960728 - DNA, 25 bp, Mus musculus
gttccaagaaaggtgcttacagaca

SEQ ID NO: 960729 - DNA, 25 bp, Mus musculus
gttccaagatgtctacttagtgatg

SEQ ID NO: 960730 - DNA, 25 bp, Mus musculus
gttccaagatgtgtacttagtgatg

SEQ ID NO: 960731 - DNA, 25 bp, Mus musculus
gttccacgcctgattctggcaggtg

SEQ ID NO: 960732 - DNA, 25 bp, Mus musculus
gttccacgcctgtttctggcaggtg

SEQ ID NO: 960733 - DNA, 25 bp, Mus musculus
gttccagaaagtcatcacagaatac

SEQ ID NO: 960734 - DNA, 25 bp, Mus musculus
gttccagaaagtgatcacagaatac

SEQ ID NO: 960735 - DNA, 25 bp, Mus musculus
gttccagaagtgatccagactctca

SEQ ID NO: 960736 - DNA, 25 bp, Mus musculus
gttccagaagtgttccagactctca

SEQ ID NO: 960737 - DNA, 25 bp, Mus musculus
gttccagaccaacgtgcacaggaag

SEQ ID NO: 960738 - DNA, 25 bp, Mus musculus
gttccagaccaaggtgcacaggaag

SEQ ID NO: 960739 - DNA, 25 bp, Mus musculus
gttccagaggagctactacaagcct

SEQ ID NO: 960740 - DNA, 25 bp, Mus musculus
gttccagaggaggtactacaagcct

SEQ ID NO: 960741 - DNA, 25 bp, Mus musculus
gttccagaggcatctaaagagtaat

SEQ ID NO: 960742 - DNA, 25 bp, Mus musculus
gttccagagggatctaaagagtaat

SEQ ID NO: 960743 - DNA, 25 bp, Mus musculus
gttccagcgcagctttgaaccagaa

SEQ ID NO: 960744 - DNA, 25 bp, Mus musculus
gttccagcgcaggtttgaaccagaa

SEQ ID NO: 960745 - DNA, 25 bp, Mus musculus
gttccagtagcctactggtgacagg

SEQ ID NO: 960746 - DNA, 25 bp, Mus musculus
gttccagtagcctagtggtgacagg

SEQ ID NO: 960747 - DNA, 25 bp, Mus musculus
gttccataagcgtcctgtgatcaag

SEQ ID NO: 960748 - DNA, 25 bp, Mus musculus
gttccataagggtcctgtgatcaag

SEQ ID NO: 960749 - DNA, 25 bp, Mus musculus
gttccataagtttgcatgatttacc

SEQ ID NO: 960750 - DNA, 25 bp, Mus musculus
gttccataagtttggatgatttacc

SEQ ID NO: 960751 - DNA, 25 bp, Mus musculus
gttccattacaacaccgaccagggc

SEQ ID NO: 960752 - DNA, 25 bp, Mus musculus
gttccattacaagaccgaccagggc

SEQ ID NO: 960753 - DNA, 25 bp, Mus musculus
gttcccaagaagcattcatttctgc

SEQ ID NO: 960754 - DNA, 25 bp, Mus musculus
gttcccaagaaggattcatttctgc

SEQ ID NO: 960755 - DNA, 25 bp, Mus musculus
gttcccaatgatcgcagcaagatca

SEQ ID NO: 960756 - DNA, 25 bp, Mus musculus
gttcccaatgatctgattggctgtg

SEQ ID NO: 960757 - DNA, 25 bp, Mus musculus
gttcccaatgatggcagcaagatca

SEQ ID NO: 960758 - DNA, 25 bp, Mus musculus
gttcccaatgatgtgattggctgtg

SEQ ID NO: 960759 - DNA, 25 bp, Mus musculus
gttcccactgggcctgaagtggagg

SEQ ID NO: 960760 - DNA, 25 bp, Mus musculus
gttcccactggggctgaagtggagg

SEQ ID NO: 960761 - DNA, 25 bp, Mus musculus
gttcccagatcccgctcacgctaac

SEQ ID NO: 960762 - DNA, 25 bp, Mus musculus
gttcccagatccggctcacgctaac

SEQ ID NO: 960763 - DNA, 25 bp, Mus musculus
gttcccatgttgatgctggttgttg

SEQ ID NO: 960764 - DNA, 25 bp, Mus musculus
gttcccatgttgttgctggttgttg

SEQ ID NO: 960765 - DNA, 25 bp, Mus musculus
gttcccgctgagacgtaggcaattt

SEQ ID NO: 960766 - DNA, 25 bp, Mus musculus
gttcccgctgagctcccgccatcct

SEQ ID NO: 960767 - DNA, 25 bp, Mus musculus
gttcccgctgaggtcccgccatcct

SEQ ID NO: 960768 - DNA, 25 bp, Mus musculus
gttcccgctgagtcgtaggcaattt

SEQ ID NO: 960769 - DNA, 25 bp, Mus musculus
gttcccggaagacgctcccagatgg

SEQ ID NO: 960770 - DNA, 25 bp, Mus musculus
gttcccggaagaggctcccagatgg

SEQ ID NO: 960771 - DNA, 25 bp, Mus musculus
gttccctagaagatgtgctgccccc

SEQ ID NO: 960772 - DNA, 25 bp, Mus musculus
gttccctagaagttgtgctgccccc

SEQ ID NO: 960773 - DNA, 25 bp, Mus musculus
gttccctgatcacaaagcagaccca

SEQ ID NO: 960774 - DNA, 25 bp, Mus musculus
gttccctgatcacatagcagaccca

SEQ ID NO: 960775 - DNA, 25 bp, Mus musculus
gttccctgggcacgtttcagtcgtt

SEQ ID NO: 960776 - DNA, 25 bp, Mus musculus
gttccctgggcaggtttcagtcgtt

SEQ ID NO: 960777 - DNA, 25 bp, Mus musculus
gttccgaaagaactggaataagtgg

SEQ ID NO: 960778 - DNA, 25 bp, Mus musculus
gttccgaaagaagtggaataagtgg

SEQ ID NO: 960779 - DNA, 25 bp, Mus musculus
gttccgagaaagctgataattgatg

SEQ ID NO: 960780 - DNA, 25 bp, Mus musculus
gttccgagaaaggtgataattgatg

SEQ ID NO: 960781 - DNA, 25 bp, Mus musculus
gttccgagaccacacccctgagcag

SEQ ID NO: 960782 - DNA, 25 bp, Mus musculus
gttccgagaccagacccctgagcag

SEQ ID NO: 960783 - DNA, 25 bp, Mus musculus
gttccggaagctgcagcttcaacca

SEQ ID NO: 960784 - DNA, 25 bp, Mus musculus
gttccggaaggtgcagcttcaacca

SEQ ID NO: 960785 - DNA, 25 bp, Mus musculus
gttccgtcagctatctacagaagaa

SEQ ID NO: 960786 - DNA, 25 bp, Mus musculus
gttccgtcaggtatctacagaagaa

SEQ ID NO: 960787 - DNA, 25 bp, Mus musculus
gttccgtcggaaccctctcttctgt

SEQ ID NO: 960788 - DNA, 25 bp, Mus musculus
gttccgtcggaagcctctcttctgt

SEQ ID NO: 960789 - DNA, 25 bp, Mus musculus
gttcctaaggcgcattctccactgc

SEQ ID NO: 960790 - DNA, 25 bp, Mus musculus
gttcctaaggcggattctccactgc

SEQ ID NO: 960791 - DNA, 25 bp, Mus musculus
gttcctacacaaaaagctgttcagc

SEQ ID NO: 960792 - DNA, 25 bp, Mus musculus
gttcctacacaaaatgctgttcagc

SEQ ID NO: 960793 - DNA, 25 bp, Mus musculus
gttcctacagcgctagagcagctgg

SEQ ID NO: 960794 - DNA, 25 bp, Mus musculus
gttcctacagggctagagcagctgg

SEQ ID NO: 960795 - DNA, 25 bp, Mus musculus
gttcctacattgatttgtctgtgat

SEQ ID NO: 960796 - DNA, 25 bp, Mus musculus
gttcctacattgttttgtctgtgat

SEQ ID NO: 960797 - DNA, 25 bp, Mus musculus
gttcctagagaggcaacctttctgg

SEQ ID NO: 960798 - DNA, 25 bp, Mus musculus
gttcctagagtggcaacctttctgg

SEQ ID NO: 960799 - DNA, 25 bp, Mus musculus
gttcctagcccacacccctctaggg

SEQ ID NO: 960800 - DNA, 25 bp, Mus musculus
gttcctagcccacagccctctaggg

SEQ ID NO: 960801 - DNA, 25 bp, Mus musculus
gttcctagctgtcccaccaaggagc

SEQ ID NO: 960802 - DNA, 25 bp, Mus musculus
gttcctagctgtgccaccaaggagc

SEQ ID NO: 960803 - DNA, 25 bp, Mus musculus
gttcctataatgcgcgcagagacct

SEQ ID NO: 960804 - DNA, 25 bp, Mus musculus
gttcctataatgggcgcagagacct

SEQ ID NO: 960805 - DNA, 25 bp, Mus musculus
gttcctcaagatggccgactctgga

SEQ ID NO: 960806 - DNA, 25 bp, Mus musculus
gttcctcaagttggccgactctgga

SEQ ID NO: 960807 - DNA, 25 bp, Mus musculus
gttcctcaatcccaatggaagcagt

SEQ ID NO: 960808 - DNA, 25 bp, Mus musculus
gttcctcaatgccaatggaagcagt

SEQ ID NO: 960809 - DNA, 25 bp, Mus musculus
gttcctcccgaacgcgctcaaggtc

SEQ ID NO: 960810 - DNA, 25 bp, Mus musculus
gttcctcccgaaggcgctcaaggtc

SEQ ID NO: 960811 - DNA, 25 bp, Mus musculus
gttcctctgtcacatgatgatcatt

SEQ ID NO: 960812 - DNA, 25 bp, Mus musculus
gttcctctgtcagatgatgatcatt

SEQ ID NO: 960813 - DNA, 25 bp, Mus musculus
gttcctgatgatgatgaaccagctg

SEQ ID NO: 960814 - DNA, 25 bp, Mus musculus
gttcctgatgcaaaaccaactctac

SEQ ID NO: 960815 - DNA, 25 bp, Mus musculus
gttcctgatggaaaaccaactctac

SEQ ID NO: 960816 - DNA, 25 bp, Mus musculus
gttcctgatgttgatgaaccagctg

SEQ ID NO: 960817 - DNA, 25 bp, Mus musculus
gttcctgcagcacagtgttgaatac

SEQ ID NO: 960818 - DNA, 25 bp, Mus musculus
gttcctgcaggacagtgttgaatac

SEQ ID NO: 960819 - DNA, 25 bp, Mus musculus
gttcctgcattacgggaaagctggg

SEQ ID NO: 960820 - DNA, 25 bp, Mus musculus
gttcctgcattaggggaaagctggg

SEQ ID NO: 960821 - DNA, 25 bp, Mus musculus
gttcctgccaatgtcagcaaaggca

SEQ ID NO: 960822 - DNA, 25 bp, Mus musculus
gttcctgccaatgtgagcaaaggca

SEQ ID NO: 960823 - DNA, 25 bp, Mus musculus
gttcctggagaggacggtctagaga

SEQ ID NO: 960824 - DNA, 25 bp, Mus musculus
gttcctggagaggagggtctagaga

SEQ ID NO: 960825 - DNA, 25 bp, Mus musculus
gttcctggagcgatcaatgtgacca

SEQ ID NO: 960826 - DNA, 25 bp, Mus musculus
gttcctggagggatcaatgtgacca

SEQ ID NO: 960827 - DNA, 25 bp, Mus musculus
gttcctggcgctatatgtgcaggcc

SEQ ID NO: 960828 - DNA, 25 bp, Mus musculus
gttcctggcggtatatgtgcaggcc

SEQ ID NO: 960829 - DNA, 25 bp, Mus musculus
gttcctgtagccaacaccacatcct

SEQ ID NO: 960830 - DNA, 25 bp, Mus musculus
gttcctgtagccaacgtcagattac

SEQ ID NO: 960831 - DNA, 25 bp, Mus musculus
gttcctgtagccaagaccacatcct

SEQ ID NO: 960832 - DNA, 25 bp, Mus musculus
gttcctgtagccaaggtcagattac

SEQ ID NO: 960833 - DNA, 25 bp, Mus musculus
gttcctgtgcagaacgcaaggcctg

SEQ ID NO: 960834 - DNA, 25 bp, Mus musculus
gttcctgtgcagaaggcaaggcctg

SEQ ID NO: 960835 - DNA, 25 bp, Mus musculus
gttcctgtgcagatctgtggccctg

SEQ ID NO: 960836 - DNA, 25 bp, Mus musculus
gttcctgtgcagttctgtggccctg

SEQ ID NO: 960837 - DNA, 25 bp, Mus musculus
gttccttgatgccacacggaaaagg

SEQ ID NO: 960838 - DNA, 25 bp, Mus musculus
gttccttgatgccagacggaaaagg

SEQ ID NO: 960839 - DNA, 25 bp, Mus musculus
gttccttggctatccgtttggtgtt

SEQ ID NO: 960840 - DNA, 25 bp, Mus musculus
gttccttggctatcggtttggtgtt

SEQ ID NO: 960841 - DNA, 25 bp, Mus musculus
gttcgaaaccaacaatcttgtggaa

SEQ ID NO: 960842 - DNA, 25 bp, Mus musculus
gttcgaaaccaagaatcttgtggaa

SEQ ID NO: 960843 - DNA, 25 bp, Mus musculus
gttcgaataccgccatgtcatgttg

SEQ ID NO: 960844 - DNA, 25 bp, Mus musculus
gttcgaataccggcatgtcatgttg

SEQ ID NO: 960845 - DNA, 25 bp, Mus musculus
gttcgacagaatttttggacaagca

SEQ ID NO: 960846 - DNA, 25 bp, Mus musculus
gttcgacagattttttggacaagca

SEQ ID NO: 960847 - DNA, 25 bp, Mus musculus
gttcgaggacagctgtccttttatc

SEQ ID NO: 960848 - DNA, 25 bp, Mus musculus
gttcgaggacaggtgtccttttatc

SEQ ID NO: 960849 - DNA, 25 bp, Mus musculus
gttcgaggaccacatggcttcacac

SEQ ID NO: 960850 - DNA, 25 bp, Mus musculus
gttcgaggaccagatggcttcacac

SEQ ID NO: 960851 - DNA, 25 bp, Mus musculus
gttcgaggctaatgaggaagcatta

SEQ ID NO: 960852 - DNA, 25 bp, Mus musculus
gttcgaggctaatgaggtttctggc

SEQ ID NO: 960853 - DNA, 25 bp, Mus musculus
gttcgaggctaatgtggaagcatta

SEQ ID NO: 960854 - DNA, 25 bp, Mus musculus
gttcgaggctaatgtggtttctggc

SEQ ID NO: 960855 - DNA, 25 bp, Mus musculus
gttcgccaccaacgatgctgtggct

SEQ ID NO: 960856 - DNA, 25 bp, Mus musculus
gttcgccaccaaggatgctgtggct

SEQ ID NO: 960857 - DNA, 25 bp, Mus musculus
gttcgccagcaacatctccagcacc

SEQ ID NO: 960858 - DNA, 25 bp, Mus musculus
gttcgccagcaagatctccagcacc

SEQ ID NO: 960859 - DNA, 25 bp, Mus musculus
gttcgcgaagaatcgagatccgaga

SEQ ID NO: 960860 - DNA, 25 bp, Mus musculus
gttcgcgaagagcgtccccacgcgg

SEQ ID NO: 960861 - DNA, 25 bp, Mus musculus
gttcgcgaagtatcgagatccgaga

SEQ ID NO: 960862 - DNA, 25 bp, Mus musculus
gttcgcgaagtgcgtccccacgcgg

SEQ ID NO: 960863 - DNA, 25 bp, Mus musculus
gttcgcgagaacagttcaagggcag

SEQ ID NO: 960864 - DNA, 25 bp, Mus musculus
gttcgcgagaactgttcaagggcag

SEQ ID NO: 960865 - DNA, 25 bp, Mus musculus
gttcgctgttgtcatgagcaatgtg

SEQ ID NO: 960866 - DNA, 25 bp, Mus musculus
gttcgctgttgtgatgagcaatgtg

SEQ ID NO: 960867 - DNA, 25 bp, Mus musculus
gttcggattaagatccttgccactg

SEQ ID NO: 960868 - DNA, 25 bp, Mus musculus
gttcggattaagttccttgccactg

SEQ ID NO: 960869 - DNA, 25 bp, Mus musculus
gttcggccagagcattactcactgt

SEQ ID NO: 960870 - DNA, 25 bp, Mus musculus
gttcggccagaggattactcactgt

SEQ ID NO: 960871 - DNA, 25 bp, Mus musculus
gttcgggcggcccacggcggcacct

SEQ ID NO: 960872 - DNA, 25 bp, Mus musculus
gttcgggcggcccagggcggcacct

SEQ ID NO: 960873 - DNA, 25 bp, Mus musculus
gttcgggtttagcctgccatatgtt

SEQ ID NO: 960874 - DNA, 25 bp, Mus musculus
gttcgggtttaggctgccatatgtt

SEQ ID NO: 960875 - DNA, 25 bp, Mus musculus
gttcggtgcagacccaccatgccaa

SEQ ID NO: 960876 - DNA, 25 bp, Mus musculus
gttcggtgcagagccaccatgccaa

SEQ ID NO: 960877 - DNA, 25 bp, Mus musculus
gttcgtacagcctttgaaatatgaa

SEQ ID NO: 960878 - DNA, 25 bp, Mus musculus
gttcgtacaggctttgaaatatgaa

SEQ ID NO: 960879 - DNA, 25 bp, Mus musculus
gttcgtcaaaagactggcaatggac

SEQ ID NO: 960880 - DNA, 25 bp, Mus musculus
gttcgtcaaatgactggcaatggac

SEQ ID NO: 960881 - DNA, 25 bp, Mus musculus
gttcgtcgtcgtcccctccagaaat

SEQ ID NO: 960882 - DNA, 25 bp, Mus musculus
gttcgtcgtcgtccgctccagaaat

SEQ ID NO: 960883 - DNA, 25 bp, Mus musculus
gttcgtgatttccactccctgcagg

SEQ ID NO: 960884 - DNA, 25 bp, Mus musculus
gttcgtgatttccagtccctgcagg

SEQ ID NO: 960885 - DNA, 25 bp, Mus musculus
gttcgtggagctggagcctactacc

SEQ ID NO: 960886 - DNA, 25 bp, Mus musculus
gttcgtggaggtggagcctactacc

SEQ ID NO: 960887 - DNA, 25 bp, Mus musculus
gttcgttgccaacgtcatgcaggtt

SEQ ID NO: 960888 - DNA, 25 bp, Mus musculus
gttcgttgccaaggtcatgcaggtt

SEQ ID NO: 960889 - DNA, 25 bp, Mus musculus
gttctacacatgatagaagatggag

SEQ ID NO: 960890 - DNA, 25 bp, Mus musculus
gttctacacatgttagaagatggag

SEQ ID NO: 960891 - DNA, 25 bp, Mus musculus
gttctacagaagaccattgactaca

SEQ ID NO: 960892 - DNA, 25 bp, Mus musculus
gttctacagaagtccattgactaca

SEQ ID NO: 960893 - DNA, 25 bp, Mus musculus
gttctaccactgcaccctctccttc

SEQ ID NO: 960894 - DNA, 25 bp, Mus musculus
gttctaccactggaccctctccttc

SEQ ID NO: 960895 - DNA, 25 bp, Mus musculus
gttctaccggcactggtggaactcg

SEQ ID NO: 960896 - DNA, 25 bp, Mus musculus
gttctaccgggactggtggaactcg

SEQ ID NO: 960897 - DNA, 25 bp, Mus musculus
gttctacctgaacgatctgaaaaca

SEQ ID NO: 960898 - DNA, 25 bp, Mus musculus
gttctacctgaaggatctgaaaaca

SEQ ID NO: 960899 - DNA, 25 bp, Mus musculus
gttctagtcacacggaaccacacag

SEQ ID NO: 960900 - DNA, 25 bp, Mus musculus
gttctagtcacagggaaccacacag

SEQ ID NO: 960901 - DNA, 25 bp, Mus musculus
gttctatatgcgccaaacagggcct

SEQ ID NO: 960902 - DNA, 25 bp, Mus musculus
gttctatatgcggcaaacagggcct

SEQ ID NO: 960903 - DNA, 25 bp, Mus musculus
gttctatcagcactggcagctgaaa

SEQ ID NO: 960904 - DNA, 25 bp, Mus musculus
gttctatcagcagtggcagctgaaa

SEQ ID NO: 960905 - DNA, 25 bp, Mus musculus
gttctatgagtccgtttatggccag

SEQ ID NO: 960906 - DNA, 25 bp, Mus musculus
gttctatgagtcggtttatggccag

SEQ ID NO: 960907 - DNA, 25 bp, Mus musculus
gttctattggtgcaatccatgaaga

SEQ ID NO: 960908 - DNA, 25 bp, Mus musculus
gttctattggtggaatccatgaaga

SEQ ID NO: 960909 - DNA, 25 bp, Mus musculus
gttctcaacccaatcagtattttca

SEQ ID NO: 960910 - DNA, 25 bp, Mus musculus
gttctcaacccattcagtattttca

SEQ ID NO: 960911 - DNA, 25 bp, Mus musculus
gttctcacaaggcataagcgtcttg

SEQ ID NO: 960912 - DNA, 25 bp, Mus musculus
gttctcacaagggataagcgtcttg

SEQ ID NO: 960913 - DNA, 25 bp, Mus musculus
gttctcacctttcgtattgtcctgc

SEQ ID NO: 960914 - DNA, 25 bp, Mus musculus
gttctcacctttggtattgtcctgc

SEQ ID NO: 960915 - DNA, 25 bp, Mus musculus
gttctcagggaaaaccacagagctg

SEQ ID NO: 960916 - DNA, 25 bp, Mus musculus
gttctcagggaaaacgaacaccatg

SEQ ID NO: 960917 - DNA, 25 bp, Mus musculus
gttctcagggaaaagcacagagctg

SEQ ID NO: 960918 - DNA, 25 bp, Mus musculus
gttctcagggaaaaggaacaccatg

SEQ ID NO: 960919 - DNA, 25 bp, Mus musculus
gttctcatgcagccctatcgctgga

SEQ ID NO: 960920 - DNA, 25 bp, Mus musculus
gttctcatgcaggcctatcgctgga

SEQ ID NO: 960921 - DNA, 25 bp, Mus musculus
gttctcccagatgattggcatgctg

SEQ ID NO: 960922 - DNA, 25 bp, Mus musculus
gttctcccagcttgttcctcaaagt

SEQ ID NO: 960923 - DNA, 25 bp, Mus musculus
gttctcccaggttgttcctcaaagt

SEQ ID NO: 960924 - DNA, 25 bp, Mus musculus
gttctcccagttgattggcatgctg

SEQ ID NO: 960925 - DNA, 25 bp, Mus musculus
gttctccctacccacccacttgaac

SEQ ID NO: 960926 - DNA, 25 bp, Mus musculus
gttctccctacccagccacttgaac

SEQ ID NO: 960927 - DNA, 25 bp, Mus musculus
gttctcctccacagcatatgggagc

SEQ ID NO: 960928 - DNA, 25 bp, Mus musculus
gttctcctccacaggatatgggagc

SEQ ID NO: 960929 - DNA, 25 bp, Mus musculus
gttctcctgccacggcccctttgac

SEQ ID NO: 960930 - DNA, 25 bp, Mus musculus
gttctcctgccagggcccctttgac

SEQ ID NO: 960931 - DNA, 25 bp, Mus musculus
gttctcctggcacaactgaagcaag

SEQ ID NO: 960932 - DNA, 25 bp, Mus musculus
gttctcctggcagaactgaagcaag

SEQ ID NO: 960933 - DNA, 25 bp, Mus musculus
gttctcgggcaacgacttagcattc

SEQ ID NO: 960934 - DNA, 25 bp, Mus musculus
gttctcgggcaaggacttagcattc

SEQ ID NO: 960935 - DNA, 25 bp, Mus musculus
gttctctctaaacctttgacatgga

SEQ ID NO: 960936 - DNA, 25 bp, Mus musculus
gttctctctatacctttgacatgga

SEQ ID NO: 960937 - DNA, 25 bp, Mus musculus
gttctctgagccgcagtaacagcat

SEQ ID NO: 960938 - DNA, 25 bp, Mus musculus
gttctctgaggcgcagtaacagcat

SEQ ID NO: 960939 - DNA, 25 bp, Mus musculus
gttctctgccgccacgtcctcagat

SEQ ID NO: 960940 - DNA, 25 bp, Mus musculus
gttctctgccgccaggtcctcagat

SEQ ID NO: 960941 - DNA, 25 bp, Mus musculus
gttctctgtaagatctccctgttca

SEQ ID NO: 960942 - DNA, 25 bp, Mus musculus
gttctctgtaagttctccctgttca

SEQ ID NO: 960943 - DNA, 25 bp, Mus musculus
gttctctgtgagatcattgggcagg

SEQ ID NO: 960944 - DNA, 25 bp, Mus musculus
gttctctgtgagttcattgggcagg

SEQ ID NO: 960945 - DNA, 25 bp, Mus musculus
gttctctgttcaccccttcccacaa

SEQ ID NO: 960946 - DNA, 25 bp, Mus musculus
gttctctgttcacgatatgcagtac

SEQ ID NO: 960947 - DNA, 25 bp, Mus musculus
gttctctgttcagcccttcccacaa

SEQ ID NO: 960948 - DNA, 25 bp, Mus musculus
gttctctgttcaggatatgcagtac

SEQ ID NO: 960949 - DNA, 25 bp, Mus musculus
gttctctgtttgagagatgagccgg

SEQ ID NO: 960950 - DNA, 25 bp, Mus musculus
gttctctgtttgagtgatgagccgg

SEQ ID NO: 960951 - DNA, 25 bp, Mus musculus
gttctgaaagtgagccccgattcat

SEQ ID NO: 960952 - DNA, 25 bp, Mus musculus
gttctgaaagtgtgccccgattcat

SEQ ID NO: 960953 - DNA, 25 bp, Mus musculus
gttctgaagctgctcactttaacca

SEQ ID NO: 960954 - DNA, 25 bp, Mus musculus
gttctgaagctggtcactttaacca

SEQ ID NO: 960955 - DNA, 25 bp, Mus musculus
gttctgaatctagacggtgagaaag

SEQ ID NO: 960956 - DNA, 25 bp, Mus musculus
gttctgaatctagagggtgagaaag

SEQ ID NO: 960957 - DNA, 25 bp, Mus musculus
gttctgacagctcgatcactgatgg

SEQ ID NO: 960958 - DNA, 25 bp, Mus musculus
gttctgacagctggatcactgatgg

SEQ ID NO: 960959 - DNA, 25 bp, Mus musculus
gttctgactgcgacatttacattgt

SEQ ID NO: 960960 - DNA, 25 bp, Mus musculus
gttctgactgcgcttgaaatgggca

SEQ ID NO: 960961 - DNA, 25 bp, Mus musculus
gttctgactgcggttgaaatgggca

SEQ ID NO: 960962 - DNA, 25 bp, Mus musculus
gttctgactgcgtcatttacattgt

SEQ ID NO: 960963 - DNA, 25 bp, Mus musculus
gttctgagctggcttgctgcccatt

SEQ ID NO: 960964 - DNA, 25 bp, Mus musculus
gttctgagctgggttgctgcccatt

SEQ ID NO: 960965 - DNA, 25 bp, Mus musculus
gttctgatctggctttggacaaagt

SEQ ID NO: 960966 - DNA, 25 bp, Mus musculus
gttctgatctgggtttggacaaagt

SEQ ID NO: 960967 - DNA, 25 bp, Mus musculus
gttctgattgaaccctgctgcaaaa

SEQ ID NO: 960968 - DNA, 25 bp, Mus musculus
gttctgattgaagcctgctgcaaaa

SEQ ID NO: 960969 - DNA, 25 bp, Mus musculus
gttctgccagcgcctgtgagagaga

SEQ ID NO: 960970 - DNA, 25 bp, Mus musculus
gttctgccagggcctgtgagagaga

SEQ ID NO: 960971 - DNA, 25 bp, Mus musculus
gttctgccagtgagattttgacatt

SEQ ID NO: 960972 - DNA, 25 bp, Mus musculus
gttctgccagtgtgattttgacatt

SEQ ID NO: 960973 - DNA, 25 bp, Mus musculus
gttctggaagccctggaagagagac

SEQ ID NO: 960974 - DNA, 25 bp, Mus musculus
gttctggaaggcctggaagagagac

SEQ ID NO: 960975 - DNA, 25 bp, Mus musculus
gttctggataagcgtggtaaatctc

SEQ ID NO: 960976 - DNA, 25 bp, Mus musculus
gttctggataagggtggtaaatctc

SEQ ID NO: 960977 - DNA, 25 bp, Mus musculus
gttctggcacagcttgcgagttgta

SEQ ID NO: 960978 - DNA, 25 bp, Mus musculus
gttctggcacaggttgcgagttgta

SEQ ID NO: 960979 - DNA, 25 bp, Mus musculus
gttctgggaactctccaggctttgg

SEQ ID NO: 960980 - DNA, 25 bp, Mus musculus
gttctgggaagtctccaggctttgg

SEQ ID NO: 960981 - DNA, 25 bp, Mus musculus
gttctgggccttcacttttgatgag

SEQ ID NO: 960982 - DNA, 25 bp, Mus musculus
gttctgggccttcagttttgatgag

SEQ ID NO: 960983 - DNA, 25 bp, Mus musculus
gttctgtgtggacgtactacaagcc

SEQ ID NO: 960984 - DNA, 25 bp, Mus musculus
gttctgtgtggaggtactacaagcc

SEQ ID NO: 960985 - DNA, 25 bp, Mus musculus
gttctgttcccaagagaacccctga

SEQ ID NO: 960986 - DNA, 25 bp, Mus musculus
gttctgttcccaaggaatcattggt

SEQ ID NO: 960987 - DNA, 25 bp, Mus musculus
gttctgttcccatgagaacccctga

SEQ ID NO: 960988 - DNA, 25 bp, Mus musculus
gttctgttcccatggaatcattggt

SEQ ID NO: 960989 - DNA, 25 bp, Mus musculus
gttctgttgcaaccctacttctccc

SEQ ID NO: 960990 - DNA, 25 bp, Mus musculus
gttctgttgcaacgtgatctctgca

SEQ ID NO: 960991 - DNA, 25 bp, Mus musculus
gttctgttgcaagcctacttctccc

SEQ ID NO: 960992 - DNA, 25 bp, Mus musculus
gttctgttgcaaggtgatctctgca

SEQ ID NO: 960993 - DNA, 25 bp, Mus musculus
gttcttagctcacggaaccatggaa

SEQ ID NO: 960994 - DNA, 25 bp, Mus musculus
gttcttagctcagggaaccatggaa

SEQ ID NO: 960995 - DNA, 25 bp, Mus musculus
gttcttcaacaacgcattgtgaaat

SEQ ID NO: 960996 - DNA, 25 bp, Mus musculus
gttcttcaacaaggcattgtgaaat

SEQ ID NO: 960997 - DNA, 25 bp, Mus musculus
gttcttcagtaacactgaagagctg

SEQ ID NO: 960998 - DNA, 25 bp, Mus musculus
gttcttcagtaagactgaagagctg

SEQ ID NO: 960999 - DNA, 25 bp, Mus musculus
gttcttccacaacgaggtgtgtgag

SEQ ID NO: 961000 - DNA, 25 bp, Mus musculus
gttcttccacaaggaggtgtgtgag

SEQ ID NO: 961001 - DNA, 25 bp, Mus musculus
gttcttccagaagatggacaaaaat

SEQ ID NO: 961002 - DNA, 25 bp, Mus musculus
gttcttccagccaaggacccctgtc

SEQ ID NO: 961003 - DNA, 25 bp, Mus musculus
gttcttccaggcaaggacccctgtc

SEQ ID NO: 961004 - DNA, 25 bp, Mus musculus
gttcttccagtagatggacaaaaat

SEQ ID NO: 961005 - DNA, 25 bp, Mus musculus
gttcttcctacgcagatggctcgtg

SEQ ID NO: 961006 - DNA, 25 bp, Mus musculus
gttcttcctacggagatggctcgtg

SEQ ID NO: 961007 - DNA, 25 bp, Mus musculus
gttcttccttaaccatcatgggaaa

SEQ ID NO: 961008 - DNA, 25 bp, Mus musculus
gttcttccttaagcatcatgggaaa

SEQ ID NO: 961009 - DNA, 25 bp, Mus musculus
gttcttctccaccgtactacttgtc

SEQ ID NO: 961010 - DNA, 25 bp, Mus musculus
gttcttctccaccttctaccacgcc

SEQ ID NO: 961011 - DNA, 25 bp, Mus musculus
gttcttctccacggtactacttgtc

SEQ ID NO: 961012 - DNA, 25 bp, Mus musculus
gttcttctccacgttctaccacgcc

SEQ ID NO: 961013 - DNA, 25 bp, Mus musculus
gttcttgccgctaatatttgctatg

SEQ ID NO: 961014 - DNA, 25 bp, Mus musculus
gttcttgccggtaatatttgctatg

SEQ ID NO: 961015 - DNA, 25 bp, Mus musculus
gttcttgtttcacgaaatggctgca

SEQ ID NO: 961016 - DNA, 25 bp, Mus musculus
gttcttgtttcacgacttcctccat

SEQ ID NO: 961017 - DNA, 25 bp, Mus musculus
gttcttgtttcaggaaatggctgca

SEQ ID NO: 961018 - DNA, 25 bp, Mus musculus
gttcttgtttcaggacttcctccat

SEQ ID NO: 961019 - DNA, 25 bp, Mus musculus
gttctttagacacggtgacagagaa

SEQ ID NO: 961020 - DNA, 25 bp, Mus musculus
gttctttagacagggtgacagagaa

SEQ ID NO: 961021 - DNA, 25 bp, Mus musculus
gttgaaaagcagcccttcaaacaag

SEQ ID NO: 961022 - DNA, 25 bp, Mus musculus
gttgaaaagcaggccttcaaacaag

SEQ ID NO: 961023 - DNA, 25 bp, Mus musculus
gttgaaatggccttcaatgttgaca

SEQ ID NO: 961024 - DNA, 25 bp, Mus musculus
gttgaaatgggcttcaatgttgaca

SEQ ID NO: 961025 - DNA, 25 bp, Mus musculus
gttgaaatgttccactatgttaaag

SEQ ID NO: 961026 - DNA, 25 bp, Mus musculus
gttgaaatgttccagtatgttaaag

SEQ ID NO: 961027 - DNA, 25 bp, Mus musculus
gttgaagaaatgaacagagctaaag

SEQ ID NO: 961028 - DNA, 25 bp, Mus musculus
gttgaagaaatgaagagagctaaag

SEQ ID NO: 961029 - DNA, 25 bp, Mus musculus
gttgaagaattaaacgagattgatg

SEQ ID NO: 961030 - DNA, 25 bp, Mus musculus
gttgaagaattaaaggagattgatg

SEQ ID NO: 961031 - DNA, 25 bp, Mus musculus
gttgaagatcctggcggcagtgtat

SEQ ID NO: 961032 - DNA, 25 bp, Mus musculus
gttgaagatcctgggggcagtgtat

SEQ ID NO: 961033 - DNA, 25 bp, Mus musculus
gttgaaggcaaactatcctgtagag

SEQ ID NO: 961034 - DNA, 25 bp, Mus musculus
gttgaaggcaaagtatcctgtagag

SEQ ID NO: 961035 - DNA, 25 bp, Mus musculus
gttgaatctgagaattatatccaag

SEQ ID NO: 961036 - DNA, 25 bp, Mus musculus
gttgaatctgtgaattatatccaag

SEQ ID NO: 961037 - DNA, 25 bp, Mus musculus
gttgacagatttaacagtttgtttc

SEQ ID NO: 961038 - DNA, 25 bp, Mus musculus
gttgacagatttaaccttccttcca

SEQ ID NO: 961039 - DNA, 25 bp, Mus musculus
gttgacagatttaagagtttgtttc

SEQ ID NO: 961040 - DNA, 25 bp, Mus musculus
gttgacagatttaagcttccttcca

SEQ ID NO: 961041 - DNA, 25 bp, Mus musculus
gttgaccacactccttcggagtgcc

SEQ ID NO: 961042 - DNA, 25 bp, Mus musculus
gttgaccacactgcttcggagtgcc

SEQ ID NO: 961043 - DNA, 25 bp, Mus musculus
gttgaccagaagcacctggtgaatg

SEQ ID NO: 961044 - DNA, 25 bp, Mus musculus
gttgaccagaagcacggaaaaggct

SEQ ID NO: 961045 - DNA, 25 bp, Mus musculus
gttgaccagaagcagctggtgaatg

SEQ ID NO: 961046 - DNA, 25 bp, Mus musculus
gttgaccagaagcagggaaaaggct

SEQ ID NO: 961047 - DNA, 25 bp, Mus musculus
gttgaccatcagcggctctccggtc

SEQ ID NO: 961048 - DNA, 25 bp, Mus musculus
gttgaccatcaggggctctccggtc

SEQ ID NO: 961049 - DNA, 25 bp, Mus musculus
gttgacccagcccctgattttgttg

SEQ ID NO: 961050 - DNA, 25 bp, Mus musculus
gttgacccaggccctgattttgttg

SEQ ID NO: 961051 - DNA, 25 bp, Mus musculus
gttgacccttcgcttgatgttctta

SEQ ID NO: 961052 - DNA, 25 bp, Mus musculus
gttgacccttcggttgatgttctta

SEQ ID NO: 961053 - DNA, 25 bp, Mus musculus
gttgacccttgccatccttgcactt

SEQ ID NO: 961054 - DNA, 25 bp, Mus musculus
gttgacccttgcgatccttgcactt

SEQ ID NO: 961055 - DNA, 25 bp, Mus musculus
gttgaccgaaagcacagccatcttg

SEQ ID NO: 961056 - DNA, 25 bp, Mus musculus
gttgaccgaaaggacagccatcttg

SEQ ID NO: 961057 - DNA, 25 bp, Mus musculus
gttgactccttgaacctggctgtct

SEQ ID NO: 961058 - DNA, 25 bp, Mus musculus
gttgactccttgaagctggctgtct

SEQ ID NO: 961059 - DNA, 25 bp, Mus musculus
gttgagaaaaagattgaagacccac

SEQ ID NO: 961060 - DNA, 25 bp, Mus musculus
gttgagaaaaagtttgaagacccac

SEQ ID NO: 961061 - DNA, 25 bp, Mus musculus
gttgagaccattaacgatctaatgc

SEQ ID NO: 961062 - DNA, 25 bp, Mus musculus
gttgagaccattaaggatctaatgc

SEQ ID NO: 961063 - DNA, 25 bp, Mus musculus
gttgagacccagctactaaatcaaa

SEQ ID NO: 961064 - DNA, 25 bp, Mus musculus
gttgagacccaggtactaaatcaaa

SEQ ID NO: 961065 - DNA, 25 bp, Mus musculus
gttgagaggataaaagatgaagaag

SEQ ID NO: 961066 - DNA, 25 bp, Mus musculus
gttgagaggataaatgatgaagaag

SEQ ID NO: 961067 - DNA, 25 bp, Mus musculus
gttgaggaagatgacaaaattccag

SEQ ID NO: 961068 - DNA, 25 bp, Mus musculus
gttgaggaagatgagaaaattccag

SEQ ID NO: 961069 - DNA, 25 bp, Mus musculus
gttgaggagcctttcagcgagagtg

SEQ ID NO: 961070 - DNA, 25 bp, Mus musculus
gttgaggagcgtttcagcgagagtg

SEQ ID NO: 961071 - DNA, 25 bp, Mus musculus
gttgaggaggaacgccaggtgcccc

SEQ ID NO: 961072 - DNA, 25 bp, Mus musculus
gttgaggaggaaggccaggtgcccc

SEQ ID NO: 961073 - DNA, 25 bp, Mus musculus
gttgatccgagacgagtatgaggag

SEQ ID NO: 961074 - DNA, 25 bp, Mus musculus
gttgatccgagaggagtatgaggag

SEQ ID NO: 961075 - DNA, 25 bp, Mus musculus
gttgatctgatactttatctgcgaa

SEQ ID NO: 961076 - DNA, 25 bp, Mus musculus
gttgatctgatagtttatctgcgaa

SEQ ID NO: 961077 - DNA, 25 bp, Mus musculus
gttgatctgtcacaagctccagttt

SEQ ID NO: 961078 - DNA, 25 bp, Mus musculus
gttgatctgtcacaggaagaagctc

SEQ ID NO: 961079 - DNA, 25 bp, Mus musculus
gttgatctgtcacgaagaagctcca

SEQ ID NO: 961080 - DNA, 25 bp, Mus musculus
gttgatctgtcagaagctccagttt

SEQ ID NO: 961081 - DNA, 25 bp, Mus musculus
gttgatctgtcagaggaagaagctc

SEQ ID NO: 961082 - DNA, 25 bp, Mus musculus
gttgatctgtcaggaagaagctcca

SEQ ID NO: 961083 - DNA, 25 bp, Mus musculus
gttgatcttgcacattctacgcatc

SEQ ID NO: 961084 - DNA, 25 bp, Mus musculus
gttgatcttgcagattctacgcatc

SEQ ID NO: 961085 - DNA, 25 bp, Mus musculus
gttgatgcagcccgtggctcttggc

SEQ ID NO: 961086 - DNA, 25 bp, Mus musculus
gttgatgcaggccgtggctcttggc

SEQ ID NO: 961087 - DNA, 25 bp, Mus musculus
gttgatgcgttgcaccccagcagct

SEQ ID NO: 961088 - DNA, 25 bp, Mus musculus
gttgatgcgttggaccccagcagct

SEQ ID NO: 961089 - DNA, 25 bp, Mus musculus
gttgatggaggacgctatgggggaa

SEQ ID NO: 961090 - DNA, 25 bp, Mus musculus
gttgatggaggaggctatgggggaa

SEQ ID NO: 961091 - DNA, 25 bp, Mus musculus
gttgattcagaacatgcagaatgag

SEQ ID NO: 961092 - DNA, 25 bp, Mus musculus
gttgattcagaagatgcagaatgag

SEQ ID NO: 961093 - DNA, 25 bp, Mus musculus
gttgattccctgaactttgcagtgt

SEQ ID NO: 961094 - DNA, 25 bp, Mus musculus
gttgattccctgaagtttgcagtgt

SEQ ID NO: 961095 - DNA, 25 bp, Mus musculus
gttgattgagaaggagggagagttc

SEQ ID NO: 961096 - DNA, 25 bp, Mus musculus
gttgattgagtaggagggagagttc

SEQ ID NO: 961097 - DNA, 25 bp, Mus musculus
gttgcaagagcgtgaagaagctgac

SEQ ID NO: 961098 - DNA, 25 bp, Mus musculus
gttgcaagagggtgaagaagctgac

SEQ ID NO: 961099 - DNA, 25 bp, Mus musculus
gttgcaagcctcaacacgaaagtag

SEQ ID NO: 961100 - DNA, 25 bp, Mus musculus
gttgcaagcctcaagacgaaagtag

SEQ ID NO: 961101 - DNA, 25 bp, Mus musculus
gttgcaatccttcacacctccagag

SEQ ID NO: 961102 - DNA, 25 bp, Mus musculus
gttgcaatccttcagacctccagag

SEQ ID NO: 961103 - DNA, 25 bp, Mus musculus
gttgcagcagaacatcctgtgcagc

SEQ ID NO: 961104 - DNA, 25 bp, Mus musculus
gttgcagcagaagatcctgtgcagc

SEQ ID NO: 961105 - DNA, 25 bp, Mus musculus
gttgcagcagctgaaacagtttgag

SEQ ID NO: 961106 - DNA, 25 bp, Mus musculus
gttgcagcaggtgaaacagtttgag

SEQ ID NO: 961107 - DNA, 25 bp, Mus musculus
gttgcaggagcacccccaccgctgc

SEQ ID NO: 961108 - DNA, 25 bp, Mus musculus
gttgcaggagcgtgaagggcctggc

SEQ ID NO: 961109 - DNA, 25 bp, Mus musculus
gttgcaggaggacccccaccgctgc

SEQ ID NO: 961110 - DNA, 25 bp, Mus musculus
gttgcaggagggtgaagggcctggc

SEQ ID NO: 961111 - DNA, 25 bp, Mus musculus
gttgcagttacgtacgtctggtcag

SEQ ID NO: 961112 - DNA, 25 bp, Mus musculus
gttgcagttacgtaggtctggtcag

SEQ ID NO: 961113 - DNA, 25 bp, Mus musculus
gttgcataaaagctgtgaggaggca

SEQ ID NO: 961114 - DNA, 25 bp, Mus musculus
gttgcataaatgctgtgaggaggca

SEQ ID NO: 961115 - DNA, 25 bp, Mus musculus
gttgcataacaacttttggcaagaa

SEQ ID NO: 961116 - DNA, 25 bp, Mus musculus
gttgcataacaagttttggcaagaa

SEQ ID NO: 961117 - DNA, 25 bp, Mus musculus
gttgcatgtttcagctggtttgttg

SEQ ID NO: 961118 - DNA, 25 bp, Mus musculus
gttgcatgtttcaggtggtttgttg

SEQ ID NO: 961119 - DNA, 25 bp, Mus musculus
gttgccaaaaaagccaaagatgtga

SEQ ID NO: 961120 - DNA, 25 bp, Mus musculus
gttgccaaaaaagcgaaagatgtga

SEQ ID NO: 961121 - DNA, 25 bp, Mus musculus
gttgccaaattgcctccacttacct

SEQ ID NO: 961122 - DNA, 25 bp, Mus musculus
gttgccaaattggctccacttacct

SEQ ID NO: 961123 - DNA, 25 bp, Mus musculus
gttgccaacaagcctacgctgtgtt

SEQ ID NO: 961124 - DNA, 25 bp, Mus musculus
gttgccaacaaggctacgctgtgtt

SEQ ID NO: 961125 - DNA, 25 bp, Mus musculus
gttgccacaccaaataccgaagcaa

SEQ ID NO: 961126 - DNA, 25 bp, Mus musculus
gttgccacaccaaatataaactaca

SEQ ID NO: 961127 - DNA, 25 bp, Mus musculus
gttgccacaccatataccgaagcaa

SEQ ID NO: 961128 - DNA, 25 bp, Mus musculus
gttgccacaccatatataaactaca

SEQ ID NO: 961129 - DNA, 25 bp, Mus musculus
gttgccaccaagacctgtacatgga

SEQ ID NO: 961130 - DNA, 25 bp, Mus musculus
gttgccaccaagtcctgtacatgga

SEQ ID NO: 961131 - DNA, 25 bp, Mus musculus
gttgccatacagctgtctaggagca

SEQ ID NO: 961132 - DNA, 25 bp, Mus musculus
gttgccatacaggtgtctaggagca

SEQ ID NO: 961133 - DNA, 25 bp, Mus musculus
gttgccatcattcgaaagatctata

SEQ ID NO: 961134 - DNA, 25 bp, Mus musculus
gttgccatcattggaaagatctata

SEQ ID NO: 961135 - DNA, 25 bp, Mus musculus
gttgccgccatacgtttatggagcc

SEQ ID NO: 961136 - DNA, 25 bp, Mus musculus
gttgccgccataggtttatggagcc

SEQ ID NO: 961137 - DNA, 25 bp, Mus musculus
gttgccgggcgacctggaaaccatg

SEQ ID NO: 961138 - DNA, 25 bp, Mus musculus
gttgccgggcgagctggaaaccatg

SEQ ID NO: 961139 - DNA, 25 bp, Mus musculus
gttgcctcggagattcagcctcaac

SEQ ID NO: 961140 - DNA, 25 bp, Mus musculus
gttgcctcggagtttcagcctcaac

SEQ ID NO: 961141 - DNA, 25 bp, Mus musculus
gttgcctgactccctcggaagctgt

SEQ ID NO: 961142 - DNA, 25 bp, Mus musculus
gttgcctgactcgctcggaagctgt

SEQ ID NO: 961143 - DNA, 25 bp, Mus musculus
gttgcctggggaaacgctactcaaa

SEQ ID NO: 961144 - DNA, 25 bp, Mus musculus
gttgcctggggaaaggctactcaaa

SEQ ID NO: 961145 - DNA, 25 bp, Mus musculus
gttgcgacagcacgtcaaggagatc

SEQ ID NO: 961146 - DNA, 25 bp, Mus musculus
gttgcgacagcaggtcaaggagatc

SEQ ID NO: 961147 - DNA, 25 bp, Mus musculus
gttgcgccccagccaccaccatgcc

SEQ ID NO: 961148 - DNA, 25 bp, Mus musculus
gttgcgccccagcctccaccatgcc

SEQ ID NO: 961149 - DNA, 25 bp, Mus musculus
gttgctaaagcgcctattaaatccc

SEQ ID NO: 961150 - DNA, 25 bp, Mus musculus
gttgctaaagcggctattaaatccc

SEQ ID NO: 961151 - DNA, 25 bp, Mus musculus
gttgctatcatgcgtgagtgcatct

SEQ ID NO: 961152 - DNA, 25 bp, Mus musculus
gttgctatcatgggtgagtgcatct

SEQ ID NO: 961153 - DNA, 25 bp, Mus musculus
gttgctccccagccctgaggtgcgc

SEQ ID NO: 961154 - DNA, 25 bp, Mus musculus
gttgctccccaggcctgaggtgcgc

SEQ ID NO: 961155 - DNA, 25 bp, Mus musculus
gttgctctgagaaacttcaagacag

SEQ ID NO: 961156 - DNA, 25 bp, Mus musculus
gttgctctgagaaagttcaagacag

SEQ ID NO: 961157 - DNA, 25 bp, Mus musculus
gttgctgaagaacagcatcatggtc

SEQ ID NO: 961158 - DNA, 25 bp, Mus musculus
gttgctgaagaacgatgtggatgcc

SEQ ID NO: 961159 - DNA, 25 bp, Mus musculus
gttgctgaagaagagcatcatggtc

SEQ ID NO: 961160 - DNA, 25 bp, Mus musculus
gttgctgaagaaggatgtggatgcc

SEQ ID NO: 961161 - DNA, 25 bp, Mus musculus
gttgctgaagcttcaaaagaaagcc

SEQ ID NO: 961162 - DNA, 25 bp, Mus musculus
gttgctgaaggttcaaaagaaagcc

SEQ ID NO: 961163 - DNA, 25 bp, Mus musculus
gttgctgacaagatcctgtgggaaa

SEQ ID NO: 961164 - DNA, 25 bp, Mus musculus
gttgctgacaagttcctgtgggaaa

SEQ ID NO: 961165 - DNA, 25 bp, Mus musculus
gttgctgcagctgaacgatgtcaac

SEQ ID NO: 961166 - DNA, 25 bp, Mus musculus
gttgctgcaggtgaacgatgtcaac

SEQ ID NO: 961167 - DNA, 25 bp, Mus musculus
gttgctgctgatatttccgagagac

SEQ ID NO: 961168 - DNA, 25 bp, Mus musculus
gttgctgctgttatttccgagagac

SEQ ID NO: 961169 - DNA, 25 bp, Mus musculus
gttgctggtgcgcgtgagcagcatc

SEQ ID NO: 961170 - DNA, 25 bp, Mus musculus
gttgctggtgcgggtgagcagcatc

SEQ ID NO: 961171 - DNA, 25 bp, Mus musculus
gttgctgtatttcgcaaatgtggtc

SEQ ID NO: 961172 - DNA, 25 bp, Mus musculus
gttgctgtatttggcaaatgtggtc

SEQ ID NO: 961173 - DNA, 25 bp, Mus musculus
gttgctgtcattgacctgctggggt

SEQ ID NO: 961174 - DNA, 25 bp, Mus musculus
gttgctgtcattgagctgctggggt

SEQ ID NO: 961175 - DNA, 25 bp, Mus musculus
gttgcttcccagaggaagtcacaga

SEQ ID NO: 961176 - DNA, 25 bp, Mus musculus
gttgcttcccagtggaagtcacaga

SEQ ID NO: 961177 - DNA, 25 bp, Mus musculus
gttgcttttacattagtcataatcc

SEQ ID NO: 961178 - DNA, 25 bp, Mus musculus
gttgcttttacatttgtcataatcc

SEQ ID NO: 961179 - DNA, 25 bp, Mus musculus
gttgcttttatcatttattttcaaa

SEQ ID NO: 961180 - DNA, 25 bp, Mus musculus
gttgcttttatcttttattttcaaa

SEQ ID NO: 961181 - DNA, 25 bp, Mus musculus
gttggaaaagaacccacgagctcac

SEQ ID NO: 961182 - DNA, 25 bp, Mus musculus
gttggaaaagaaccctggctctcca

SEQ ID NO: 961183 - DNA, 25 bp, Mus musculus
gttggaaaagaaccgacgagctcac

SEQ ID NO: 961184 - DNA, 25 bp, Mus musculus
gttggaaaagaaccgtggctctcca

SEQ ID NO: 961185 - DNA, 25 bp, Mus musculus
gttggaaatcagaggtgatgagttc

SEQ ID NO: 961186 - DNA, 25 bp, Mus musculus
gttggaaatcagtggtgatgagttc

SEQ ID NO: 961187 - DNA, 25 bp, Mus musculus
gttggaaatgcctttcttcgtaggc

SEQ ID NO: 961188 - DNA, 25 bp, Mus musculus
gttggaaatggctttcttcgtaggc

SEQ ID NO: 961189 - DNA, 25 bp, Mus musculus
gttggaacattattccttcacctct

SEQ ID NO: 961190 - DNA, 25 bp, Mus musculus
gttggaacattattgcttcacctct

SEQ ID NO: 961191 - DNA, 25 bp, Mus musculus
gttggaaggacaagcttgttgacct

SEQ ID NO: 961192 - DNA, 25 bp, Mus musculus
gttggaaggacaaggttgttgacct

SEQ ID NO: 961193 - DNA, 25 bp, Mus musculus
gttggacaagatgcaagttctgctg

SEQ ID NO: 961194 - DNA, 25 bp, Mus musculus
gttggacaagcttgctgaagagtgg

SEQ ID NO: 961195 - DNA, 25 bp, Mus musculus
gttggacaaggttgctgaagagtgg

SEQ ID NO: 961196 - DNA, 25 bp, Mus musculus
gttggacaagttgcaagttctgctg

SEQ ID NO: 961197 - DNA, 25 bp, Mus musculus
gttggactgcagccaaaatggcaaa

SEQ ID NO: 961198 - DNA, 25 bp, Mus musculus
gttggactgcagcctaaatggcaaa

SEQ ID NO: 961199 - DNA, 25 bp, Mus musculus
gttggagagagacgcacgattacag

SEQ ID NO: 961200 - DNA, 25 bp, Mus musculus
gttggagagagaggcacgattacag

SEQ ID NO: 961201 - DNA, 25 bp, Mus musculus
gttggagagaggcgtctggcaggcc

SEQ ID NO: 961202 - DNA, 25 bp, Mus musculus
gttggagagaggggtctggcaggcc

SEQ ID NO: 961203 - DNA, 25 bp, Mus musculus
gttggagatgaactggtgttgataa

SEQ ID NO: 961204 - DNA, 25 bp, Mus musculus
gttggagatgaagtggtgttgataa

SEQ ID NO: 961205 - DNA, 25 bp, Mus musculus
gttggagctcagctgcccctgggag

SEQ ID NO: 961206 - DNA, 25 bp, Mus musculus
gttggagctcaggtgcccctgggag

SEQ ID NO: 961207 - DNA, 25 bp, Mus musculus
gttggaggagcgaacctagctcaga

SEQ ID NO: 961208 - DNA, 25 bp, Mus musculus
gttggaggagggaacctagctcaga

SEQ ID NO: 961209 - DNA, 25 bp, Mus musculus
gttggaggtggaccacgaccacagg

SEQ ID NO: 961210 - DNA, 25 bp, Mus musculus
gttggaggtggagcacgaccacagg

SEQ ID NO: 961211 - DNA, 25 bp, Mus musculus
gttggatatcgacgctgaagtccct

SEQ ID NO: 961212 - DNA, 25 bp, Mus musculus
gttggatatcgaggctgaagtccct

SEQ ID NO: 961213 - DNA, 25 bp, Mus musculus
gttggatctcagcgcatgcccaaga

SEQ ID NO: 961214 - DNA, 25 bp, Mus musculus
gttggatctcagggcatgcccaaga

SEQ ID NO: 961215 - DNA, 25 bp, Mus musculus
gttggatgaaaccctgtcttcattg

SEQ ID NO: 961216 - DNA, 25 bp, Mus musculus
gttggatgaaacgctgtcttcattg

SEQ ID NO: 961217 - DNA, 25 bp, Mus musculus
gttggcaataagctgagccagctca

SEQ ID NO: 961218 - DNA, 25 bp, Mus musculus
gttggcaataaggtgagccagctca

SEQ ID NO: 961219 - DNA, 25 bp, Mus musculus
gttggcacgagacgaccctctcaaa

SEQ ID NO: 961220 - DNA, 25 bp, Mus musculus
gttggcacgagaggaccctctcaaa

SEQ ID NO: 961221 - DNA, 25 bp, Mus musculus
gttggcagagagaacctgatggact

SEQ ID NO: 961222 - DNA, 25 bp, Mus musculus
gttggcagaggacagcctgaacatc

SEQ ID NO: 961223 - DNA, 25 bp, Mus musculus
gttggcagaggagagcctgaacatc

SEQ ID NO: 961224 - DNA, 25 bp, Mus musculus
gttggcagagtgaacctgatggact

SEQ ID NO: 961225 - DNA, 25 bp, Mus musculus
gttggccaagcatgaacatggaaag

SEQ ID NO: 961226 - DNA, 25 bp, Mus musculus
gttggccaaggatgaacatggaaag

SEQ ID NO: 961227 - DNA, 25 bp, Mus musculus
gttggcccagctgacaagctacagt

SEQ ID NO: 961228 - DNA, 25 bp, Mus musculus
gttggcccaggtgacaagctacagt

SEQ ID NO: 961229 - DNA, 25 bp, Mus musculus
gttggcctatagcaagtttggtgag

SEQ ID NO: 961230 - DNA, 25 bp, Mus musculus
gttggcctataggaagtttggtgag

SEQ ID NO: 961231 - DNA, 25 bp, Mus musculus
gttggcgattagactctgccttcag

SEQ ID NO: 961232 - DNA, 25 bp, Mus musculus
gttggcgattagaggtctgacatgg

SEQ ID NO: 961233 - DNA, 25 bp, Mus musculus
gttggcgattagtctctgccttcag

SEQ ID NO: 961234 - DNA, 25 bp, Mus musculus
gttggcgattagtggtctgacatgg

SEQ ID NO: 961235 - DNA, 25 bp, Mus musculus
gttggcggagagagtacccagtatt

SEQ ID NO: 961236 - DNA, 25 bp, Mus musculus
gttggcggagagtgtacccagtatt

SEQ ID NO: 961237 - DNA, 25 bp, Mus musculus
gttggctcagcagggtgtgaagaca

SEQ ID NO: 961238 - DNA, 25 bp, Mus musculus
gttggctcaggagggtgtgaagaca

SEQ ID NO: 961239 - DNA, 25 bp, Mus musculus
gttggctctataatcgttaactttg

SEQ ID NO: 961240 - DNA, 25 bp, Mus musculus
gttggctctataatggttaactttg

SEQ ID NO: 961241 - DNA, 25 bp, Mus musculus
gttggctgcacaccaggtgtgcaag

SEQ ID NO: 961242 - DNA, 25 bp, Mus musculus
gttggctgcacagcaggtgtgcaag

SEQ ID NO: 961243 - DNA, 25 bp, Mus musculus
gttggcttgtggactatgttcagaa

SEQ ID NO: 961244 - DNA, 25 bp, Mus musculus
gttggcttgtggtctatgttcagaa

SEQ ID NO: 961245 - DNA, 25 bp, Mus musculus
gttgggaacagacgactctggggcc

SEQ ID NO: 961246 - DNA, 25 bp, Mus musculus
gttgggaacagaggactctggggcc

SEQ ID NO: 961247 - DNA, 25 bp, Mus musculus
gttgggaagagtcccatgacaatgc

SEQ ID NO: 961248 - DNA, 25 bp, Mus musculus
gttgggaagagtctgtcctgagttg

SEQ ID NO: 961249 - DNA, 25 bp, Mus musculus
gttgggaagagtgccatgacaatgc

SEQ ID NO: 961250 - DNA, 25 bp, Mus musculus
gttgggaagagtgtgtcctgagttg

SEQ ID NO: 961251 - DNA, 25 bp, Mus musculus
gttgggagagatctggttgctcctt

SEQ ID NO: 961252 - DNA, 25 bp, Mus musculus
gttgggagagatgtggttgctcctt

SEQ ID NO: 961253 - DNA, 25 bp, Mus musculus
gttgggataaactcgcatgtgtgga

SEQ ID NO: 961254 - DNA, 25 bp, Mus musculus
gttgggataatctcgcatgtgtgga

SEQ ID NO: 961255 - DNA, 25 bp, Mus musculus
gttgggattattatcctttctccca

SEQ ID NO: 961256 - DNA, 25 bp, Mus musculus
gttgggattattatgctttctccca

SEQ ID NO: 961257 - DNA, 25 bp, Mus musculus
gttgggccccagcgctatggaactg

SEQ ID NO: 961258 - DNA, 25 bp, Mus musculus
gttgggccccagggctatggaactg

SEQ ID NO: 961259 - DNA, 25 bp, Mus musculus
gttgggtgcgaacgtaacagagaga

SEQ ID NO: 961260 - DNA, 25 bp, Mus musculus
gttgggtgcgaaggtaacagagaga

SEQ ID NO: 961261 - DNA, 25 bp, Mus musculus
gttggtaaaagcccagtcacaatgc

SEQ ID NO: 961262 - DNA, 25 bp, Mus musculus
gttggtaaaagcgcagtcacaatgc

SEQ ID NO: 961263 - DNA, 25 bp, Mus musculus
gttggtaaatctttatggagccgta

SEQ ID NO: 961264 - DNA, 25 bp, Mus musculus
gttggtaaatgtttatggagccgta

SEQ ID NO: 961265 - DNA, 25 bp, Mus musculus
gttggtacagcatcagtatggcaat

SEQ ID NO: 961266 - DNA, 25 bp, Mus musculus
gttggtacaggatcagtatggcaat

SEQ ID NO: 961267 - DNA, 25 bp, Mus musculus
gttggtatattcaacgttggatgga

SEQ ID NO: 961268 - DNA, 25 bp, Mus musculus
gttggtatattcaaggttggatgga

SEQ ID NO: 961269 - DNA, 25 bp, Mus musculus
gttggtctcgctgctcttagtagaa

SEQ ID NO: 961270 - DNA, 25 bp, Mus musculus
gttggtctcggtgctcttagtagaa

SEQ ID NO: 961271 - DNA, 25 bp, Mus musculus
gttggtgcagctatcgctgggttgc

SEQ ID NO: 961272 - DNA, 25 bp, Mus musculus
gttggtgcagctatggctgggttgc

SEQ ID NO: 961273 - DNA, 25 bp, Mus musculus
gttggtggcacgcatggcaatgtgc

SEQ ID NO: 961274 - DNA, 25 bp, Mus musculus
gttggtggcacggatggcaatgtgc

SEQ ID NO: 961275 - DNA, 25 bp, Mus musculus
gttggttcaacaaacgaattgaaat

SEQ ID NO: 961276 - DNA, 25 bp, Mus musculus
gttggttcaacaaaggaattgaaat

SEQ ID NO: 961277 - DNA, 25 bp, Mus musculus
gttggttcacagcctggaatacatt

SEQ ID NO: 961278 - DNA, 25 bp, Mus musculus
gttggttcacaggctggaatacatt

SEQ ID NO: 961279 - DNA, 25 bp, Mus musculus
gttggttcagaatcctgtggaacat

SEQ ID NO: 961280 - DNA, 25 bp, Mus musculus
gttggttcagctggaacatccagac

SEQ ID NO: 961281 - DNA, 25 bp, Mus musculus
gttggttcaggtggaacatccagac

SEQ ID NO: 961282 - DNA, 25 bp, Mus musculus
gttggttcagtatcctgtggaacat

SEQ ID NO: 961283 - DNA, 25 bp, Mus musculus
gttggttccttccacggcctggtgg

SEQ ID NO: 961284 - DNA, 25 bp, Mus musculus
gttggttccttccagggcctggtgg

SEQ ID NO: 961285 - DNA, 25 bp, Mus musculus
gttgtaccccagccattgggcatgg

SEQ ID NO: 961286 - DNA, 25 bp, Mus musculus
gttgtaccccaggcattgggcatgg

SEQ ID NO: 961287 - DNA, 25 bp, Mus musculus
gttgtaccgaagccactacacgctg

SEQ ID NO: 961288 - DNA, 25 bp, Mus musculus
gttgtaccgaaggcactacacgctg

SEQ ID NO: 961289 - DNA, 25 bp, Mus musculus
gttgtagcccagaaagtcctaggtg

SEQ ID NO: 961290 - DNA, 25 bp, Mus musculus
gttgtagcccagtaagtcctaggtg

SEQ ID NO: 961291 - DNA, 25 bp, Mus musculus
gttgtattaacacgtgctaaagtta

SEQ ID NO: 961292 - DNA, 25 bp, Mus musculus
gttgtattaacaggtgctaaagtta

SEQ ID NO: 961293 - DNA, 25 bp, Mus musculus
gttgtattcaaccgcttctttgaga

SEQ ID NO: 961294 - DNA, 25 bp, Mus musculus
gttgtattcaacggcttctttgaga

SEQ ID NO: 961295 - DNA, 25 bp, Mus musculus
gttgtcaaagataatactaaatatg

SEQ ID NO: 961296 - DNA, 25 bp, Mus musculus
gttgtcaaagttaatactaaatatg

SEQ ID NO: 961297 - DNA, 25 bp, Mus musculus
gttgtcatcacaccttagcgctctg

SEQ ID NO: 961298 - DNA, 25 bp, Mus musculus
gttgtcatcacagcttagcgctctg

SEQ ID NO: 961299 - DNA, 25 bp, Mus musculus
gttgtccaagcaatgtggcttcggc

SEQ ID NO: 961300 - DNA, 25 bp, Mus musculus
gttgtccaaggaatgtggcttcggc

SEQ ID NO: 961301 - DNA, 25 bp, Mus musculus
gttgtccctgacaggtttggccatc

SEQ ID NO: 961302 - DNA, 25 bp, Mus musculus
gttgtccctgtcaggtttggccatc

SEQ ID NO: 961303 - DNA, 25 bp, Mus musculus
gttgtcctggcagatggaagtacaa

SEQ ID NO: 961304 - DNA, 25 bp, Mus musculus
gttgtcctgggagatggaagtacaa

SEQ ID NO: 961305 - DNA, 25 bp, Mus musculus
gttgtcctgtcacctttggccacag

SEQ ID NO: 961306 - DNA, 25 bp, Mus musculus
gttgtcctgtcagctttggccacag

SEQ ID NO: 961307 - DNA, 25 bp, Mus musculus
gttgtcgggcagaactgtgtctgta

SEQ ID NO: 961308 - DNA, 25 bp, Mus musculus
gttgtcgggcagccagccattcatg

SEQ ID NO: 961309 - DNA, 25 bp, Mus musculus
gttgtcgggcaggcagccattcatg

SEQ ID NO: 961310 - DNA, 25 bp, Mus musculus
gttgtcgggcagtactgtgtctgta

SEQ ID NO: 961311 - DNA, 25 bp, Mus musculus
gttgtctctgatgcagcccttggca

SEQ ID NO: 961312 - DNA, 25 bp, Mus musculus
gttgtctctgccatcgtgaactccc

SEQ ID NO: 961313 - DNA, 25 bp, Mus musculus
gttgtctctgccatggtgaactccc

SEQ ID NO: 961314 - DNA, 25 bp, Mus musculus
gttgtctctgttgcagcccttggca

SEQ ID NO: 961315 - DNA, 25 bp, Mus musculus
gttgtcttccaaaaggctcaaagac

SEQ ID NO: 961316 - DNA, 25 bp, Mus musculus
gttgtcttccaataggctcaaagac

SEQ ID NO: 961317 - DNA, 25 bp, Mus musculus
gttgtcttcgtcaacggcacactga

SEQ ID NO: 961318 - DNA, 25 bp, Mus musculus
gttgtcttcgtcaagggcacactga

SEQ ID NO: 961319 - DNA, 25 bp, Mus musculus
gttgtgagatttttctggacagcac

SEQ ID NO: 961320 - DNA, 25 bp, Mus musculus
gttgtgagatttttgtggacagcac

SEQ ID NO: 961321 - DNA, 25 bp, Mus musculus
gttgtgaggactcctcctgagcctg

SEQ ID NO: 961322 - DNA, 25 bp, Mus musculus
gttgtgaggactgctcctgagcctg

SEQ ID NO: 961323 - DNA, 25 bp, Mus musculus
gttgtgatcttgcaggctggtccag

SEQ ID NO: 961324 - DNA, 25 bp, Mus musculus
gttgtgatcttggaggctggtccag

SEQ ID NO: 961325 - DNA, 25 bp, Mus musculus
gttgtggacactggaaggtctacgt

SEQ ID NO: 961326 - DNA, 25 bp, Mus musculus
gttgtggacactggtaggtctacgt

SEQ ID NO: 961327 - DNA, 25 bp, Mus musculus
gttgtggatgatgacgagatggggg

SEQ ID NO: 961328 - DNA, 25 bp, Mus musculus
gttgtggatgatgaggagatggggg

SEQ ID NO: 961329 - DNA, 25 bp, Mus musculus
gttgtgggcattaacataagggtgt

SEQ ID NO: 961330 - DNA, 25 bp, Mus musculus
gttgtgggcattaacgtagataagg

SEQ ID NO: 961331 - DNA, 25 bp, Mus musculus
gttgtgggcattaagataagggtgt

SEQ ID NO: 961332 - DNA, 25 bp, Mus musculus
gttgtgggcattaaggtagataagg

SEQ ID NO: 961333 - DNA, 25 bp, Mus musculus
gttgttaagaacctggaccgctggt

SEQ ID NO: 961334 - DNA, 25 bp, Mus musculus
gttgttaagactactgggaatcagc

SEQ ID NO: 961335 - DNA, 25 bp, Mus musculus
gttgttaagagtactgggaatcagc

SEQ ID NO: 961336 - DNA, 25 bp, Mus musculus
gttgttaagatcctggaccgctggt

SEQ ID NO: 961337 - DNA, 25 bp, Mus musculus
gttgttagatcacgctgctttctcc

SEQ ID NO: 961338 - DNA, 25 bp, Mus musculus
gttgttagatcacgggggctttgcc

SEQ ID NO: 961339 - DNA, 25 bp, Mus musculus
gttgttagatcaggctgctttctcc

SEQ ID NO: 961340 - DNA, 25 bp, Mus musculus
gttgttagatcaggggggctttgcc

SEQ ID NO: 961341 - DNA, 25 bp, Mus musculus
gttgttcaagagaaaccatttattg

SEQ ID NO: 961342 - DNA, 25 bp, Mus musculus
gttgttcaagatgggagaatgaagt

SEQ ID NO: 961343 - DNA, 25 bp, Mus musculus
gttgttcaagtgaaaccatttattg

SEQ ID NO: 961344 - DNA, 25 bp, Mus musculus
gttgttcaagttgggagaatgaagt

SEQ ID NO: 961345 - DNA, 25 bp, Mus musculus
gttgttcatgacctgaaggggaaga

SEQ ID NO: 961346 - DNA, 25 bp, Mus musculus
gttgttcatgtcctgaaggggaaga

SEQ ID NO: 961347 - DNA, 25 bp, Mus musculus
gttgttccagcgcacctttgaacca

SEQ ID NO: 961348 - DNA, 25 bp, Mus musculus
gttgttccagcgcagctttgaacca

SEQ ID NO: 961349 - DNA, 25 bp, Mus musculus
gttgttcctggccctatatgtgcag

SEQ ID NO: 961350 - DNA, 25 bp, Mus musculus
gttgttcctggcgctatatgtgcag

SEQ ID NO: 961351 - DNA, 25 bp, Mus musculus
gttgttgctggacacaaccggatcc

SEQ ID NO: 961352 - DNA, 25 bp, Mus musculus
gttgttgctggagacaaccggatcc

SEQ ID NO: 961353 - DNA, 25 bp, Mus musculus
gttgttggagcaactgctgaagaag

SEQ ID NO: 961354 - DNA, 25 bp, Mus musculus
gttgttggaggaactgctgaagaag

SEQ ID NO: 961355 - DNA, 25 bp, Mus musculus
gttgttggctgcacagcaggtgtgc

SEQ ID NO: 961356 - DNA, 25 bp, Mus musculus
gttgttggctgcactgcaggtgtgc

SEQ ID NO: 961357 - DNA, 25 bp, Mus musculus
gtttaacacaatggcatatttagga

SEQ ID NO: 961358 - DNA, 25 bp, Mus musculus
gtttaacacattggcatatttagga

SEQ ID NO: 961359 - DNA, 25 bp, Mus musculus
gtttaatgggtatcaatataaagct

SEQ ID NO: 961360 - DNA, 25 bp, Mus musculus
gtttaatgggtatctatataaagct

SEQ ID NO: 961361 - DNA, 25 bp, Mus musculus
gtttaatggtagcaaattaaaatgt

SEQ ID NO: 961362 - DNA, 25 bp, Mus musculus
gtttaatggtagcatattaaaatgt

SEQ ID NO: 961363 - DNA, 25 bp, Mus musculus
gtttaatttgaccgaggacatgtat

SEQ ID NO: 961364 - DNA, 25 bp, Mus musculus
gtttaatttgacggaggacatgtat

SEQ ID NO: 961365 - DNA, 25 bp, Mus musculus
gtttacatactgccacaagccgaaa

SEQ ID NO: 961366 - DNA, 25 bp, Mus musculus
gtttacatactggcacaagccgaaa

SEQ ID NO: 961367 - DNA, 25 bp, Mus musculus
gtttactacatagcaggcttttttc

SEQ ID NO: 961368 - DNA, 25 bp, Mus musculus
gtttactacatagctggcttttttc

SEQ ID NO: 961369 - DNA, 25 bp, Mus musculus
gtttactcccaaaatgaagactctt

SEQ ID NO: 961370 - DNA, 25 bp, Mus musculus
gtttactcccaatatgaagactctt

SEQ ID NO: 961371 - DNA, 25 bp, Mus musculus
gtttactttcaacgtgccatactcg

SEQ ID NO: 961372 - DNA, 25 bp, Mus musculus
gtttactttcaaggtgccatactcg

SEQ ID NO: 961373 - DNA, 25 bp, Mus musculus
gtttagaaaggcactggaactgatc

SEQ ID NO: 961374 - DNA, 25 bp, Mus musculus
gtttagaaaggctctggaactgatc

SEQ ID NO: 961375 - DNA, 25 bp, Mus musculus
gtttagctacagcaagcagtttgag

SEQ ID NO: 961376 - DNA, 25 bp, Mus musculus
gtttagctacagcagcatctggacc

SEQ ID NO: 961377 - DNA, 25 bp, Mus musculus
gtttagctacaggaagcagtttgag

SEQ ID NO: 961378 - DNA, 25 bp, Mus musculus
gtttagctacaggagcatctggacc

SEQ ID NO: 961379 - DNA, 25 bp, Mus musculus
gtttataactaccacatgccaccgc

SEQ ID NO: 961380 - DNA, 25 bp, Mus musculus
gtttataactaccacgcttatacaa

SEQ ID NO: 961381 - DNA, 25 bp, Mus musculus
gtttataactaccagatgccaccgc

SEQ ID NO: 961382 - DNA, 25 bp, Mus musculus
gtttataactaccaggcttatacaa

SEQ ID NO: 961383 - DNA, 25 bp, Mus musculus
gtttataagaaccagctgcaccgcc

SEQ ID NO: 961384 - DNA, 25 bp, Mus musculus
gtttataagaacgagctgcaccgcc

SEQ ID NO: 961385 - DNA, 25 bp, Mus musculus
gtttatattcaaccagctgtgacca

SEQ ID NO: 961386 - DNA, 25 bp, Mus musculus
gtttatattcaacctgctgtgacca

SEQ ID NO: 961387 - DNA, 25 bp, Mus musculus
gtttatcaaaagacttccaactgaa

SEQ ID NO: 961388 - DNA, 25 bp, Mus musculus
gtttatcaaaagtcttccaactgaa

SEQ ID NO: 961389 - DNA, 25 bp, Mus musculus
gtttatcaaactcatgtaggaaatt

SEQ ID NO: 961390 - DNA, 25 bp, Mus musculus
gtttatcaaagtcatgtaggaaatt

SEQ ID NO: 961391 - DNA, 25 bp, Mus musculus
gtttatcaacaaccctcttattgtt

SEQ ID NO: 961392 - DNA, 25 bp, Mus musculus
gtttatcaacaagcctcttattgtt

SEQ ID NO: 961393 - DNA, 25 bp, Mus musculus
gtttatcaagctcttccatggctta

SEQ ID NO: 961394 - DNA, 25 bp, Mus musculus
gtttatcaaggtcttccatggctta

SEQ ID NO: 961395 - DNA, 25 bp, Mus musculus
gtttatcagaagattccagagtgtg

SEQ ID NO: 961396 - DNA, 25 bp, Mus musculus
gtttatcagaagtttccagagtgtg

SEQ ID NO: 961397 - DNA, 25 bp, Mus musculus
gtttatcatgacaccaagctggatg

SEQ ID NO: 961398 - DNA, 25 bp, Mus musculus
gtttatcatgtcaccaagctggatg

SEQ ID NO: 961399 - DNA, 25 bp, Mus musculus
gtttatcccgagccggcgattggac

SEQ ID NO: 961400 - DNA, 25 bp, Mus musculus
gtttatcccgtgccggcgattggac

SEQ ID NO: 961401 - DNA, 25 bp, Mus musculus
gtttatcgaggacgcagcgggccgt

SEQ ID NO: 961402 - DNA, 25 bp, Mus musculus
gtttatcgaggaggcagcgggccgt

SEQ ID NO: 961403 - DNA, 25 bp, Mus musculus
gtttatgaagaggaagtcttcggtg

SEQ ID NO: 961404 - DNA, 25 bp, Mus musculus
gtttatgaagtggaagtcttcggtg

SEQ ID NO: 961405 - DNA, 25 bp, Mus musculus
gtttatggagcaaaacacagaaaga

SEQ ID NO: 961406 - DNA, 25 bp, Mus musculus
gtttatggaggaaaacacagaaaga

SEQ ID NO: 961407 - DNA, 25 bp, Mus musculus
gtttattcagattgatatctgtgca

SEQ ID NO: 961408 - DNA, 25 bp, Mus musculus
gtttattcagtttgatatctgtgca

SEQ ID NO: 961409 - DNA, 25 bp, Mus musculus
gtttattctgccgggagggaagcct

SEQ ID NO: 961410 - DNA, 25 bp, Mus musculus
gtttattctggcgggagggaagcct

SEQ ID NO: 961411 - DNA, 25 bp, Mus musculus
gtttattttcacaaagtggctacag

SEQ ID NO: 961412 - DNA, 25 bp, Mus musculus
gtttattttcacaatgtggctacag

SEQ ID NO: 961413 - DNA, 25 bp, Mus musculus
gtttcaaaagccattgcgctccctc

SEQ ID NO: 961414 - DNA, 25 bp, Mus musculus
gtttcaaaagctctcttctcccttg

SEQ ID NO: 961415 - DNA, 25 bp, Mus musculus
gtttcaaaaggcattgcgctccctc

SEQ ID NO: 961416 - DNA, 25 bp, Mus musculus
gtttcaaaaggtctcttctcccttg

SEQ ID NO: 961417 - DNA, 25 bp, Mus musculus
gtttcaattccaatccaaacaagaa

SEQ ID NO: 961418 - DNA, 25 bp, Mus musculus
gtttcaattccaatgcaaacaagaa

SEQ ID NO: 961419 - DNA, 25 bp, Mus musculus
gtttcaccacagatcccatcactct

SEQ ID NO: 961420 - DNA, 25 bp, Mus musculus
gtttcaccacagatgccatcactct

SEQ ID NO: 961421 - DNA, 25 bp, Mus musculus
gtttcagaacagagggcaatgcgag

SEQ ID NO: 961422 - DNA, 25 bp, Mus musculus
gtttcagaacagtgggcaatgcgag

SEQ ID NO: 961423 - DNA, 25 bp, Mus musculus
gtttcagataataggaggatagaca

SEQ ID NO: 961424 - DNA, 25 bp, Mus musculus
gtttcagataatagggccattgaca

SEQ ID NO: 961425 - DNA, 25 bp, Mus musculus
gtttcagataattggaggatagaca

SEQ ID NO: 961426 - DNA, 25 bp, Mus musculus
gtttcagataattgggccattgaca

SEQ ID NO: 961427 - DNA, 25 bp, Mus musculus
gtttcagccgcatccctctgaagaa

SEQ ID NO: 961428 - DNA, 25 bp, Mus musculus
gtttcagccgcatcgctctgaagaa

SEQ ID NO: 961429 - DNA, 25 bp, Mus musculus
gtttcatcatggcaaactgtgacgt

SEQ ID NO: 961430 - DNA, 25 bp, Mus musculus
gtttcatcatgggaaactgtgacgt

SEQ ID NO: 961431 - DNA, 25 bp, Mus musculus
gtttcatttaaaatcgatgtgaaat

SEQ ID NO: 961432 - DNA, 25 bp, Mus musculus
gtttcatttaaaatggatgtgaaat

SEQ ID NO: 961433 - DNA, 25 bp, Mus musculus
gtttccaagcacatcaatgaaacaa

SEQ ID NO: 961434 - DNA, 25 bp, Mus musculus
gtttccaagcacatgaatgaaacaa

SEQ ID NO: 961435 - DNA, 25 bp, Mus musculus
gtttccacagaatggactcgctaca

SEQ ID NO: 961436 - DNA, 25 bp, Mus musculus
gtttccacagcttgaagcttgcaga

SEQ ID NO: 961437 - DNA, 25 bp, Mus musculus
gtttccacaggttgaagcttgcaga

SEQ ID NO: 961438 - DNA, 25 bp, Mus musculus
gtttccacagtatggactcgctaca

SEQ ID NO: 961439 - DNA, 25 bp, Mus musculus
gtttccactgagtccttagccagga

SEQ ID NO: 961440 - DNA, 25 bp, Mus musculus
gtttccactgcaaggcctgcaggaa

SEQ ID NO: 961441 - DNA, 25 bp, Mus musculus
gtttccactgcacctcctggccttc

SEQ ID NO: 961442 - DNA, 25 bp, Mus musculus
gtttccactgcatggcctgcaggaa

SEQ ID NO: 961443 - DNA, 25 bp, Mus musculus
gtttccactggacctcctggccttc

SEQ ID NO: 961444 - DNA, 25 bp, Mus musculus
gtttccactgtgtccttagccagga

SEQ ID NO: 961445 - DNA, 25 bp, Mus musculus
gtttccatcacgaacaacatctgga

SEQ ID NO: 961446 - DNA, 25 bp, Mus musculus
gtttccatcacgaagaacatctgga

SEQ ID NO: 961447 - DNA, 25 bp, Mus musculus
gtttccccagatcctgtcttccatc

SEQ ID NO: 961448 - DNA, 25 bp, Mus musculus
gtttccccagcacaccaatcttccc

SEQ ID NO: 961449 - DNA, 25 bp, Mus musculus
gtttccccagcacagcaatcttccc

SEQ ID NO: 961450 - DNA, 25 bp, Mus musculus
gtttccccagttcctgtcttccatc

SEQ ID NO: 961451 - DNA, 25 bp, Mus musculus
gtttccctcagcaaccatcacttct

SEQ ID NO: 961452 - DNA, 25 bp, Mus musculus
gtttccctcagctaccatcacttct

SEQ ID NO: 961453 - DNA, 25 bp, Mus musculus
gtttcccttgagcttctgatcttat

SEQ ID NO: 961454 - DNA, 25 bp, Mus musculus
gtttcccttgaggttctgatcttat

SEQ ID NO: 961455 - DNA, 25 bp, Mus musculus
gtttccgagcagaaccaagccatac

SEQ ID NO: 961456 - DNA, 25 bp, Mus musculus
gtttccgagcagaagcaagccatac

SEQ ID NO: 961457 - DNA, 25 bp, Mus musculus
gtttccgtgcctatgaagatgagca

SEQ ID NO: 961458 - DNA, 25 bp, Mus musculus
gtttccgtgcctttgaagatgagca

SEQ ID NO: 961459 - DNA, 25 bp, Mus musculus
gtttcctctgggatatcagtaccca

SEQ ID NO: 961460 - DNA, 25 bp, Mus musculus
gtttcctctgggttatcagtaccca

SEQ ID NO: 961461 - DNA, 25 bp, Mus musculus
gtttcctgagattttgtgtatccac

SEQ ID NO: 961462 - DNA, 25 bp, Mus musculus
gtttcctgagtttttgtgtatccac

SEQ ID NO: 961463 - DNA, 25 bp, Mus musculus
gtttcctggatgcacgcctgccagg

SEQ ID NO: 961464 - DNA, 25 bp, Mus musculus
gtttcctggatgcaggcctgccagg

SEQ ID NO: 961465 - DNA, 25 bp, Mus musculus
gtttccttgcagatatactgctgtt

SEQ ID NO: 961466 - DNA, 25 bp, Mus musculus
gtttccttgcagcgcctctatgacc

SEQ ID NO: 961467 - DNA, 25 bp, Mus musculus
gtttccttgcagctccattcacaca

SEQ ID NO: 961468 - DNA, 25 bp, Mus musculus
gtttccttgcagggcctctatgacc

SEQ ID NO: 961469 - DNA, 25 bp, Mus musculus
gtttccttgcaggtccattcacaca

SEQ ID NO: 961470 - DNA, 25 bp, Mus musculus
gtttccttgcagttatactgctgtt

SEQ ID NO: 961471 - DNA, 25 bp, Mus musculus
gtttcggccaggagtcctactgtgt

SEQ ID NO: 961472 - DNA, 25 bp, Mus musculus
gtttcggccaggtgtcctactgtgt

SEQ ID NO: 961473 - DNA, 25 bp, Mus musculus
gtttcgtcagaacgtggaaatgacg

SEQ ID NO: 961474 - DNA, 25 bp, Mus musculus
gtttcgtcagaaggtggaaatgacg

SEQ ID NO: 961475 - DNA, 25 bp, Mus musculus
gtttcgtcatgacatcaaggacacc

SEQ ID NO: 961476 - DNA, 25 bp, Mus musculus
gtttcgtcatgagatcaaggacacc

SEQ ID NO: 961477 - DNA, 25 bp, Mus musculus
gtttctcaagcgttgagctccataa

SEQ ID NO: 961478 - DNA, 25 bp, Mus musculus
gtttctcaagggttgagctccataa

SEQ ID NO: 961479 - DNA, 25 bp, Mus musculus
gtttctcatgagcaacctggcttta

SEQ ID NO: 961480 - DNA, 25 bp, Mus musculus
gtttctcatgaggaacctggcttta

SEQ ID NO: 961481 - DNA, 25 bp, Mus musculus
gtttctccaccacgacatggatttg

SEQ ID NO: 961482 - DNA, 25 bp, Mus musculus
gtttctccaccaggacatggatttg

SEQ ID NO: 961483 - DNA, 25 bp, Mus musculus
gtttctctaccacgtctgtcaccta

SEQ ID NO: 961484 - DNA, 25 bp, Mus musculus
gtttctctaccaggtctgtcaccta

SEQ ID NO: 961485 - DNA, 25 bp, Mus musculus
gtttctctgcctcagtgcttcaatt

SEQ ID NO: 961486 - DNA, 25 bp, Mus musculus
gtttctctgcctgagtgcttcaatt

SEQ ID NO: 961487 - DNA, 25 bp, Mus musculus
gtttctgcaaagaacagaacagtct

SEQ ID NO: 961488 - DNA, 25 bp, Mus musculus
gtttctgcaaagtacagaacagtct

SEQ ID NO: 961489 - DNA, 25 bp, Mus musculus
gtttctgcacaacactccagtggaa

SEQ ID NO: 961490 - DNA, 25 bp, Mus musculus
gtttctgcacaagactccagtggaa

SEQ ID NO: 961491 - DNA, 25 bp, Mus musculus
gtttctgcatcagccgatctctcaa

SEQ ID NO: 961492 - DNA, 25 bp, Mus musculus
gtttctgcatcagcggatctctcaa

SEQ ID NO: 961493 - DNA, 25 bp, Mus musculus
gtttctgctgagcagagcaatggcc

SEQ ID NO: 961494 - DNA, 25 bp, Mus musculus
gtttctgctgaggagagcaatggcc

SEQ ID NO: 961495 - DNA, 25 bp, Mus musculus
gtttctgcttgaagtcctagaagac

SEQ ID NO: 961496 - DNA, 25 bp, Mus musculus
gtttctgcttgatgtcctagaagac

SEQ ID NO: 961497 - DNA, 25 bp, Mus musculus
gtttctggagacctccatggagaaa

SEQ ID NO: 961498 - DNA, 25 bp, Mus musculus
gtttctggagacctgcatggagaaa

SEQ ID NO: 961499 - DNA, 25 bp, Mus musculus
gtttctggtgaacattatgggacag

SEQ ID NO: 961500 - DNA, 25 bp, Mus musculus
gtttctggtgaagattatgggacag

SEQ ID NO: 961501 - DNA, 25 bp, Mus musculus
gtttctgtccgacgtcgctcatccg

SEQ ID NO: 961502 - DNA, 25 bp, Mus musculus
gtttctgtccgaggtcgctcatccg

SEQ ID NO: 961503 - DNA, 25 bp, Mus musculus
gtttcttgcaaacatcactggagat

SEQ ID NO: 961504 - DNA, 25 bp, Mus musculus
gtttcttgcaaagatcactggagat

SEQ ID NO: 961505 - DNA, 25 bp, Mus musculus
gtttctttgtgacactcttcgtacc

SEQ ID NO: 961506 - DNA, 25 bp, Mus musculus
gtttctttgtgagactcttcgtacc

SEQ ID NO: 961507 - DNA, 25 bp, Mus musculus
gtttgaaaggaattccagatggtca

SEQ ID NO: 961508 - DNA, 25 bp, Mus musculus
gtttgaaaggaattgcagatggtca

SEQ ID NO: 961509 - DNA, 25 bp, Mus musculus
gtttgaacagccccacgaagccgtc

SEQ ID NO: 961510 - DNA, 25 bp, Mus musculus
gtttgaacaggcccacgaagccgtc

SEQ ID NO: 961511 - DNA, 25 bp, Mus musculus
gtttgaaggaagagcggatatgtgg

SEQ ID NO: 961512 - DNA, 25 bp, Mus musculus
gtttgaaggaagaggggatatgtgg

SEQ ID NO: 961513 - DNA, 25 bp, Mus musculus
gtttgacaagatgcgggaagatgac

SEQ ID NO: 961514 - DNA, 25 bp, Mus musculus
gtttgacaagcatgggaatggttac

SEQ ID NO: 961515 - DNA, 25 bp, Mus musculus
gtttgacaaggatgggaatggttac

SEQ ID NO: 961516 - DNA, 25 bp, Mus musculus
gtttgacaagttgcgggaagatgac

SEQ ID NO: 961517 - DNA, 25 bp, Mus musculus
gtttgacataaacgagattgaagta

SEQ ID NO: 961518 - DNA, 25 bp, Mus musculus
gtttgacataaaggagattgaagta

SEQ ID NO: 961519 - DNA, 25 bp, Mus musculus
gtttgacatggcaacagaagttggt

SEQ ID NO: 961520 - DNA, 25 bp, Mus musculus
gtttgacatggctacagaagttggt

SEQ ID NO: 961521 - DNA, 25 bp, Mus musculus
gtttgactcgcacatccttgtggcg

SEQ ID NO: 961522 - DNA, 25 bp, Mus musculus
gtttgactcggacatccttgtggcg

SEQ ID NO: 961523 - DNA, 25 bp, Mus musculus
gtttgagaacaacacgaacctgagg

SEQ ID NO: 961524 - DNA, 25 bp, Mus musculus
gtttgagaacaacacgactccggga

SEQ ID NO: 961525 - DNA, 25 bp, Mus musculus
gtttgagaacaacaggaacctgagg

SEQ ID NO: 961526 - DNA, 25 bp, Mus musculus
gtttgagaacaacaggactccggga

SEQ ID NO: 961527 - DNA, 25 bp, Mus musculus
gtttgagaagaatgacatcagcaac

SEQ ID NO: 961528 - DNA, 25 bp, Mus musculus
gtttgagaagatgtgcaagagtgac

SEQ ID NO: 961529 - DNA, 25 bp, Mus musculus
gtttgagaagctatgcagcaatgac

SEQ ID NO: 961530 - DNA, 25 bp, Mus musculus
gtttgagaaggtatgcagcaatgac

SEQ ID NO: 961531 - DNA, 25 bp, Mus musculus
gtttgagaagtatgacatcagcaac

SEQ ID NO: 961532 - DNA, 25 bp, Mus musculus
gtttgagaagttgtgcaagagtgac

SEQ ID NO: 961533 - DNA, 25 bp, Mus musculus
gtttgagcagcaccaaaaagatgga

SEQ ID NO: 961534 - DNA, 25 bp, Mus musculus
gtttgagcagcagcaaaaagatgga

SEQ ID NO: 961535 - DNA, 25 bp, Mus musculus
gtttgagctaaaagaaatgctcacc

SEQ ID NO: 961536 - DNA, 25 bp, Mus musculus
gtttgagctaaatgaaatgctcacc

SEQ ID NO: 961537 - DNA, 25 bp, Mus musculus
gtttgagctggctgcgtttgactct

SEQ ID NO: 961538 - DNA, 25 bp, Mus musculus
gtttgagctggctgctgctggcatg

SEQ ID NO: 961539 - DNA, 25 bp, Mus musculus
gtttgagctggctgggtttgactct

SEQ ID NO: 961540 - DNA, 25 bp, Mus musculus
gtttgagctggctggtgctggcatg

SEQ ID NO: 961541 - DNA, 25 bp, Mus musculus
gtttgaggagcctcaacgcacagcg

SEQ ID NO: 961542 - DNA, 25 bp, Mus musculus
gtttgaggaggctcaacgcacagcg

SEQ ID NO: 961543 - DNA, 25 bp, Mus musculus
gtttgaggccagcttcttccatttg

SEQ ID NO: 961544 - DNA, 25 bp, Mus musculus
gtttgaggccaggttcttccatttg

SEQ ID NO: 961545 - DNA, 25 bp, Mus musculus
gtttgatgagcgccgcctgacagat

SEQ ID NO: 961546 - DNA, 25 bp, Mus musculus
gtttgatgagggccgcctgacagat

SEQ ID NO: 961547 - DNA, 25 bp, Mus musculus
gtttgatggcaacggtcatgtgggt

SEQ ID NO: 961548 - DNA, 25 bp, Mus musculus
gtttgatggcaacgtgctgtctgaa

SEQ ID NO: 961549 - DNA, 25 bp, Mus musculus
gtttgatggcaagggtcatgtgggt

SEQ ID NO: 961550 - DNA, 25 bp, Mus musculus
gtttgatggcaaggtgctgtctgaa

SEQ ID NO: 961551 - DNA, 25 bp, Mus musculus
gtttgcaagtcatgacattgtgctt

SEQ ID NO: 961552 - DNA, 25 bp, Mus musculus
gtttgcaagtcatgtcattgtgctt

SEQ ID NO: 961553 - DNA, 25 bp, Mus musculus
gtttgcaataatctctgaaccaatc

SEQ ID NO: 961554 - DNA, 25 bp, Mus musculus
gtttgcaataatgtctgaaccaatc

SEQ ID NO: 961555 - DNA, 25 bp, Mus musculus
gtttgcacagcttgtactccaggac

SEQ ID NO: 961556 - DNA, 25 bp, Mus musculus
gtttgcacagcttgtgttgcctgcc

SEQ ID NO: 961557 - DNA, 25 bp, Mus musculus
gtttgcacaggttgtactccaggac

SEQ ID NO: 961558 - DNA, 25 bp, Mus musculus
gtttgcacaggttgtgttgcctgcc

SEQ ID NO: 961559 - DNA, 25 bp, Mus musculus
gtttgcactgatctgtttacccgag

SEQ ID NO: 961560 - DNA, 25 bp, Mus musculus
gtttgcactgttctgtttacccgag

SEQ ID NO: 961561 - DNA, 25 bp, Mus musculus
gtttgcatgctacgagatgtacgac

SEQ ID NO: 961562 - DNA, 25 bp, Mus musculus
gtttgcatgctaggagatgtacgac

SEQ ID NO: 961563 - DNA, 25 bp, Mus musculus
gtttgcattccgcttgcttcccaga

SEQ ID NO: 961564 - DNA, 25 bp, Mus musculus
gtttgcattccggttgcttcccaga

SEQ ID NO: 961565 - DNA, 25 bp, Mus musculus
gtttgcatttagcaggactgacaaa

SEQ ID NO: 961566 - DNA, 25 bp, Mus musculus
gtttgcatttaggaggactgacaaa

SEQ ID NO: 961567 - DNA, 25 bp, Mus musculus
gtttgccagaagcaacctgaatgaa

SEQ ID NO: 961568 - DNA, 25 bp, Mus musculus
gtttgccagaaggaacctgaatgaa

SEQ ID NO: 961569 - DNA, 25 bp, Mus musculus
gtttgccaggccgacggaacaagat

SEQ ID NO: 961570 - DNA, 25 bp, Mus musculus
gtttgccagggcgacggaacaagat

SEQ ID NO: 961571 - DNA, 25 bp, Mus musculus
gtttgcccagagtctctgcctctct

SEQ ID NO: 961572 - DNA, 25 bp, Mus musculus
gtttgcccagtgtctctgcctctct

SEQ ID NO: 961573 - DNA, 25 bp, Mus musculus
gtttgccttacagcacggcatccct

SEQ ID NO: 961574 - DNA, 25 bp, Mus musculus
gtttgccttagagcacggcatccct

SEQ ID NO: 961575 - DNA, 25 bp, Mus musculus
gtttgcggttgaaaatggaagacaa

SEQ ID NO: 961576 - DNA, 25 bp, Mus musculus
gtttgcggttgataatggaagacaa

SEQ ID NO: 961577 - DNA, 25 bp, Mus musculus
gtttgcggttgatgaaaatggaaga

SEQ ID NO: 961578 - DNA, 25 bp, Mus musculus
gtttgcggttgatgtaaatggaaga

SEQ ID NO: 961579 - DNA, 25 bp, Mus musculus
gtttgctatgatctctttcattggg

SEQ ID NO: 961580 - DNA, 25 bp, Mus musculus
gtttgctatgttctctttcattggg

SEQ ID NO: 961581 - DNA, 25 bp, Mus musculus
gtttgctgctggaggtgccttactc

SEQ ID NO: 961582 - DNA, 25 bp, Mus musculus
gtttgctgctggtggtgccttactc

SEQ ID NO: 961583 - DNA, 25 bp, Mus musculus
gtttgctgtgggaaagtacattgag

SEQ ID NO: 961584 - DNA, 25 bp, Mus musculus
gtttgctgtgggaatgtacattgag

SEQ ID NO: 961585 - DNA, 25 bp, Mus musculus
gtttgcttcaagactttatatggag

SEQ ID NO: 961586 - DNA, 25 bp, Mus musculus
gtttgcttcatgactttatatggag

SEQ ID NO: 961587 - DNA, 25 bp, Mus musculus
gtttgctttgcagcatgggattcct

SEQ ID NO: 961588 - DNA, 25 bp, Mus musculus
gtttgctttggagcatgggattcct

SEQ ID NO: 961589 - DNA, 25 bp, Mus musculus
gtttggaaagccaagcaggccaaca

SEQ ID NO: 961590 - DNA, 25 bp, Mus musculus
gtttggaaaggcaagcaggccaaca

SEQ ID NO: 961591 - DNA, 25 bp, Mus musculus
gtttggacggagtgccggactcctg

SEQ ID NO: 961592 - DNA, 25 bp, Mus musculus
gtttggacggtgtgccggactcctg

SEQ ID NO: 961593 - DNA, 25 bp, Mus musculus
gtttggagagacatcatttcagctt

SEQ ID NO: 961594 - DNA, 25 bp, Mus musculus
gtttggagagagacatcatttcagc

SEQ ID NO: 961595 - DNA, 25 bp, Mus musculus
gtttggagagtcatcatttcagctt

SEQ ID NO: 961596 - DNA, 25 bp, Mus musculus
gtttggagagtgacatcatttcagc

SEQ ID NO: 961597 - DNA, 25 bp, Mus musculus
gtttggagatatgacacgaaagtag

SEQ ID NO: 961598 - DNA, 25 bp, Mus musculus
gtttggagatatgacgtactccatc

SEQ ID NO: 961599 - DNA, 25 bp, Mus musculus
gtttggagatatgagacgaaagtag

SEQ ID NO: 961600 - DNA, 25 bp, Mus musculus
gtttggagatatgaggtactccatc

SEQ ID NO: 961601 - DNA, 25 bp, Mus musculus
gtttggagtgctgtttgtggtgctg

SEQ ID NO: 961602 - DNA, 25 bp, Mus musculus
gtttggagtggtgtttgtggtgctg

SEQ ID NO: 961603 - DNA, 25 bp, Mus musculus
gtttggcaagcaagcagaacaagcc

SEQ ID NO: 961604 - DNA, 25 bp, Mus musculus
gtttggcaaggaagcagaacaagcc

SEQ ID NO: 961605 - DNA, 25 bp, Mus musculus
gtttggcgttcaactgaacataggt

SEQ ID NO: 961606 - DNA, 25 bp, Mus musculus
gtttggcgttcatctgaacataggt

SEQ ID NO: 961607 - DNA, 25 bp, Mus musculus
gtttggcttccgcttgccctatgct

SEQ ID NO: 961608 - DNA, 25 bp, Mus musculus
gtttggcttccggttgccctatgct

SEQ ID NO: 961609 - DNA, 25 bp, Mus musculus
gtttggggaaggaacaagatcaggt

SEQ ID NO: 961610 - DNA, 25 bp, Mus musculus
gtttggggaaggaagaagatcaggt

SEQ ID NO: 961611 - DNA, 25 bp, Mus musculus
gtttggggagattgaggccattgag

SEQ ID NO: 961612 - DNA, 25 bp, Mus musculus
gtttggggagtttgaggccattgag

SEQ ID NO: 961613 - DNA, 25 bp, Mus musculus
gtttggtaaaagccatggccatgca

SEQ ID NO: 961614 - DNA, 25 bp, Mus musculus
gtttggtaaaaggcatggccatgca

SEQ ID NO: 961615 - DNA, 25 bp, Mus musculus
gtttggtcagctggtacgtgggctg

SEQ ID NO: 961616 - DNA, 25 bp, Mus musculus
gtttggtcaggtggtacgtgggctg

SEQ ID NO: 961617 - DNA, 25 bp, Mus musculus
gtttggtggaatccatgcagatgtc

SEQ ID NO: 961618 - DNA, 25 bp, Mus musculus
gtttggtggaatgcatgcagatgtc

SEQ ID NO: 961619 - DNA, 25 bp, Mus musculus
gtttggttatgacgtctggcgggaa

SEQ ID NO: 961620 - DNA, 25 bp, Mus musculus
gtttggttatgaggtctggcgggaa

SEQ ID NO: 961621 - DNA, 25 bp, Mus musculus
gtttgtaaccatcaaaatcagaaaa

SEQ ID NO: 961622 - DNA, 25 bp, Mus musculus
gtttgtaaccatgaaaatcagaaaa

SEQ ID NO: 961623 - DNA, 25 bp, Mus musculus
gtttgtattgccttctcaaggatgc

SEQ ID NO: 961624 - DNA, 25 bp, Mus musculus
gtttgtattggcttctcaaggatgc

SEQ ID NO: 961625 - DNA, 25 bp, Mus musculus
gtttgtcagtgacctttctgtcagg

SEQ ID NO: 961626 - DNA, 25 bp, Mus musculus
gtttgtcagtgagctttctgtcagg

SEQ ID NO: 961627 - DNA, 25 bp, Mus musculus
gtttgtccgcagaaatctgtctttc

SEQ ID NO: 961628 - DNA, 25 bp, Mus musculus
gtttgtccgcagcaacctgaatgaa

SEQ ID NO: 961629 - DNA, 25 bp, Mus musculus
gtttgtccgcaggaacctgaatgaa

SEQ ID NO: 961630 - DNA, 25 bp, Mus musculus
gtttgtccgcagtaatctgtctttc

SEQ ID NO: 961631 - DNA, 25 bp, Mus musculus
gtttgtcgcactttatcttcaagcc

SEQ ID NO: 961632 - DNA, 25 bp, Mus musculus
gtttgtcgcagtttatcttcaagcc

SEQ ID NO: 961633 - DNA, 25 bp, Mus musculus
gtttgtcttgaacaacacccagtgc

SEQ ID NO: 961634 - DNA, 25 bp, Mus musculus
gtttgtcttgaagaacacccagtgc

SEQ ID NO: 961635 - DNA, 25 bp, Mus musculus
gtttgtgaagcgggctccagaaggt

SEQ ID NO: 961636 - DNA, 25 bp, Mus musculus
gtttgtgaagggggctccagaaggt

SEQ ID NO: 961637 - DNA, 25 bp, Mus musculus
gtttgtgagcctcccgctcatgctg

SEQ ID NO: 961638 - DNA, 25 bp, Mus musculus
gtttgtgagcctctttgtgggctgt

SEQ ID NO: 961639 - DNA, 25 bp, Mus musculus
gtttgtgagcctgccgctcatgctg

SEQ ID NO: 961640 - DNA, 25 bp, Mus musculus
gtttgtgagcctgtttgtgggctgt

SEQ ID NO: 961641 - DNA, 25 bp, Mus musculus
gtttgtgagtttcatgcagcctacc

SEQ ID NO: 961642 - DNA, 25 bp, Mus musculus
gtttgtgagtttctctttggaggcc

SEQ ID NO: 961643 - DNA, 25 bp, Mus musculus
gtttgtgagtttgatgcagcctacc

SEQ ID NO: 961644 - DNA, 25 bp, Mus musculus
gtttgtgagtttgtctttggaggcc

SEQ ID NO: 961645 - DNA, 25 bp, Mus musculus
gtttgtgcagatgctttattctccc

SEQ ID NO: 961646 - DNA, 25 bp, Mus musculus
gtttgtgcagccggccctggcccgt

SEQ ID NO: 961647 - DNA, 25 bp, Mus musculus
gtttgtgcaggcggccctggcccgt

SEQ ID NO: 961648 - DNA, 25 bp, Mus musculus
gtttgtgcagttgctttattctccc

SEQ ID NO: 961649 - DNA, 25 bp, Mus musculus
gtttgtgtgtgacacccccacagag

SEQ ID NO: 961650 - DNA, 25 bp, Mus musculus
gtttgtgtgtgacagccccacagag

SEQ ID NO: 961651 - DNA, 25 bp, Mus musculus
gtttgttcaaaacagcatgggctca

SEQ ID NO: 961652 - DNA, 25 bp, Mus musculus
gtttgttcaaaagagcatgggctca

SEQ ID NO: 961653 - DNA, 25 bp, Mus musculus
gtttgtttacagcaaagatgtagcg

SEQ ID NO: 961654 - DNA, 25 bp, Mus musculus
gtttgtttacaggaaagatgtagcg

SEQ ID NO: 961655 - DNA, 25 bp, Mus musculus
gtttgtttgcaattagtctcttcat

SEQ ID NO: 961656 - DNA, 25 bp, Mus musculus
gtttgtttgcaatttgtctcttcat

SEQ ID NO: 961657 - DNA, 25 bp, Mus musculus
gttttaagagagcatttaacagtgc

SEQ ID NO: 961658 - DNA, 25 bp, Mus musculus
gttttaagagagctggctttgcagc

SEQ ID NO: 961659 - DNA, 25 bp, Mus musculus
gttttaagagaggatttaacagtgc

SEQ ID NO: 961660 - DNA, 25 bp, Mus musculus
gttttaagagaggtggctttgcagc

SEQ ID NO: 961661 - DNA, 25 bp, Mus musculus
gttttacggagccacccatgagaag

SEQ ID NO: 961662 - DNA, 25 bp, Mus musculus
gttttacggagccagccatgagaag

SEQ ID NO: 961663 - DNA, 25 bp, Mus musculus
gttttactacaacgaagctgcccaa

SEQ ID NO: 961664 - DNA, 25 bp, Mus musculus
gttttactacaaggaagctgcccaa

SEQ ID NO: 961665 - DNA, 25 bp, Mus musculus
gttttagatgatcacagtggtaaga

SEQ ID NO: 961666 - DNA, 25 bp, Mus musculus
gttttagatgatcagagtggtaaga

SEQ ID NO: 961667 - DNA, 25 bp, Mus musculus
gttttagctatgaaaagtgggagat

SEQ ID NO: 961668 - DNA, 25 bp, Mus musculus
gttttagctatgtaaagtgggagat

SEQ ID NO: 961669 - DNA, 25 bp, Mus musculus
gttttaggaaagatataccgcattg

SEQ ID NO: 961670 - DNA, 25 bp, Mus musculus
gttttaggaatgatataccgcattg

SEQ ID NO: 961671 - DNA, 25 bp, Mus musculus
gttttaggtcgacaatccttagacg

SEQ ID NO: 961672 - DNA, 25 bp, Mus musculus
gttttaggtcgagaatccttagacg

SEQ ID NO: 961673 - DNA, 25 bp, Mus musculus
gttttataagagagcagtatttcaa

SEQ ID NO: 961674 - DNA, 25 bp, Mus musculus
gttttataagtgagcagtatttcaa

SEQ ID NO: 961675 - DNA, 25 bp, Mus musculus
gttttatcacatttccctggagcac

SEQ ID NO: 961676 - DNA, 25 bp, Mus musculus
gttttatcacttttccctggagcac

SEQ ID NO: 961677 - DNA, 25 bp, Mus musculus
gttttatgagatgtccagctcgccg

SEQ ID NO: 961678 - DNA, 25 bp, Mus musculus
gttttatgagttgtccagctcgccg

SEQ ID NO: 961679 - DNA, 25 bp, Mus musculus
gttttcacagcaactggtgactact

SEQ ID NO: 961680 - DNA, 25 bp, Mus musculus
gttttcacagcggccgatcaacagt

SEQ ID NO: 961681 - DNA, 25 bp, Mus musculus
gttttcacaggaactggtgactact

SEQ ID NO: 961682 - DNA, 25 bp, Mus musculus
gttttcacaggggccgatcaacagt

SEQ ID NO: 961683 - DNA, 25 bp, Mus musculus
gttttcacagtacgctattgcagac

SEQ ID NO: 961684 - DNA, 25 bp, Mus musculus
gttttcacagtaggctattgcagac

SEQ ID NO: 961685 - DNA, 25 bp, Mus musculus
gttttcattgagatctctgggctag

SEQ ID NO: 961686 - DNA, 25 bp, Mus musculus
gttttcattgtgatctctgggctag

SEQ ID NO: 961687 - DNA, 25 bp, Mus musculus
gttttcccagaaggcgtgtgctgaa

SEQ ID NO: 961688 - DNA, 25 bp, Mus musculus
gttttcccagaaggggtgtgctgaa

SEQ ID NO: 961689 - DNA, 25 bp, Mus musculus
gttttccctctacttgtgagcggcc

SEQ ID NO: 961690 - DNA, 25 bp, Mus musculus
gttttccctctagttgtgagcggcc

SEQ ID NO: 961691 - DNA, 25 bp, Mus musculus
gttttccgactgctgaccaaccgcg

SEQ ID NO: 961692 - DNA, 25 bp, Mus musculus
gttttccgactggtgaccaaccgcg

SEQ ID NO: 961693 - DNA, 25 bp, Mus musculus
gttttcctacagagagaacctggag

SEQ ID NO: 961694 - DNA, 25 bp, Mus musculus
gttttcctacagtgagaacctggag

SEQ ID NO: 961695 - DNA, 25 bp, Mus musculus
gttttcctggctctcggtcttgatg

SEQ ID NO: 961696 - DNA, 25 bp, Mus musculus
gttttcctgggtctcggtcttgatg

SEQ ID NO: 961697 - DNA, 25 bp, Mus musculus
gttttcggcactctgacatctccag

SEQ ID NO: 961698 - DNA, 25 bp, Mus musculus
gttttcggcactgtgacatctccag

SEQ ID NO: 961699 - DNA, 25 bp, Mus musculus
gttttcggggcgctgctgaatttca

SEQ ID NO: 961700 - DNA, 25 bp, Mus musculus
gttttcggggggctgctgaatttca

SEQ ID NO: 961701 - DNA, 25 bp, Mus musculus
gttttctatgaacgtattctacttc

SEQ ID NO: 961702 - DNA, 25 bp, Mus musculus
gttttctatgaaggtattctacttc

SEQ ID NO: 961703 - DNA, 25 bp, Mus musculus
gttttctatgcaaggcagtattgaa

SEQ ID NO: 961704 - DNA, 25 bp, Mus musculus
gttttctatggaaggcagtattgaa

SEQ ID NO: 961705 - DNA, 25 bp, Mus musculus
gttttctcagcaaattgggcttgca

SEQ ID NO: 961706 - DNA, 25 bp, Mus musculus
gttttctcaggaaattgggcttgca

SEQ ID NO: 961707 - DNA, 25 bp, Mus musculus
gttttctgccagattcaagaacctg

SEQ ID NO: 961708 - DNA, 25 bp, Mus musculus
gttttctgccagtttcaagaacctg

SEQ ID NO: 961709 - DNA, 25 bp, Mus musculus
gttttgcacaaacgtttgtggtgaa

SEQ ID NO: 961710 - DNA, 25 bp, Mus musculus
gttttgcacaaaggtttgtggtgaa

SEQ ID NO: 961711 - DNA, 25 bp, Mus musculus
gttttgccagatagctgatttggcc

SEQ ID NO: 961712 - DNA, 25 bp, Mus musculus
gttttgccagttagctgatttggcc

SEQ ID NO: 961713 - DNA, 25 bp, Mus musculus
gttttgcttaagcatggtgctgacg

SEQ ID NO: 961714 - DNA, 25 bp, Mus musculus
gttttgcttaaggatggtgctgacg

SEQ ID NO: 961715 - DNA, 25 bp, Mus musculus
gttttggatgtccacacaactacag

SEQ ID NO: 961716 - DNA, 25 bp, Mus musculus
gttttggatgtccagacaactacag

SEQ ID NO: 961717 - DNA, 25 bp, Mus musculus
gttttggcagggaattcacgcagcg

SEQ ID NO: 961718 - DNA, 25 bp, Mus musculus
gttttggcagggtattcacgcagcg

SEQ ID NO: 961719 - DNA, 25 bp, Mus musculus
gttttgtgcagacattaagcacatg

SEQ ID NO: 961720 - DNA, 25 bp, Mus musculus
gttttgtgcagagattaagcacatg

SEQ ID NO: 961721 - DNA, 25 bp, Mus musculus
gttttgttgcttacccagcactatg

SEQ ID NO: 961722 - DNA, 25 bp, Mus musculus
gttttgttgctttcccagcactatg

SEQ ID NO: 961723 - DNA, 25 bp, Mus musculus
gtttttaagcatcaaaaagaagatg

SEQ ID NO: 961724 - DNA, 25 bp, Mus musculus
gtttttaagcatgaaaaagaagatg

SEQ ID NO: 961725 - DNA, 25 bp, Mus musculus
gtttttaatgatcaggtccttctgt

SEQ ID NO: 961726 - DNA, 25 bp, Mus musculus
gtttttaatgatgaggtccttctgt

SEQ ID NO: 961727 - DNA, 25 bp, Mus musculus
gtttttacatcaaacgcaagaaatt

SEQ ID NO: 961728 - DNA, 25 bp, Mus musculus
gtttttacatcaaaggcaagaaatt

SEQ ID NO: 961729 - DNA, 25 bp, Mus musculus
gtttttcaagaatgaagtcagaggc

SEQ ID NO: 961730 - DNA, 25 bp, Mus musculus
gtttttcaagcatgtcactgatttt

SEQ ID NO: 961731 - DNA, 25 bp, Mus musculus
gtttttcaaggatgtcactgatttt

SEQ ID NO: 961732 - DNA, 25 bp, Mus musculus
gtttttcaagtatgaagtcagaggc

SEQ ID NO: 961733 - DNA, 25 bp, Mus musculus
gtttttcatacacataaaaattatt

SEQ ID NO: 961734 - DNA, 25 bp, Mus musculus
gtttttcatacagataaaaattatt

SEQ ID NO: 961735 - DNA, 25 bp, Mus musculus
gtttttcgatgacatggcggatcca

SEQ ID NO: 961736 - DNA, 25 bp, Mus musculus
gtttttcgatgacgctgaattgcat

SEQ ID NO: 961737 - DNA, 25 bp, Mus musculus
gtttttcgatgagatggcggatcca

SEQ ID NO: 961738 - DNA, 25 bp, Mus musculus
gtttttcgatgaggctgaattgcat

SEQ ID NO: 961739 - DNA, 25 bp, Mus musculus
gtttttgagacgcgtgctcggcacc

SEQ ID NO: 961740 - DNA, 25 bp, Mus musculus
gtttttgagacgggtgctcggcacc

SEQ ID NO: 961741 - DNA, 25 bp, Mus musculus
gtttttgcagaatgtgtgctgtgtt

SEQ ID NO: 961742 - DNA, 25 bp, Mus musculus
gtttttgcagtatgtgtgctgtgtt

SEQ ID NO: 961743 - DNA, 25 bp, Mus musculus
gtttttgctgatgggaacttttggg

SEQ ID NO: 961744 - DNA, 25 bp, Mus musculus
gtttttgctgatttctaagttattt

SEQ ID NO: 961745 - DNA, 25 bp, Mus musculus
gtttttgctgttgggaacttttggg

SEQ ID NO: 961746 - DNA, 25 bp, Mus musculus
gtttttgctgttttctaagttattt

SEQ ID NO: 961747 - DNA, 25 bp, Mus musculus
gttttttgaaattggcagtcatgaa

SEQ ID NO: 961748 - DNA, 25 bp, Mus musculus
gttttttgaatttggcagtcatgaa

SEQ ID NO: 961749 - DNA, 25 bp, Mus musculus
taaaaaagaatacatgtgccaactg

SEQ ID NO: 961750 - DNA, 25 bp, Mus musculus
taaaaaagaatagatgtgccaactg

SEQ ID NO: 961751 - DNA, 25 bp, Mus musculus
taaaaacaatccccactatgcagtc

SEQ ID NO: 961752 - DNA, 25 bp, Mus musculus
taaaaacaatgcccactatgcagtc

SEQ ID NO: 961753 - DNA, 25 bp, Mus musculus
taaaaactggagccctcagctgctc

SEQ ID NO: 961754 - DNA, 25 bp, Mus musculus
taaaaactggaggcctcagctgctc

SEQ ID NO: 961755 - DNA, 25 bp, Mus musculus
taaaaagagggacgtgctgtcagcc

SEQ ID NO: 961756 - DNA, 25 bp, Mus musculus
taaaaagagggaggtgctgtcagcc

SEQ ID NO: 961757 - DNA, 25 bp, Mus musculus
taaaaatctaaagtcgattggtctt

SEQ ID NO: 961758 - DNA, 25 bp, Mus musculus
taaaaatctaaagtggattggtctt

SEQ ID NO: 961759 - DNA, 25 bp, Mus musculus
taaaaatgcaccaacaattctcttg

SEQ ID NO: 961760 - DNA, 25 bp, Mus musculus
taaaaatgcagcaacaattctcttg

SEQ ID NO: 961761 - DNA, 25 bp, Mus musculus
taaaaatggaagcaaatgcaagtcc

SEQ ID NO: 961762 - DNA, 25 bp, Mus musculus
taaaaatggaaggaaatgcaagtcc

SEQ ID NO: 961763 - DNA, 25 bp, Mus musculus
taaaaatgtgaatcaagaagtggtg

SEQ ID NO: 961764 - DNA, 25 bp, Mus musculus
taaaaatgtgtatcaagaagtggtg

SEQ ID NO: 961765 - DNA, 25 bp, Mus musculus
taaaaattgctccacgaggaatggg

SEQ ID NO: 961766 - DNA, 25 bp, Mus musculus
taaaaattgctccaggaggaatggg

SEQ ID NO: 961767 - DNA, 25 bp, Mus musculus
taaaacaaagatgtctcatttccgt

SEQ ID NO: 961768 - DNA, 25 bp, Mus musculus
taaaacaaagttgtctcatttccgt

SEQ ID NO: 961769 - DNA, 25 bp, Mus musculus
taaaacagagccgtgtgacaggctt

SEQ ID NO: 961770 - DNA, 25 bp, Mus musculus
taaaacagaggcgtgtgacaggctt

SEQ ID NO: 961771 - DNA, 25 bp, Mus musculus
taaaactatagacgtgccttggagc

SEQ ID NO: 961772 - DNA, 25 bp, Mus musculus
taaaactatagaggtgccttggagc

SEQ ID NO: 961773 - DNA, 25 bp, Mus musculus
taaaactctaatcggtcaggctcct

SEQ ID NO: 961774 - DNA, 25 bp, Mus musculus
taaaactctaatgggtcaggctcct

SEQ ID NO: 961775 - DNA, 25 bp, Mus musculus
taaaactgccaacgtcacccctggc

SEQ ID NO: 961776 - DNA, 25 bp, Mus musculus
taaaactgccaaggtcacccctggc

SEQ ID NO: 961777 - DNA, 25 bp, Mus musculus
taaaagatgaatatcaaaaggtgga

SEQ ID NO: 961778 - DNA, 25 bp, Mus musculus
taaaagatgaatatgaaaaggtgga

SEQ ID NO: 961779 - DNA, 25 bp, Mus musculus
taaaagcactaaaaggtatatttga

SEQ ID NO: 961780 - DNA, 25 bp, Mus musculus
taaaagcacttaaaggtatatttga

SEQ ID NO: 961781 - DNA, 25 bp, Mus musculus
taaaagcatcagatgtgactgtgag

SEQ ID NO: 961782 - DNA, 25 bp, Mus musculus
taaaagcatcagccaagaggcaaag

SEQ ID NO: 961783 - DNA, 25 bp, Mus musculus
taaaagcatcaggcaagaggcaaag

SEQ ID NO: 961784 - DNA, 25 bp, Mus musculus
taaaagcatcagttgtgactgtgag

SEQ ID NO: 961785 - DNA, 25 bp, Mus musculus
taaaagctaaacaagagcatgaagg

SEQ ID NO: 961786 - DNA, 25 bp, Mus musculus
taaaagctaaactagagcatgaagg

SEQ ID NO: 961787 - DNA, 25 bp, Mus musculus
taaaaggaagagagaattcaacagt

SEQ ID NO: 961788 - DNA, 25 bp, Mus musculus
taaaaggaagcagagagaattcaac

SEQ ID NO: 961789 - DNA, 25 bp, Mus musculus
taaaaggaaggagagagaattcaac

SEQ ID NO: 961790 - DNA, 25 bp, Mus musculus
taaaaggaagtgagaattcaacagt

SEQ ID NO: 961791 - DNA, 25 bp, Mus musculus
taaaagtgctgaagtgacttcatta

SEQ ID NO: 961792 - DNA, 25 bp, Mus musculus
taaaagtgctgatgtgacttcatta

SEQ ID NO: 961793 - DNA, 25 bp, Mus musculus
taaaatacagcgtatgcatgcacaa

SEQ ID NO: 961794 - DNA, 25 bp, Mus musculus
taaaatacagggtatgcatgcacaa

SEQ ID NO: 961795 - DNA, 25 bp, Mus musculus
taaaatcagcaacagcccagatggt

SEQ ID NO: 961796 - DNA, 25 bp, Mus musculus
taaaatcagcaagagcccagatggt

SEQ ID NO: 961797 - DNA, 25 bp, Mus musculus
taaaatgaggcacgaacatcgaaat

SEQ ID NO: 961798 - DNA, 25 bp, Mus musculus
taaaatgaggcaggaacatcgaaat

SEQ ID NO: 961799 - DNA, 25 bp, Mus musculus
taaaatggagagactggatgtggat

SEQ ID NO: 961800 - DNA, 25 bp, Mus musculus
taaaatggagagaggtaagaagtat

SEQ ID NO: 961801 - DNA, 25 bp, Mus musculus
taaaatggagagtctggatgtggat

SEQ ID NO: 961802 - DNA, 25 bp, Mus musculus
taaaatggagagtggtaagaagtat

SEQ ID NO: 961803 - DNA, 25 bp, Mus musculus
taaaatgtgaagcctgtggattaaa

SEQ ID NO: 961804 - DNA, 25 bp, Mus musculus
taaaatgtgaaggctgtggattaaa

SEQ ID NO: 961805 - DNA, 25 bp, Mus musculus
taaaatgttacacatgaaatgccag

SEQ ID NO: 961806 - DNA, 25 bp, Mus musculus
taaaatgttacagatgaaatgccag

SEQ ID NO: 961807 - DNA, 25 bp, Mus musculus
taaaattaagcagctgacaagtatt

SEQ ID NO: 961808 - DNA, 25 bp, Mus musculus
taaaattaaggagctgacaagtatt

SEQ ID NO: 961809 - DNA, 25 bp, Mus musculus
taaaattattcacgctaatggctac

SEQ ID NO: 961810 - DNA, 25 bp, Mus musculus
taaaattattcaggctaatggctac

SEQ ID NO: 961811 - DNA, 25 bp, Mus musculus
taaaattcaacacgctaaaccggct

SEQ ID NO: 961812 - DNA, 25 bp, Mus musculus
taaaattcaacaggctaaaccggct

SEQ ID NO: 961813 - DNA, 25 bp, Mus musculus
taaaattctcattaagctgtttgac

SEQ ID NO: 961814 - DNA, 25 bp, Mus musculus
taaaattctcattatgctgtttgac

SEQ ID NO: 961815 - DNA, 25 bp, Mus musculus
taaaattgacaacgattttctacaa

SEQ ID NO: 961816 - DNA, 25 bp, Mus musculus
taaaattgacaaggattttctacaa

SEQ ID NO: 961817 - DNA, 25 bp, Mus musculus
taaacaaaaaatgacaactggctca

SEQ ID NO: 961818 - DNA, 25 bp, Mus musculus
taaacaaaaaatgagaactggctca

SEQ ID NO: 961819 - DNA, 25 bp, Mus musculus
taaacaacctagagcttcaggatct

SEQ ID NO: 961820 - DNA, 25 bp, Mus musculus
taaacaacctagtgcttcaggatct

SEQ ID NO: 961821 - DNA, 25 bp, Mus musculus
taaacactatatttatgtggttcga

SEQ ID NO: 961822 - DNA, 25 bp, Mus musculus
taaacactatttttatgtggttcga

SEQ ID NO: 961823 - DNA, 25 bp, Mus musculus
taaacactctacaggatgactggaa

SEQ ID NO: 961824 - DNA, 25 bp, Mus musculus
taaacactctactggatgactggaa

SEQ ID NO: 961825 - DNA, 25 bp, Mus musculus
taaacactttgcaaaggcaaaatca

SEQ ID NO: 961826 - DNA, 25 bp, Mus musculus
taaacactttgcaatggcaaaatca

SEQ ID NO: 961827 - DNA, 25 bp, Mus musculus
taaacagctgaacgtgtgggatgtg

SEQ ID NO: 961828 - DNA, 25 bp, Mus musculus
taaacagctgaaggtgtgggatgtg

SEQ ID NO: 961829 - DNA, 25 bp, Mus musculus
taaacatcggtacacgacagctttg

SEQ ID NO: 961830 - DNA, 25 bp, Mus musculus
taaacatcggtacactggcaggaca

SEQ ID NO: 961831 - DNA, 25 bp, Mus musculus
taaacatcggtacaggacagctttg

SEQ ID NO: 961832 - DNA, 25 bp, Mus musculus
taaacatcggtacagtggcaggaca

SEQ ID NO: 961833 - DNA, 25 bp, Mus musculus
taaacatcttgacatcttcaacttt

SEQ ID NO: 961834 - DNA, 25 bp, Mus musculus
taaacatcttgagatcttcaacttt

SEQ ID NO: 961835 - DNA, 25 bp, Mus musculus
taaacattttcaaatctggaggcta

SEQ ID NO: 961836 - DNA, 25 bp, Mus musculus
taaacattttcatatctggaggcta

SEQ ID NO: 961837 - DNA, 25 bp, Mus musculus
taaaccacaacactggggacaaatg

SEQ ID NO: 961838 - DNA, 25 bp, Mus musculus
taaaccacaagactggggacaaatg

SEQ ID NO: 961839 - DNA, 25 bp, Mus musculus
taaaccatctgaaacctgggttgca

SEQ ID NO: 961840 - DNA, 25 bp, Mus musculus
taaaccatctgaaagctgggttgca

SEQ ID NO: 961841 - DNA, 25 bp, Mus musculus
taaaccccacgcatgccccacttgt

SEQ ID NO: 961842 - DNA, 25 bp, Mus musculus
taaaccccacgcttgccccacttgt

SEQ ID NO: 961843 - DNA, 25 bp, Mus musculus
taaacctctgaaacaccctgaagaa

SEQ ID NO: 961844 - DNA, 25 bp, Mus musculus
taaacctctgaaactccctgaagaa

SEQ ID NO: 961845 - DNA, 25 bp, Mus musculus
taaactaaagattgcgcagctgtgc

SEQ ID NO: 961846 - DNA, 25 bp, Mus musculus
taaactaaagtttgcgcagctgtgc

SEQ ID NO: 961847 - DNA, 25 bp, Mus musculus
taaactcaagccaggaaccatgatt

SEQ ID NO: 961848 - DNA, 25 bp, Mus musculus
taaactcaagcgctcgggccatcaa

SEQ ID NO: 961849 - DNA, 25 bp, Mus musculus
taaactcaaggacgcagagacccgt

SEQ ID NO: 961850 - DNA, 25 bp, Mus musculus
taaactcaaggaggcagagacccgt

SEQ ID NO: 961851 - DNA, 25 bp, Mus musculus
taaactcaaggcaggaaccatgatt

SEQ ID NO: 961852 - DNA, 25 bp, Mus musculus
taaactcaagggctcgggccatcaa

SEQ ID NO: 961853 - DNA, 25 bp, Mus musculus
taaactctcaccaaaatgtgagcgt

SEQ ID NO: 961854 - DNA, 25 bp, Mus musculus
taaactctcacctaaatgtgagcgt

SEQ ID NO: 961855 - DNA, 25 bp, Mus musculus
taaactgaaatgctgtttgcgagta

SEQ ID NO: 961856 - DNA, 25 bp, Mus musculus
taaactgaaatggtgtttgcgagta

SEQ ID NO: 961857 - DNA, 25 bp, Mus musculus
taaactggataacactgcctccgga

SEQ ID NO: 961858 - DNA, 25 bp, Mus musculus
taaactggataacagtgcctccgga

SEQ ID NO: 961859 - DNA, 25 bp, Mus musculus
taaacttctcccagaatacccaggc

SEQ ID NO: 961860 - DNA, 25 bp, Mus musculus
taaacttctcccagtatacccaggc

SEQ ID NO: 961861 - DNA, 25 bp, Mus musculus
taaactttcttccatgatagagtct

SEQ ID NO: 961862 - DNA, 25 bp, Mus musculus
taaactttcttcgatgatagagtct

SEQ ID NO: 961863 - DNA, 25 bp, Mus musculus
taaactttgtcacttgcactaagaa

SEQ ID NO: 961864 - DNA, 25 bp, Mus musculus
taaactttgtgacttgcactaagaa

SEQ ID NO: 961865 - DNA, 25 bp, Mus musculus
taaagaaaagctgaaagcaatggaa

SEQ ID NO: 961866 - DNA, 25 bp, Mus musculus
taaagaaaaggtgaaagcaatggaa

SEQ ID NO: 961867 - DNA, 25 bp, Mus musculus
taaagaaaatccagcgttcctgctt

SEQ ID NO: 961868 - DNA, 25 bp, Mus musculus
taaagaaaatgcagcgttcctgctt

SEQ ID NO: 961869 - DNA, 25 bp, Mus musculus
taaagaaacgactggtatagtgagt

SEQ ID NO: 961870 - DNA, 25 bp, Mus musculus
taaagaaacgtctggtatagtgagt

SEQ ID NO: 961871 - DNA, 25 bp, Mus musculus
taaagaagccagcccctctttgctg

SEQ ID NO: 961872 - DNA, 25 bp, Mus musculus
taaagaagccaggccctctttgctg

SEQ ID NO: 961873 - DNA, 25 bp, Mus musculus
taaagaatgaagcaataacagcctt

SEQ ID NO: 961874 - DNA, 25 bp, Mus musculus
taaagaatgaaggaataacagcctt

SEQ ID NO: 961875 - DNA, 25 bp, Mus musculus
taaagacaccacagtgctacaagga

SEQ ID NO: 961876 - DNA, 25 bp, Mus musculus
taaagacacctcagtgctacaagga

SEQ ID NO: 961877 - DNA, 25 bp, Mus musculus
taaagacagactcgctagatggcaa

SEQ ID NO: 961878 - DNA, 25 bp, Mus musculus
taaagacagactggctagatggcaa

SEQ ID NO: 961879 - DNA, 25 bp, Mus musculus
taaagaccagcagtcttgccagaac

SEQ ID NO: 961880 - DNA, 25 bp, Mus musculus
taaagaccaggagtcttgccagaac

SEQ ID NO: 961881 - DNA, 25 bp, Mus musculus
taaagaccctgcagcgagagagaat

SEQ ID NO: 961882 - DNA, 25 bp, Mus musculus
taaagaccctgcagggagagagaat

SEQ ID NO: 961883 - DNA, 25 bp, Mus musculus
taaagagaagaccaacttctccctg

SEQ ID NO: 961884 - DNA, 25 bp, Mus musculus
taaagagaagactttcaagaacttt

SEQ ID NO: 961885 - DNA, 25 bp, Mus musculus
taaagagaagtccaacttctccctg

SEQ ID NO: 961886 - DNA, 25 bp, Mus musculus
taaagagaagtctttcaagaacttt

SEQ ID NO: 961887 - DNA, 25 bp, Mus musculus
taaagagcagctgtcacaactgctg

SEQ ID NO: 961888 - DNA, 25 bp, Mus musculus
taaagagcaggtgtcacaactgctg

SEQ ID NO: 961889 - DNA, 25 bp, Mus musculus
taaagaggctggcttcctcatgggt

SEQ ID NO: 961890 - DNA, 25 bp, Mus musculus
taaagaggctgggttcctcatgggt

SEQ ID NO: 961891 - DNA, 25 bp, Mus musculus
taaagagtattcacaaatgcaacaa

SEQ ID NO: 961892 - DNA, 25 bp, Mus musculus
taaagagtattctcaaatgcaacaa

SEQ ID NO: 961893 - DNA, 25 bp, Mus musculus
taaagataataactttcacaagaag

SEQ ID NO: 961894 - DNA, 25 bp, Mus musculus
taaagataataagtttcacaagaag

SEQ ID NO: 961895 - DNA, 25 bp, Mus musculus
taaagatatgagtgaagacaatgag

SEQ ID NO: 961896 - DNA, 25 bp, Mus musculus
taaagatatgtgtgaagacaatgag

SEQ ID NO: 961897 - DNA, 25 bp, Mus musculus
taaagatgacccaggttggtctcct

SEQ ID NO: 961898 - DNA, 25 bp, Mus musculus
taaagatgacgcaggttggtctcct

SEQ ID NO: 961899 - DNA, 25 bp, Mus musculus
taaagatgagccttccgtgtacaag

SEQ ID NO: 961900 - DNA, 25 bp, Mus musculus
taaagatgaggcttccgtgtacaag

SEQ ID NO: 961901 - DNA, 25 bp, Mus musculus
taaagattcagacggctctggaact

SEQ ID NO: 961902 - DNA, 25 bp, Mus musculus
taaagattcagagggctctggaact

SEQ ID NO: 961903 - DNA, 25 bp, Mus musculus
taaagcagaggacactctaacacgt

SEQ ID NO: 961904 - DNA, 25 bp, Mus musculus
taaagcagaggagactctaacacgt

SEQ ID NO: 961905 - DNA, 25 bp, Mus musculus
taaagcatgactctcgtgatcaaga

SEQ ID NO: 961906 - DNA, 25 bp, Mus musculus
taaagcatgactctggtgatcaaga

SEQ ID NO: 961907 - DNA, 25 bp, Mus musculus
taaagccaacatcaagaaactaggg

SEQ ID NO: 961908 - DNA, 25 bp, Mus musculus
taaagccaacatcatgaaactaggg

SEQ ID NO: 961909 - DNA, 25 bp, Mus musculus
taaagccaagcgccattctcttagt

SEQ ID NO: 961910 - DNA, 25 bp, Mus musculus
taaagccaagctgcagcagctagtg

SEQ ID NO: 961911 - DNA, 25 bp, Mus musculus
taaagccaagggccattctcttagt

SEQ ID NO: 961912 - DNA, 25 bp, Mus musculus
taaagccaaggtgcagcagctagtg

SEQ ID NO: 961913 - DNA, 25 bp, Mus musculus
taaagccaggagcagcaggtggatg

SEQ ID NO: 961914 - DNA, 25 bp, Mus musculus
taaagccaggagcaggtggatggat

SEQ ID NO: 961915 - DNA, 25 bp, Mus musculus
taaagccaggaggagcaggtggatg

SEQ ID NO: 961916 - DNA, 25 bp, Mus musculus
taaagccaggaggaggtggatggat

SEQ ID NO: 961917 - DNA, 25 bp, Mus musculus
taaagccatgaacatccgagtctcc

SEQ ID NO: 961918 - DNA, 25 bp, Mus musculus
taaagccatgtacatccgagtctcc

SEQ ID NO: 961919 - DNA, 25 bp, Mus musculus
taaagcccataaccctcttggcttc

SEQ ID NO: 961920 - DNA, 25 bp, Mus musculus
taaagcccataagcctcttggcttc

SEQ ID NO: 961921 - DNA, 25 bp, Mus musculus
taaaggaccgagcattgaagtgagt

SEQ ID NO: 961922 - DNA, 25 bp, Mus musculus
taaaggaccgaggattgaagtgagt

SEQ ID NO: 961923 - DNA, 25 bp, Mus musculus
taaaggacctttcatcaattctgag

SEQ ID NO: 961924 - DNA, 25 bp, Mus musculus
taaaggacctttgatcaattctgag

SEQ ID NO: 961925 - DNA, 25 bp, Mus musculus
taaaggacgacccacgtattctcat

SEQ ID NO: 961926 - DNA, 25 bp, Mus musculus
taaaggacgacccaggtattctcat

SEQ ID NO: 961927 - DNA, 25 bp, Mus musculus
taaaggacttcactcgaccttcagg

SEQ ID NO: 961928 - DNA, 25 bp, Mus musculus
taaaggacttcactggaccttcagg

SEQ ID NO: 961929 - DNA, 25 bp, Mus musculus
taaaggagacagcggtgtaccaggc

SEQ ID NO: 961930 - DNA, 25 bp, Mus musculus
taaaggagacaggggtgtaccaggc

SEQ ID NO: 961931 - DNA, 25 bp, Mus musculus
taaaggcacttccgacagctcctca

SEQ ID NO: 961932 - DNA, 25 bp, Mus musculus
taaaggcacttcggacagctcctca

SEQ ID NO: 961933 - DNA, 25 bp, Mus musculus
taaaggcgagaaatcagagaaacgc

SEQ ID NO: 961934 - DNA, 25 bp, Mus musculus
taaaggcgagaaatcgaaacagctg

SEQ ID NO: 961935 - DNA, 25 bp, Mus musculus
taaaggcgagaaatgagagaaacgc

SEQ ID NO: 961936 - DNA, 25 bp, Mus musculus
taaaggcgagaaatggaaacagctg

SEQ ID NO: 961937 - DNA, 25 bp, Mus musculus
taaagggtcacaaaacgcttggagt

SEQ ID NO: 961938 - DNA, 25 bp, Mus musculus
taaagggtcagaaaacgcttggagt

SEQ ID NO: 961939 - DNA, 25 bp, Mus musculus
taaagtcatcagcgatgccagagag

SEQ ID NO: 961940 - DNA, 25 bp, Mus musculus
taaagtcatcagggatgccagagag

SEQ ID NO: 961941 - DNA, 25 bp, Mus musculus
taaagtcatgcacgtcaagaatttt

SEQ ID NO: 961942 - DNA, 25 bp, Mus musculus
taaagtcatgcaggtcaagaatttt

SEQ ID NO: 961943 - DNA, 25 bp, Mus musculus
taaagtgaacagcccatggcgcagg

SEQ ID NO: 961944 - DNA, 25 bp, Mus musculus
taaagtgaacagctgccttcttcac

SEQ ID NO: 961945 - DNA, 25 bp, Mus musculus
taaagtgaacaggccatggcgcagg

SEQ ID NO: 961946 - DNA, 25 bp, Mus musculus
taaagtgaacaggtgccttcttcac

SEQ ID NO: 961947 - DNA, 25 bp, Mus musculus
taaagtgaagaccaccacagaaagc

SEQ ID NO: 961948 - DNA, 25 bp, Mus musculus
taaagtgaagacgctgactgggaag

SEQ ID NO: 961949 - DNA, 25 bp, Mus musculus
taaagtgaagtccaccacagaaagc

SEQ ID NO: 961950 - DNA, 25 bp, Mus musculus
taaagtgaagtcgctgactgggaag

SEQ ID NO: 961951 - DNA, 25 bp, Mus musculus
taaagtgcgcaccgcacccctgaat

SEQ ID NO: 961952 - DNA, 25 bp, Mus musculus
taaagtgcgcacggcacccctgaat

SEQ ID NO: 961953 - DNA, 25 bp, Mus musculus
taaagtgctaaacgactgttgtgta

SEQ ID NO: 961954 - DNA, 25 bp, Mus musculus
taaagtgctaaaggactgttgtgta

SEQ ID NO: 961955 - DNA, 25 bp, Mus musculus
taaagtggagcgtggctgtatcact

SEQ ID NO: 961956 - DNA, 25 bp, Mus musculus
taaagtggagggtggctgtatcact

SEQ ID NO: 961957 - DNA, 25 bp, Mus musculus
taaagtgtgaagattgtggcatgaa

SEQ ID NO: 961958 - DNA, 25 bp, Mus musculus
taaagtgtgaagtttgtggcatgaa

SEQ ID NO: 961959 - DNA, 25 bp, Mus musculus
taaagttcacctcctggctattata

SEQ ID NO: 961960 - DNA, 25 bp, Mus musculus
taaagttcacgtcctggctattata

SEQ ID NO: 961961 - DNA, 25 bp, Mus musculus
taaatcacatcacgtgacagagtta

SEQ ID NO: 961962 - DNA, 25 bp, Mus musculus
taaatcacatcaggtgacagagtta

SEQ ID NO: 961963 - DNA, 25 bp, Mus musculus
taaatcatcaaaaacacattcaggt

SEQ ID NO: 961964 - DNA, 25 bp, Mus musculus
taaatcatcaaaaagacattcaggt

SEQ ID NO: 961965 - DNA, 25 bp, Mus musculus
taaatccatgaacggcttaggcact

SEQ ID NO: 961966 - DNA, 25 bp, Mus musculus
taaatccatgaagggcttaggcact

SEQ ID NO: 961967 - DNA, 25 bp, Mus musculus
taaatcccagattggtgccttgcca

SEQ ID NO: 961968 - DNA, 25 bp, Mus musculus
taaatcccagtttggtgccttgcca

SEQ ID NO: 961969 - DNA, 25 bp, Mus musculus
taaatctcaaccagctgaaagacaa

SEQ ID NO: 961970 - DNA, 25 bp, Mus musculus
taaatctcaacctgctgaaagacaa

SEQ ID NO: 961971 - DNA, 25 bp, Mus musculus
taaatctctaaaacagaagcacctt

SEQ ID NO: 961972 - DNA, 25 bp, Mus musculus
taaatctctaaaacatctatcatcc

SEQ ID NO: 961973 - DNA, 25 bp, Mus musculus
taaatctctaaaactgaagcacctt

SEQ ID NO: 961974 - DNA, 25 bp, Mus musculus
taaatctctaaaacttctatcatcc

SEQ ID NO: 961975 - DNA, 25 bp, Mus musculus
taaatgagagcactgcctgggtgca

SEQ ID NO: 961976 - DNA, 25 bp, Mus musculus
taaatgagaggactgcctgggtgca

SEQ ID NO: 961977 - DNA, 25 bp, Mus musculus
taaatgatgcagagaacctctcatc

SEQ ID NO: 961978 - DNA, 25 bp, Mus musculus
taaatgatgcagtgaacctctcatc

SEQ ID NO: 961979 - DNA, 25 bp, Mus musculus
taaatgatgtatgtcgcactggctg

SEQ ID NO: 961980 - DNA, 25 bp, Mus musculus
taaatgatgtttgtcgcactggctg

SEQ ID NO: 961981 - DNA, 25 bp, Mus musculus
taaatgcttactcattgagaaaaat

SEQ ID NO: 961982 - DNA, 25 bp, Mus musculus
taaatgcttagtcattgagaaaaat

SEQ ID NO: 961983 - DNA, 25 bp, Mus musculus
taaatggaagccatacgatgcgacc

SEQ ID NO: 961984 - DNA, 25 bp, Mus musculus
taaatggaaggcatacgatgcgacc

SEQ ID NO: 961985 - DNA, 25 bp, Mus musculus
taaatgggatgaacaaatcattttt

SEQ ID NO: 961986 - DNA, 25 bp, Mus musculus
taaatgggatgaactaatcattttt

SEQ ID NO: 961987 - DNA, 25 bp, Mus musculus
taaatgtaagaatgttgctgaagaa

SEQ ID NO: 961988 - DNA, 25 bp, Mus musculus
taaatgtaagtatgttgctgaagaa

SEQ ID NO: 961989 - DNA, 25 bp, Mus musculus
taaatgtgaaattgaacacaaggtc

SEQ ID NO: 961990 - DNA, 25 bp, Mus musculus
taaatgtgaatttgaacacaaggtc

SEQ ID NO: 961991 - DNA, 25 bp, Mus musculus
taaatgtgacagcgacttgtcactc

SEQ ID NO: 961992 - DNA, 25 bp, Mus musculus
taaatgtgacagggacttgtcactc

SEQ ID NO: 961993 - DNA, 25 bp, Mus musculus
taaattctgatgaattaaaaatcac

SEQ ID NO: 961994 - DNA, 25 bp, Mus musculus
taaattctgatgtattaaaaatcac

SEQ ID NO: 961995 - DNA, 25 bp, Mus musculus
taaattgctcaacagacattttaag

SEQ ID NO: 961996 - DNA, 25 bp, Mus musculus
taaattgctcaacagtcctaaacct

SEQ ID NO: 961997 - DNA, 25 bp, Mus musculus
taaattgctcaagagacattttaag

SEQ ID NO: 961998 - DNA, 25 bp, Mus musculus
taaattgctcaagagtcctaaacct

SEQ ID NO: 961999 - DNA, 25 bp, Mus musculus
taaatttaagaatgcagtactgttt

SEQ ID NO: 962000 - DNA, 25 bp, Mus musculus
taaatttaagtatgcagtactgttt

SEQ ID NO: 962001 - DNA, 25 bp, Mus musculus
taaatttagacacattgtttccgca

SEQ ID NO: 962002 - DNA, 25 bp, Mus musculus
taaatttagacagattgtttccgca

SEQ ID NO: 962003 - DNA, 25 bp, Mus musculus
taaatttgaagacatcaccagtgta

SEQ ID NO: 962004 - DNA, 25 bp, Mus musculus
taaatttgaagagatcaccagtgta

SEQ ID NO: 962005 - DNA, 25 bp, Mus musculus
taaatttgcaaaatcgttcattccc

SEQ ID NO: 962006 - DNA, 25 bp, Mus musculus
taaatttgcaaattcgttcattccc

SEQ ID NO: 962007 - DNA, 25 bp, Mus musculus
taaatttttgagatgcgatgatgac

SEQ ID NO: 962008 - DNA, 25 bp, Mus musculus
taaatttttgagttgcgatgatgac

SEQ ID NO: 962009 - DNA, 25 bp, Mus musculus
taacaaactgcatgcagagaatgca

SEQ ID NO: 962010 - DNA, 25 bp, Mus musculus
taacaaactggatgcagagaatgca

SEQ ID NO: 962011 - DNA, 25 bp, Mus musculus
taacaaatagaacacaggatacaga

SEQ ID NO: 962012 - DNA, 25 bp, Mus musculus
taacaaatagtacacaggatacaga

SEQ ID NO: 962013 - DNA, 25 bp, Mus musculus
taacaaatgtcgacctaagagggaa

SEQ ID NO: 962014 - DNA, 25 bp, Mus musculus
taacaaatgtggacctaagagggaa

SEQ ID NO: 962015 - DNA, 25 bp, Mus musculus
taacaactgataaacatcccaagga

SEQ ID NO: 962016 - DNA, 25 bp, Mus musculus
taacaactgataaagatcccaagga

SEQ ID NO: 962017 - DNA, 25 bp, Mus musculus
taacaagaatcaatcatacagcagc

SEQ ID NO: 962018 - DNA, 25 bp, Mus musculus
taacaagaatcaatgatacagcagc

SEQ ID NO: 962019 - DNA, 25 bp, Mus musculus
taacaagactacaatgcttctctcc

SEQ ID NO: 962020 - DNA, 25 bp, Mus musculus
taacaagactaccaagctccacttc

SEQ ID NO: 962021 - DNA, 25 bp, Mus musculus
taacaagactaccaagtgaacacct

SEQ ID NO: 962022 - DNA, 25 bp, Mus musculus
taacaagactaccatgctccacttc

SEQ ID NO: 962023 - DNA, 25 bp, Mus musculus
taacaagactaccatgtgaacacct

SEQ ID NO: 962024 - DNA, 25 bp, Mus musculus
taacaagacttcaatgcttctctcc

SEQ ID NO: 962025 - DNA, 25 bp, Mus musculus
taacaagcaccctttgacaaactac

SEQ ID NO: 962026 - DNA, 25 bp, Mus musculus
taacaagcacgctttgacaaactac

SEQ ID NO: 962027 - DNA, 25 bp, Mus musculus
taacaagccaaatgaaaaagttcga

SEQ ID NO: 962028 - DNA, 25 bp, Mus musculus
taacaagccatatgaaaaagttcga

SEQ ID NO: 962029 - DNA, 25 bp, Mus musculus
taacaaggaagacggagctagcacc

SEQ ID NO: 962030 - DNA, 25 bp, Mus musculus
taacaaggaagagggagctagcacc

SEQ ID NO: 962031 - DNA, 25 bp, Mus musculus
taacaataagctcatcaaacgggtg

SEQ ID NO: 962032 - DNA, 25 bp, Mus musculus
taacaataaggtcatcaaacgggtg

SEQ ID NO: 962033 - DNA, 25 bp, Mus musculus
taacaatgtatgccaatcgcatcct

SEQ ID NO: 962034 - DNA, 25 bp, Mus musculus
taacaatgtatggcaatcgcatcct

SEQ ID NO: 962035 - DNA, 25 bp, Mus musculus
taacacacctctctctgtgctgagc

SEQ ID NO: 962036 - DNA, 25 bp, Mus musculus
taacacacctctctgtgtgctgagc

SEQ ID NO: 962037 - DNA, 25 bp, Mus musculus
taacacagtgtaaaaacagaaagtg

SEQ ID NO: 962038 - DNA, 25 bp, Mus musculus
taacacagtgtaaatacagaaagtg

SEQ ID NO: 962039 - DNA, 25 bp, Mus musculus
taacaccttcttttccttctgcagt

SEQ ID NO: 962040 - DNA, 25 bp, Mus musculus
taacaccttcttttcgcgtgcccac

SEQ ID NO: 962041 - DNA, 25 bp, Mus musculus
taacaccttcttttgcttctgcagt

SEQ ID NO: 962042 - DNA, 25 bp, Mus musculus
taacaccttcttttggcgtgcccac

SEQ ID NO: 962043 - DNA, 25 bp, Mus musculus
taacactcctctacacttagcctgt

SEQ ID NO: 962044 - DNA, 25 bp, Mus musculus
taacactcctcttcacttagcctgt

SEQ ID NO: 962045 - DNA, 25 bp, Mus musculus
taacagaagaaaaaatcatcgttaa

SEQ ID NO: 962046 - DNA, 25 bp, Mus musculus
taacagaagaaaaattcatcgttaa

SEQ ID NO: 962047 - DNA, 25 bp, Mus musculus
taacagcccaggccaatgtggctgg

SEQ ID NO: 962048 - DNA, 25 bp, Mus musculus
taacagcccagggcaatgtggctgg

SEQ ID NO: 962049 - DNA, 25 bp, Mus musculus
taacagctgcagcaatagtgattga

SEQ ID NO: 962050 - DNA, 25 bp, Mus musculus
taacagctgcaggaatagtgattga

SEQ ID NO: 962051 - DNA, 25 bp, Mus musculus
taacatacccagagccttgccatct

SEQ ID NO: 962052 - DNA, 25 bp, Mus musculus
taacatacccagagtgtcatcaata

SEQ ID NO: 962053 - DNA, 25 bp, Mus musculus
taacatacccagtgccttgccatct

SEQ ID NO: 962054 - DNA, 25 bp, Mus musculus
taacatacccagtgtgtcatcaata

SEQ ID NO: 962055 - DNA, 25 bp, Mus musculus
taacatcacatactcgatccaaaac

SEQ ID NO: 962056 - DNA, 25 bp, Mus musculus
taacatcacatactggatccaaaac

SEQ ID NO: 962057 - DNA, 25 bp, Mus musculus
taacatcataaacgctggcccagta

SEQ ID NO: 962058 - DNA, 25 bp, Mus musculus
taacatcataaaggctggcccagta

SEQ ID NO: 962059 - DNA, 25 bp, Mus musculus
taacatgaatacacaattgccaaca

SEQ ID NO: 962060 - DNA, 25 bp, Mus musculus
taacatgaatacactattgccaaca

SEQ ID NO: 962061 - DNA, 25 bp, Mus musculus
taacatgatttttcaataccgttat

SEQ ID NO: 962062 - DNA, 25 bp, Mus musculus
taacatgatttttctataccgttat

SEQ ID NO: 962063 - DNA, 25 bp, Mus musculus
taacatgcagatattcagtgaactg

SEQ ID NO: 962064 - DNA, 25 bp, Mus musculus
taacatgcagttattcagtgaactg

SEQ ID NO: 962065 - DNA, 25 bp, Mus musculus
taacattcagaggaaatatctgaag

SEQ ID NO: 962066 - DNA, 25 bp, Mus musculus
taacattcagtggaaatatctgaag

SEQ ID NO: 962067 - DNA, 25 bp, Mus musculus
taaccaatctattacgcatcagacc

SEQ ID NO: 962068 - DNA, 25 bp, Mus musculus
taaccaatctattacggaaagagat

SEQ ID NO: 962069 - DNA, 25 bp, Mus musculus
taaccaatctattaggcatcagacc

SEQ ID NO: 962070 - DNA, 25 bp, Mus musculus
taaccaatctattagggaaagagat

SEQ ID NO: 962071 - DNA, 25 bp, Mus musculus
taaccaccacagacttcccacaacc

SEQ ID NO: 962072 - DNA, 25 bp, Mus musculus
taaccaccacagtcttcccacaacc

SEQ ID NO: 962073 - DNA, 25 bp, Mus musculus
taaccagaacaatccattggaagaa

SEQ ID NO: 962074 - DNA, 25 bp, Mus musculus
taaccagaacaatccggaacagact

SEQ ID NO: 962075 - DNA, 25 bp, Mus musculus
taaccagaacaatcgattggaagaa

SEQ ID NO: 962076 - DNA, 25 bp, Mus musculus
taaccagaacaatcgggaacagact

SEQ ID NO: 962077 - DNA, 25 bp, Mus musculus
taaccagatgagcacgctaacatcc

SEQ ID NO: 962078 - DNA, 25 bp, Mus musculus
taaccagatgagcaggctaacatcc

SEQ ID NO: 962079 - DNA, 25 bp, Mus musculus
taaccagcctcctctaaaacaaaga

SEQ ID NO: 962080 - DNA, 25 bp, Mus musculus
taaccagcctgctctaaaacaaaga

SEQ ID NO: 962081 - DNA, 25 bp, Mus musculus
taaccatcatgacatatctgccaag

SEQ ID NO: 962082 - DNA, 25 bp, Mus musculus
taaccatcatgagatatctgccaag

SEQ ID NO: 962083 - DNA, 25 bp, Mus musculus
taaccatgaccgcgaactgtggggt

SEQ ID NO: 962084 - DNA, 25 bp, Mus musculus
taaccatgaccgggaactgtggggt

SEQ ID NO: 962085 - DNA, 25 bp, Mus musculus
taacccagaccacagggatgtggac

SEQ ID NO: 962086 - DNA, 25 bp, Mus musculus
taacccagaccagagggatgtggac

SEQ ID NO: 962087 - DNA, 25 bp, Mus musculus
taacccccctaacggcagcagcaat

SEQ ID NO: 962088 - DNA, 25 bp, Mus musculus
taacccccctaagggcagcagcaat

SEQ ID NO: 962089 - DNA, 25 bp, Mus musculus
taaccctctgagcctcatgtaccat

SEQ ID NO: 962090 - DNA, 25 bp, Mus musculus
taaccctctgtgcctcatgtaccat

SEQ ID NO: 962091 - DNA, 25 bp, Mus musculus
taaccgaactcacggattgctttct

SEQ ID NO: 962092 - DNA, 25 bp, Mus musculus
taaccgaactcagggattgctttct

SEQ ID NO: 962093 - DNA, 25 bp, Mus musculus
taaccgagccagacccagatgtcaa

SEQ ID NO: 962094 - DNA, 25 bp, Mus musculus
taaccgagccagtcccagatgtcaa

SEQ ID NO: 962095 - DNA, 25 bp, Mus musculus
taacctagagcgcgtgactgagata

SEQ ID NO: 962096 - DNA, 25 bp, Mus musculus
taacctagagcgggtgactgagata

SEQ ID NO: 962097 - DNA, 25 bp, Mus musculus
taacctctatagcacgtatggagga

SEQ ID NO: 962098 - DNA, 25 bp, Mus musculus
taacctctatagcaggtatggagga

SEQ ID NO: 962099 - DNA, 25 bp, Mus musculus
taacctctctcacgttgtacggcgc

SEQ ID NO: 962100 - DNA, 25 bp, Mus musculus
taacctctctcaggttgtacggcgc

SEQ ID NO: 962101 - DNA, 25 bp, Mus musculus
taacctgcagcacctatacaacctc

SEQ ID NO: 962102 - DNA, 25 bp, Mus musculus
taacctgcaggacctatacaacctc

SEQ ID NO: 962103 - DNA, 25 bp, Mus musculus
taacctgcatcccagcctatgacca

SEQ ID NO: 962104 - DNA, 25 bp, Mus musculus
taacctgcatgccagcctatgacca

SEQ ID NO: 962105 - DNA, 25 bp, Mus musculus
taacctgcccaacgacaagctggga

SEQ ID NO: 962106 - DNA, 25 bp, Mus musculus
taacctgcccaaggacaagctggga

SEQ ID NO: 962107 - DNA, 25 bp, Mus musculus
taacctggagaatgccctggacttg

SEQ ID NO: 962108 - DNA, 25 bp, Mus musculus
taacctggagtatgccctggacttg

SEQ ID NO: 962109 - DNA, 25 bp, Mus musculus
taaccttgaacaaattgctaccagt

SEQ ID NO: 962110 - DNA, 25 bp, Mus musculus
taaccttgaacatattgctaccagt

SEQ ID NO: 962111 - DNA, 25 bp, Mus musculus
taacgaagcaggcttgcaaaacctg

SEQ ID NO: 962112 - DNA, 25 bp, Mus musculus
taacgaagcagggttgcaaaacctg

SEQ ID NO: 962113 - DNA, 25 bp, Mus musculus
taacgagcaacacaattgcccgctg

SEQ ID NO: 962114 - DNA, 25 bp, Mus musculus
taacgagcaagacaattgcccgctg

SEQ ID NO: 962115 - DNA, 25 bp, Mus musculus
taacgatccacagacatccagaagc

SEQ ID NO: 962116 - DNA, 25 bp, Mus musculus
taacgatccacagagatccagaagc

SEQ ID NO: 962117 - DNA, 25 bp, Mus musculus
taacggagttggagaatgataccaa

SEQ ID NO: 962118 - DNA, 25 bp, Mus musculus
taacggagttggtgaatgataccaa

SEQ ID NO: 962119 - DNA, 25 bp, Mus musculus
taacgtctgcatactatcgtggagc

SEQ ID NO: 962120 - DNA, 25 bp, Mus musculus
taacgtctgcttactatcgtggagc

SEQ ID NO: 962121 - DNA, 25 bp, Mus musculus
taactaaaaaaatccatgataccat

SEQ ID NO: 962122 - DNA, 25 bp, Mus musculus
taactaaaaaaatcgatgataccat

SEQ ID NO: 962123 - DNA, 25 bp, Mus musculus
taactacaaacttcagctggcggag

SEQ ID NO: 962124 - DNA, 25 bp, Mus musculus
taactacaaagttcagctggcggag

SEQ ID NO: 962125 - DNA, 25 bp, Mus musculus
taactaccagatgccaccgcagtgg

SEQ ID NO: 962126 - DNA, 25 bp, Mus musculus
taactaccagccttatacaactgtt

SEQ ID NO: 962127 - DNA, 25 bp, Mus musculus
taactaccaggcttatacaactgtt

SEQ ID NO: 962128 - DNA, 25 bp, Mus musculus
taactaccagttgccaccgcagtgg

SEQ ID NO: 962129 - DNA, 25 bp, Mus musculus
taactatatggaccaacctcggagg

SEQ ID NO: 962130 - DNA, 25 bp, Mus musculus
taactatatggagcaacctcggagg

SEQ ID NO: 962131 - DNA, 25 bp, Mus musculus
taactcacaacgcacgcctccttgg

SEQ ID NO: 962132 - DNA, 25 bp, Mus musculus
taactcacaacgcgattgtcttggg

SEQ ID NO: 962133 - DNA, 25 bp, Mus musculus
taactcacaacggacgcctccttgg

SEQ ID NO: 962134 - DNA, 25 bp, Mus musculus
taactcacaacgggattgtcttggg

SEQ ID NO: 962135 - DNA, 25 bp, Mus musculus
taactcaggagacgagccatttatt

SEQ ID NO: 962136 - DNA, 25 bp, Mus musculus
taactcaggagacgtacttggaagg

SEQ ID NO: 962137 - DNA, 25 bp, Mus musculus
taactcaggagaggagccatttatt

SEQ ID NO: 962138 - DNA, 25 bp, Mus musculus
taactcaggagaggtacttggaagg

SEQ ID NO: 962139 - DNA, 25 bp, Mus musculus
taactcatcaagcttatgaactttg

SEQ ID NO: 962140 - DNA, 25 bp, Mus musculus
taactcatcaaggttatgaactttg

SEQ ID NO: 962141 - DNA, 25 bp, Mus musculus
taactccaaagtcacacaagaagat

SEQ ID NO: 962142 - DNA, 25 bp, Mus musculus
taactccaaagtcagacaagaagat

SEQ ID NO: 962143 - DNA, 25 bp, Mus musculus
taactccataaacactctgtccagt

SEQ ID NO: 962144 - DNA, 25 bp, Mus musculus
taactccataaacagtctgtccagt

SEQ ID NO: 962145 - DNA, 25 bp, Mus musculus
taactcgtacagcgactgtatgctg

SEQ ID NO: 962146 - DNA, 25 bp, Mus musculus
taactcgtacagggactgtatgctg

SEQ ID NO: 962147 - DNA, 25 bp, Mus musculus
taactcgtcaaacgtctcattcagg

SEQ ID NO: 962148 - DNA, 25 bp, Mus musculus
taactcgtcaaaggtctcattcagg

SEQ ID NO: 962149 - DNA, 25 bp, Mus musculus
taactctgagaacgtctattacaat

SEQ ID NO: 962150 - DNA, 25 bp, Mus musculus
taactctgagaaggtctattacaat

SEQ ID NO: 962151 - DNA, 25 bp, Mus musculus
taactgaagatgaaaaaggtcattt

SEQ ID NO: 962152 - DNA, 25 bp, Mus musculus
taactgaagatgtaaaaggtcattt

SEQ ID NO: 962153 - DNA, 25 bp, Mus musculus
taactgagaaagatctccaagagga

SEQ ID NO: 962154 - DNA, 25 bp, Mus musculus
taactgagaaagttctccaagagga

SEQ ID NO: 962155 - DNA, 25 bp, Mus musculus
taactgcaaactcccacgtcctccc

SEQ ID NO: 962156 - DNA, 25 bp, Mus musculus
taactgcaaactgccacgtcctccc

SEQ ID NO: 962157 - DNA, 25 bp, Mus musculus
taactgcactgccaccacggggtct

SEQ ID NO: 962158 - DNA, 25 bp, Mus musculus
taactgcactgccagcacggggtct

SEQ ID NO: 962159 - DNA, 25 bp, Mus musculus
taactgctaaccaagctctgagtga

SEQ ID NO: 962160 - DNA, 25 bp, Mus musculus
taactgctaagcaagctctgagtga

SEQ ID NO: 962161 - DNA, 25 bp, Mus musculus
taactggcaacgattttcaccagga

SEQ ID NO: 962162 - DNA, 25 bp, Mus musculus
taactggcaaggattttcaccagga

SEQ ID NO: 962163 - DNA, 25 bp, Mus musculus
taactgggagcatgagccccaagaa

SEQ ID NO: 962164 - DNA, 25 bp, Mus musculus
taactgggaggatgagccccaagaa

SEQ ID NO: 962165 - DNA, 25 bp, Mus musculus
taactgggtatcaaattatgaaaaa

SEQ ID NO: 962166 - DNA, 25 bp, Mus musculus
taactgggtatcaatttatgaaaaa

SEQ ID NO: 962167 - DNA, 25 bp, Mus musculus
taactgtgagatgtaccgaagggag

SEQ ID NO: 962168 - DNA, 25 bp, Mus musculus
taactgtgagttgtaccgaagggag

SEQ ID NO: 962169 - DNA, 25 bp, Mus musculus
taactgttttcacacgaactggtga

SEQ ID NO: 962170 - DNA, 25 bp, Mus musculus
taactgttttcacaggaactggtga

SEQ ID NO: 962171 - DNA, 25 bp, Mus musculus
taacttaaaccctaatggaggctgg

SEQ ID NO: 962172 - DNA, 25 bp, Mus musculus
taacttaaacgctaatggaggctgg

SEQ ID NO: 962173 - DNA, 25 bp, Mus musculus
taacttacagagttgagtggcctaa

SEQ ID NO: 962174 - DNA, 25 bp, Mus musculus
taacttacagtgttgagtggcctaa

SEQ ID NO: 962175 - DNA, 25 bp, Mus musculus
taacttccagagaatctcagtatgg

SEQ ID NO: 962176 - DNA, 25 bp, Mus musculus
taacttccagatccaggccttcaat

SEQ ID NO: 962177 - DNA, 25 bp, Mus musculus
taacttccagtgaatctcagtatgg

SEQ ID NO: 962178 - DNA, 25 bp, Mus musculus
taacttccagttccaggccttcaat

SEQ ID NO: 962179 - DNA, 25 bp, Mus musculus
taacttcccacacggacgactgctg

SEQ ID NO: 962180 - DNA, 25 bp, Mus musculus
taacttcccacagggacgactgctg

SEQ ID NO: 962181 - DNA, 25 bp, Mus musculus
taacttggaggcaacgaaggagcac

SEQ ID NO: 962182 - DNA, 25 bp, Mus musculus
taacttggaggcaaggaaggagcac

SEQ ID NO: 962183 - DNA, 25 bp, Mus musculus
taactttaagcacatgtactggacc

SEQ ID NO: 962184 - DNA, 25 bp, Mus musculus
taactttaaggacatgtactggacc

SEQ ID NO: 962185 - DNA, 25 bp, Mus musculus
taactttatgaggaagtatgatgcc

SEQ ID NO: 962186 - DNA, 25 bp, Mus musculus
taactttatgaggatgtatgatgcc

SEQ ID NO: 962187 - DNA, 25 bp, Mus musculus
taactttgctcaaacggtcaaagtg

SEQ ID NO: 962188 - DNA, 25 bp, Mus musculus
taactttgctgaaacggtcaaagtg

SEQ ID NO: 962189 - DNA, 25 bp, Mus musculus
taagaacaagaactgaaagtgctgt

SEQ ID NO: 962190 - DNA, 25 bp, Mus musculus
taagaacaagcacaacatccacgct

SEQ ID NO: 962191 - DNA, 25 bp, Mus musculus
taagaacaaggacaacatccacgct

SEQ ID NO: 962192 - DNA, 25 bp, Mus musculus
taagaacaagtactgaaagtgctgt

SEQ ID NO: 962193 - DNA, 25 bp, Mus musculus
taagaacattagttcataatgctta

SEQ ID NO: 962194 - DNA, 25 bp, Mus musculus
taagaacattagttgataatgctta

SEQ ID NO: 962195 - DNA, 25 bp, Mus musculus
taagaaccccaacaggttcaatgtt

SEQ ID NO: 962196 - DNA, 25 bp, Mus musculus
taagaaccccaagaggttcaatgtt

SEQ ID NO: 962197 - DNA, 25 bp, Mus musculus
taagaactacaataagtgtttcctc

SEQ ID NO: 962198 - DNA, 25 bp, Mus musculus
taagaactacaatatgtgtttcctc

SEQ ID NO: 962199 - DNA, 25 bp, Mus musculus
taagaagatgatccccagtgtttcc

SEQ ID NO: 962200 - DNA, 25 bp, Mus musculus
taagaagatgatcgtcttcaagcct

SEQ ID NO: 962201 - DNA, 25 bp, Mus musculus
taagaagatgatctatttccagctg

SEQ ID NO: 962202 - DNA, 25 bp, Mus musculus
taagaagatgatgcccagtgtttcc

SEQ ID NO: 962203 - DNA, 25 bp, Mus musculus
taagaagatgatggtcttcaagcct

SEQ ID NO: 962204 - DNA, 25 bp, Mus musculus
taagaagatgttctatttccagctg

SEQ ID NO: 962205 - DNA, 25 bp, Mus musculus
taagaagcagccagagatcctgcaa

SEQ ID NO: 962206 - DNA, 25 bp, Mus musculus
taagaagcaggcagagatcctgcaa

SEQ ID NO: 962207 - DNA, 25 bp, Mus musculus
taagaataagattcccggagatagt

SEQ ID NO: 962208 - DNA, 25 bp, Mus musculus
taagaataagtttcccggagatagt

SEQ ID NO: 962209 - DNA, 25 bp, Mus musculus
taagaatatcagctgttgaactctt

SEQ ID NO: 962210 - DNA, 25 bp, Mus musculus
taagaatatcaggtgttgaactctt

SEQ ID NO: 962211 - DNA, 25 bp, Mus musculus
taagaatccacacacgcgacaagcc

SEQ ID NO: 962212 - DNA, 25 bp, Mus musculus
taagaatccacacaggcgacaagcc

SEQ ID NO: 962213 - DNA, 25 bp, Mus musculus
taagaatgagctggcgagtgggatg

SEQ ID NO: 962214 - DNA, 25 bp, Mus musculus
taagaatgaggtggcgagtgggatg

SEQ ID NO: 962215 - DNA, 25 bp, Mus musculus
taagacaatcagcgcaagaaaattc

SEQ ID NO: 962216 - DNA, 25 bp, Mus musculus
taagacaatcagggcaagaaaattc

SEQ ID NO: 962217 - DNA, 25 bp, Mus musculus
taagacatacagcctggacgaagat

SEQ ID NO: 962218 - DNA, 25 bp, Mus musculus
taagacatacagcggcatgaccccg

SEQ ID NO: 962219 - DNA, 25 bp, Mus musculus
taagacatacaggctggacgaagat

SEQ ID NO: 962220 - DNA, 25 bp, Mus musculus
taagacatacaggggcatgaccccg

SEQ ID NO: 962221 - DNA, 25 bp, Mus musculus
taagaccatcagattatgggacagt

SEQ ID NO: 962222 - DNA, 25 bp, Mus musculus
taagaccatcagtttatgggacagt

SEQ ID NO: 962223 - DNA, 25 bp, Mus musculus
taagacgaagcttcttcagtgggca

SEQ ID NO: 962224 - DNA, 25 bp, Mus musculus
taagacgaaggttcttcagtgggca

SEQ ID NO: 962225 - DNA, 25 bp, Mus musculus
taagacgtttgtccagctgtgtttc

SEQ ID NO: 962226 - DNA, 25 bp, Mus musculus
taagacgtttgtcctgctgtgtttc

SEQ ID NO: 962227 - DNA, 25 bp, Mus musculus
taagactaaatgcgtgaccgaggtc

SEQ ID NO: 962228 - DNA, 25 bp, Mus musculus
taagactaaatgggtgaccgaggtc

SEQ ID NO: 962229 - DNA, 25 bp, Mus musculus
taagactggaaacgcctccattcct

SEQ ID NO: 962230 - DNA, 25 bp, Mus musculus
taagactggaaaggcctccattcct

SEQ ID NO: 962231 - DNA, 25 bp, Mus musculus
taagacttgcattgctttgccattt

SEQ ID NO: 962232 - DNA, 25 bp, Mus musculus
taagacttgcattggtttgccattt

SEQ ID NO: 962233 - DNA, 25 bp, Mus musculus
taagagacaacagacataacactgc

SEQ ID NO: 962234 - DNA, 25 bp, Mus musculus
taagagacaacagagataacactgc

SEQ ID NO: 962235 - DNA, 25 bp, Mus musculus
taagagactcctctattgcatgaaa

SEQ ID NO: 962236 - DNA, 25 bp, Mus musculus
taagagactcctgtattgcatgaaa

SEQ ID NO: 962237 - DNA, 25 bp, Mus musculus
taagagcagcaacggcatgcagctg

SEQ ID NO: 962238 - DNA, 25 bp, Mus musculus
taagagcagcaagggcatgcagctg

SEQ ID NO: 962239 - DNA, 25 bp, Mus musculus
taagagccagctaatttctaatgcc

SEQ ID NO: 962240 - DNA, 25 bp, Mus musculus
taagagccaggtaatttctaatgcc

SEQ ID NO: 962241 - DNA, 25 bp, Mus musculus
taagagcgttctctggtgcaagtgt

SEQ ID NO: 962242 - DNA, 25 bp, Mus musculus
taagagcgttgtctggtgcaagtgt

SEQ ID NO: 962243 - DNA, 25 bp, Mus musculus
taagagctggaaaatcaactaaaca

SEQ ID NO: 962244 - DNA, 25 bp, Mus musculus
taagagctggtaaatcaactaaaca

SEQ ID NO: 962245 - DNA, 25 bp, Mus musculus
taagaggacaccaacggtccaccaa

SEQ ID NO: 962246 - DNA, 25 bp, Mus musculus
taagaggacaccaagggtccaccaa

SEQ ID NO: 962247 - DNA, 25 bp, Mus musculus
taagagggcgaaaattcgcctccca

SEQ ID NO: 962248 - DNA, 25 bp, Mus musculus
taagagggcgaaatgtggagccccg

SEQ ID NO: 962249 - DNA, 25 bp, Mus musculus
taagagggcgaatattcgcctccca

SEQ ID NO: 962250 - DNA, 25 bp, Mus musculus
taagagggcgaattgtggagccccg

SEQ ID NO: 962251 - DNA, 25 bp, Mus musculus
taagagtgtcacaaacaccaatagc

SEQ ID NO: 962252 - DNA, 25 bp, Mus musculus
taagagtgtcacaatcaccaatagc

SEQ ID NO: 962253 - DNA, 25 bp, Mus musculus
taagatactgagcgaatttgtaaac

SEQ ID NO: 962254 - DNA, 25 bp, Mus musculus
taagatactgagggaatttgtaaac

SEQ ID NO: 962255 - DNA, 25 bp, Mus musculus
taagatagagcgcggaaaaatggag

SEQ ID NO: 962256 - DNA, 25 bp, Mus musculus
taagatagagcggggaaaaatggag

SEQ ID NO: 962257 - DNA, 25 bp, Mus musculus
taagataggaggctccctgctatgt

SEQ ID NO: 962258 - DNA, 25 bp, Mus musculus
taagataggagggtccctgctatgt

SEQ ID NO: 962259 - DNA, 25 bp, Mus musculus
taagatcctctccgtaaatggccaa

SEQ ID NO: 962260 - DNA, 25 bp, Mus musculus
taagatcctctcggtaaatggccaa

SEQ ID NO: 962261 - DNA, 25 bp, Mus musculus
taagattctgcgctctggtatttat

SEQ ID NO: 962262 - DNA, 25 bp, Mus musculus
taagattctgggctctggtatttat

SEQ ID NO: 962263 - DNA, 25 bp, Mus musculus
taagattgagaacctagctagcatc

SEQ ID NO: 962264 - DNA, 25 bp, Mus musculus
taagattgagaccactgttcctcct

SEQ ID NO: 962265 - DNA, 25 bp, Mus musculus
taagattgagtacctagctagcatc

SEQ ID NO: 962266 - DNA, 25 bp, Mus musculus
taagattgagtccactgttcctcct

SEQ ID NO: 962267 - DNA, 25 bp, Mus musculus
taagcaaagtgacacgagcaacgcc

SEQ ID NO: 962268 - DNA, 25 bp, Mus musculus
taagcaaagtgacaggagcaacgcc

SEQ ID NO: 962269 - DNA, 25 bp, Mus musculus
taagcagaagtccacaggctggttc

SEQ ID NO: 962270 - DNA, 25 bp, Mus musculus
taagcagaagtccagaggctggttc

SEQ ID NO: 962271 - DNA, 25 bp, Mus musculus
taagcagaatgaaaagattaaagca

SEQ ID NO: 962272 - DNA, 25 bp, Mus musculus
taagcagaatgaaatgattaaagca

SEQ ID NO: 962273 - DNA, 25 bp, Mus musculus
taagcagaggagacctgccaggcct

SEQ ID NO: 962274 - DNA, 25 bp, Mus musculus
taagcagaggtgacctgccaggcct

SEQ ID NO: 962275 - DNA, 25 bp, Mus musculus
taagcagatcaccgtacggttctcc

SEQ ID NO: 962276 - DNA, 25 bp, Mus musculus
taagcagatcacggtacggttctcc

SEQ ID NO: 962277 - DNA, 25 bp, Mus musculus
taagcagatgaacatgtaccgaggc

SEQ ID NO: 962278 - DNA, 25 bp, Mus musculus
taagcagatgaagatgtaccgaggc

SEQ ID NO: 962279 - DNA, 25 bp, Mus musculus
taagcatgagctagagcggcgtgtg

SEQ ID NO: 962280 - DNA, 25 bp, Mus musculus
taagcatgaggtagagcggcgtgtg

SEQ ID NO: 962281 - DNA, 25 bp, Mus musculus
taagcatttagaatgcacaaaacaa

SEQ ID NO: 962282 - DNA, 25 bp, Mus musculus
taagcatttagattgcacaaaacaa

SEQ ID NO: 962283 - DNA, 25 bp, Mus musculus
taagccacagagacaacagctacta

SEQ ID NO: 962284 - DNA, 25 bp, Mus musculus
taagccacagtgacaacagctacta

SEQ ID NO: 962285 - DNA, 25 bp, Mus musculus
taagccagatggcacagtggaggaa

SEQ ID NO: 962286 - DNA, 25 bp, Mus musculus
taagccagatgggacagtggaggaa

SEQ ID NO: 962287 - DNA, 25 bp, Mus musculus
taagcccacctgcagcttctgtcag

SEQ ID NO: 962288 - DNA, 25 bp, Mus musculus
taagcccacctgcttctgtcagcag

SEQ ID NO: 962289 - DNA, 25 bp, Mus musculus
taagcccacctggagcttctgtcag

SEQ ID NO: 962290 - DNA, 25 bp, Mus musculus
taagcccacctggttctgtcagcag

SEQ ID NO: 962291 - DNA, 25 bp, Mus musculus
taagccgcaaagaacttccaccagg

SEQ ID NO: 962292 - DNA, 25 bp, Mus musculus
taagccgcaaagaagttccaccagg

SEQ ID NO: 962293 - DNA, 25 bp, Mus musculus
taagcctcagaacgatgcgggctcc

SEQ ID NO: 962294 - DNA, 25 bp, Mus musculus
taagcctcagaaggatgcgggctcc

SEQ ID NO: 962295 - DNA, 25 bp, Mus musculus
taagcctgtgtgcagtggttttggc

SEQ ID NO: 962296 - DNA, 25 bp, Mus musculus
taagcctgtgtggagtggttttggc

SEQ ID NO: 962297 - DNA, 25 bp, Mus musculus
taagcctttgcttcacagcagccta

SEQ ID NO: 962298 - DNA, 25 bp, Mus musculus
taagcctttggttcacagcagccta

SEQ ID NO: 962299 - DNA, 25 bp, Mus musculus
taagcgacagctgtccttggaatct

SEQ ID NO: 962300 - DNA, 25 bp, Mus musculus
taagcgacaggtgtccttggaatct

SEQ ID NO: 962301 - DNA, 25 bp, Mus musculus
taagcgacatagatcaagatgaatg

SEQ ID NO: 962302 - DNA, 25 bp, Mus musculus
taagcgacatagttcaagatgaatg

SEQ ID NO: 962303 - DNA, 25 bp, Mus musculus
taagcgacggtcagcgctggatttt

SEQ ID NO: 962304 - DNA, 25 bp, Mus musculus
taagcgacggtcagggctggatttt

SEQ ID NO: 962305 - DNA, 25 bp, Mus musculus
taagctacttcaacacagcttcatc

SEQ ID NO: 962306 - DNA, 25 bp, Mus musculus
taagctacttgaacacagcttcatc

SEQ ID NO: 962307 - DNA, 25 bp, Mus musculus
taagctcagatgaaaagaagaaacc

SEQ ID NO: 962308 - DNA, 25 bp, Mus musculus
taagctcagatgtaaagaagaaacc

SEQ ID NO: 962309 - DNA, 25 bp, Mus musculus
taagctgatgagacacatggccaca

SEQ ID NO: 962310 - DNA, 25 bp, Mus musculus
taagctgatgagtcacatggccaca

SEQ ID NO: 962311 - DNA, 25 bp, Mus musculus
taagcttgctgacactctccgctgg

SEQ ID NO: 962312 - DNA, 25 bp, Mus musculus
taagcttgctgacggtttcccagtg

SEQ ID NO: 962313 - DNA, 25 bp, Mus musculus
taagcttgctgagactctccgctgg

SEQ ID NO: 962314 - DNA, 25 bp, Mus musculus
taagcttgctgagggtttcccagtg

SEQ ID NO: 962315 - DNA, 25 bp, Mus musculus
taaggaacagcctttcatgctgctc

SEQ ID NO: 962316 - DNA, 25 bp, Mus musculus
taaggaacaggctttcatgctgctc

SEQ ID NO: 962317 - DNA, 25 bp, Mus musculus
taaggaaggcgacggtgctgaccat

SEQ ID NO: 962318 - DNA, 25 bp, Mus musculus
taaggaaggcgagggtgctgaccat

SEQ ID NO: 962319 - DNA, 25 bp, Mus musculus
taaggaatgcagcgacattcctgtg

SEQ ID NO: 962320 - DNA, 25 bp, Mus musculus
taaggaatgcagggacattcctgtg

SEQ ID NO: 962321 - DNA, 25 bp, Mus musculus
taaggacattagattgatcagggac

SEQ ID NO: 962322 - DNA, 25 bp, Mus musculus
taaggacattagtttgatcagggac

SEQ ID NO: 962323 - DNA, 25 bp, Mus musculus
taaggacattgacacagaaagacat

SEQ ID NO: 962324 - DNA, 25 bp, Mus musculus
taaggacattgagacagaaagacat

SEQ ID NO: 962325 - DNA, 25 bp, Mus musculus
taaggagaagctatacatcatagcg

SEQ ID NO: 962326 - DNA, 25 bp, Mus musculus
taaggagaaggtatacatcatagcg

SEQ ID NO: 962327 - DNA, 25 bp, Mus musculus
taaggagccgagagcagttcctcca

SEQ ID NO: 962328 - DNA, 25 bp, Mus musculus
taaggagccgagtgcagttcctcca

SEQ ID NO: 962329 - DNA, 25 bp, Mus musculus
taaggaggagaacatttcagagtaa

SEQ ID NO: 962330 - DNA, 25 bp, Mus musculus
taaggaggagtacatttcagagtaa

SEQ ID NO: 962331 - DNA, 25 bp, Mus musculus
taaggatgccatcaatccaagcaaa

SEQ ID NO: 962332 - DNA, 25 bp, Mus musculus
taaggatgccatgaatccaagcaaa

SEQ ID NO: 962333 - DNA, 25 bp, Mus musculus
taaggattccttcatctcgaggctc

SEQ ID NO: 962334 - DNA, 25 bp, Mus musculus
taaggattccttgatctcgaggctc

SEQ ID NO: 962335 - DNA, 25 bp, Mus musculus
taaggcaagacacattacaaaagaa

SEQ ID NO: 962336 - DNA, 25 bp, Mus musculus
taaggcaagacagattacaaaagaa

SEQ ID NO: 962337 - DNA, 25 bp, Mus musculus
taaggcagagctgctgctgtcccag

SEQ ID NO: 962338 - DNA, 25 bp, Mus musculus
taaggcagaggtgctgctgtcccag

SEQ ID NO: 962339 - DNA, 25 bp, Mus musculus
taaggccacaaaagtgacgttccag

SEQ ID NO: 962340 - DNA, 25 bp, Mus musculus
taaggccacaaatgtgacgttccag

SEQ ID NO: 962341 - DNA, 25 bp, Mus musculus
taaggcgcagaacgatcgccacgac

SEQ ID NO: 962342 - DNA, 25 bp, Mus musculus
taaggcgcagaaggatcgccacgac

SEQ ID NO: 962343 - DNA, 25 bp, Mus musculus
taaggctttggcactaacggccagg

SEQ ID NO: 962344 - DNA, 25 bp, Mus musculus
taaggctttggctctaacggccagg

SEQ ID NO: 962345 - DNA, 25 bp, Mus musculus
taagggaaacagcagaccatgacag

SEQ ID NO: 962346 - DNA, 25 bp, Mus musculus
taagggaaacaggagaccatgacag

SEQ ID NO: 962347 - DNA, 25 bp, Mus musculus
taagggacagatggctatgaacggc

SEQ ID NO: 962348 - DNA, 25 bp, Mus musculus
taagggacagttggctatgaacggc

SEQ ID NO: 962349 - DNA, 25 bp, Mus musculus
taagggtagaccttctgtctagtga

SEQ ID NO: 962350 - DNA, 25 bp, Mus musculus
taagggtagaccttgtgtctagtga

SEQ ID NO: 962351 - DNA, 25 bp, Mus musculus
taaggtcaagcctgtgggccgaagc

SEQ ID NO: 962352 - DNA, 25 bp, Mus musculus
taaggtcaaggctgtgggccgaagc

SEQ ID NO: 962353 - DNA, 25 bp, Mus musculus
taaggtcatggacgatttaaagcct

SEQ ID NO: 962354 - DNA, 25 bp, Mus musculus
taaggtcatggacgttttaaagcct

SEQ ID NO: 962355 - DNA, 25 bp, Mus musculus
taaggtcggacaagctctactccag

SEQ ID NO: 962356 - DNA, 25 bp, Mus musculus
taaggtcggacaaggaaacacagag

SEQ ID NO: 962357 - DNA, 25 bp, Mus musculus
taaggtcggacatgctctactccag

SEQ ID NO: 962358 - DNA, 25 bp, Mus musculus
taaggtcggacatggaaacacagag

SEQ ID NO: 962359 - DNA, 25 bp, Mus musculus
taaggttcccagcatcaccgacaac

SEQ ID NO: 962360 - DNA, 25 bp, Mus musculus
taaggttcccaggatcaccgacaac

SEQ ID NO: 962361 - DNA, 25 bp, Mus musculus
taaggttgcaagcttgctggtgaaa

SEQ ID NO: 962362 - DNA, 25 bp, Mus musculus
taaggttgcaaggttgctggtgaaa

SEQ ID NO: 962363 - DNA, 25 bp, Mus musculus
taagtacaagaaaggaggtgtggca

SEQ ID NO: 962364 - DNA, 25 bp, Mus musculus
taagtacaagtaaggaggtgtggca

SEQ ID NO: 962365 - DNA, 25 bp, Mus musculus
taagtaccagctgctggacggagag

SEQ ID NO: 962366 - DNA, 25 bp, Mus musculus
taagtaccaggtgctggacggagag

SEQ ID NO: 962367 - DNA, 25 bp, Mus musculus
taagtactgggacctcatctatgag

SEQ ID NO: 962368 - DNA, 25 bp, Mus musculus
taagtactgggagctcatctatgag

SEQ ID NO: 962369 - DNA, 25 bp, Mus musculus
taagtatatccacgtcgtctacctt

SEQ ID NO: 962370 - DNA, 25 bp, Mus musculus
taagtatatccaggtcgtctacctt

SEQ ID NO: 962371 - DNA, 25 bp, Mus musculus
taagtatcttaacgtttcaggcaca

SEQ ID NO: 962372 - DNA, 25 bp, Mus musculus
taagtatcttaaggtttcaggcaca

SEQ ID NO: 962373 - DNA, 25 bp, Mus musculus
taagtatttgatgctggagaagcgc

SEQ ID NO: 962374 - DNA, 25 bp, Mus musculus
taagtatttgcctcagtgtttagag

SEQ ID NO: 962375 - DNA, 25 bp, Mus musculus
taagtatttggctcagtgtttagag

SEQ ID NO: 962376 - DNA, 25 bp, Mus musculus
taagtatttgttgctggagaagcgc

SEQ ID NO: 962377 - DNA, 25 bp, Mus musculus
taagtcagtttgtacatgtttgcat

SEQ ID NO: 962378 - DNA, 25 bp, Mus musculus
taagtcagtttgtagatgtttgcat

SEQ ID NO: 962379 - DNA, 25 bp, Mus musculus
taagtcccagccagagtggcgggaa

SEQ ID NO: 962380 - DNA, 25 bp, Mus musculus
taagtcccaggcagagtggcgggaa

SEQ ID NO: 962381 - DNA, 25 bp, Mus musculus
taagtccgagactcccaaggagcca

SEQ ID NO: 962382 - DNA, 25 bp, Mus musculus
taagtccgagtctcccaaggagcca

SEQ ID NO: 962383 - DNA, 25 bp, Mus musculus
taagtcctatgaaattttattgcat

SEQ ID NO: 962384 - DNA, 25 bp, Mus musculus
taagtcctatgatattttattgcat

SEQ ID NO: 962385 - DNA, 25 bp, Mus musculus
taagtcgcagctagaatggatgagt

SEQ ID NO: 962386 - DNA, 25 bp, Mus musculus
taagtcgcaggtagaatggatgagt

SEQ ID NO: 962387 - DNA, 25 bp, Mus musculus
taagtgaggacacgcttttgattgc

SEQ ID NO: 962388 - DNA, 25 bp, Mus musculus
taagtgaggacaggcttttgattgc

SEQ ID NO: 962389 - DNA, 25 bp, Mus musculus
taagtgataatacgttaaagaattt

SEQ ID NO: 962390 - DNA, 25 bp, Mus musculus
taagtgataataggttaaagaattt

SEQ ID NO: 962391 - DNA, 25 bp, Mus musculus
taagtggttctacctttaaggacca

SEQ ID NO: 962392 - DNA, 25 bp, Mus musculus
taagtggttctacgagctcagactg

SEQ ID NO: 962393 - DNA, 25 bp, Mus musculus
taagtggttctagctttaaggacca

SEQ ID NO: 962394 - DNA, 25 bp, Mus musculus
taagtggttctaggagctcagactg

SEQ ID NO: 962395 - DNA, 25 bp, Mus musculus
taagtttaatttgacggaggacatg

SEQ ID NO: 962396 - DNA, 25 bp, Mus musculus
taagtttaatttgagggaggacatg

SEQ ID NO: 962397 - DNA, 25 bp, Mus musculus
taagtttatgaattcctcagagaga

SEQ ID NO: 962398 - DNA, 25 bp, Mus musculus
taagtttatgagctctatgcccagg

SEQ ID NO: 962399 - DNA, 25 bp, Mus musculus
taagtttatgcctgcagttccggct

SEQ ID NO: 962400 - DNA, 25 bp, Mus musculus
taagtttatggctgcagttccggct

SEQ ID NO: 962401 - DNA, 25 bp, Mus musculus
taagtttatgtattcctcagagaga

SEQ ID NO: 962402 - DNA, 25 bp, Mus musculus
taagtttatgtgctctatgcccagg

SEQ ID NO: 962403 - DNA, 25 bp, Mus musculus
taataaaaagagctctatgcccagg

SEQ ID NO: 962404 - DNA, 25 bp, Mus musculus
taataaaaagtgctctatgcccagg

SEQ ID NO: 962405 - DNA, 25 bp, Mus musculus
taataagctactagaacacagcttc

SEQ ID NO: 962406 - DNA, 25 bp, Mus musculus
taataagctacttgaacacagcttc

SEQ ID NO: 962407 - DNA, 25 bp, Mus musculus
taatacccagcatgtattttatgct

SEQ ID NO: 962408 - DNA, 25 bp, Mus musculus
taatacccaggatgtattttatgct

SEQ ID NO: 962409 - DNA, 25 bp, Mus musculus
taataccgagggcccatacaatcat

SEQ ID NO: 962410 - DNA, 25 bp, Mus musculus
taataccgaggggccatacaatcat

SEQ ID NO: 962411 - DNA, 25 bp, Mus musculus
taatactaagagcttcttatttcac

SEQ ID NO: 962412 - DNA, 25 bp, Mus musculus
taatactaagaggttcttatttcac

SEQ ID NO: 962413 - DNA, 25 bp, Mus musculus
taatactgcttaagtatttttctga

SEQ ID NO: 962414 - DNA, 25 bp, Mus musculus
taatactgcttatgtatttttctga

SEQ ID NO: 962415 - DNA, 25 bp, Mus musculus
taatagacagcccaggaaacaagga

SEQ ID NO: 962416 - DNA, 25 bp, Mus musculus
taatagacaggccaggaaacaagga

SEQ ID NO: 962417 - DNA, 25 bp, Mus musculus
taatagcaagcattggagaagcaaa

SEQ ID NO: 962418 - DNA, 25 bp, Mus musculus
taatagcaaggattggagaagcaaa

SEQ ID NO: 962419 - DNA, 25 bp, Mus musculus
taatagccagatcaacatgtacctg

SEQ ID NO: 962420 - DNA, 25 bp, Mus musculus
taatagccagttcaacatgtacctg

SEQ ID NO: 962421 - DNA, 25 bp, Mus musculus
taatagggacggctctgcctgaatc

SEQ ID NO: 962422 - DNA, 25 bp, Mus musculus
taatagggacgggtctgcctgaatc

SEQ ID NO: 962423 - DNA, 25 bp, Mus musculus
taatatgaagcaagtacttaagcag

SEQ ID NO: 962424 - DNA, 25 bp, Mus musculus
taatatgaaggaagtacttaagcag

SEQ ID NO: 962425 - DNA, 25 bp, Mus musculus
taatatgcatcttacttggagtgat

SEQ ID NO: 962426 - DNA, 25 bp, Mus musculus
taatatgcatgttacttggagtgat

SEQ ID NO: 962427 - DNA, 25 bp, Mus musculus
taatatgcgtcccgaccagtccaac

SEQ ID NO: 962428 - DNA, 25 bp, Mus musculus
taatatgcgtccggaccagtccaac

SEQ ID NO: 962429 - DNA, 25 bp, Mus musculus
taatcaaaaaaactaaggctcgtac

SEQ ID NO: 962430 - DNA, 25 bp, Mus musculus
taatcaaaaatactaaggctcgtac

SEQ ID NO: 962431 - DNA, 25 bp, Mus musculus
taatcaaaagcgcatcgatccggtt

SEQ ID NO: 962432 - DNA, 25 bp, Mus musculus
taatcaaaagggcatcgatccggtt

SEQ ID NO: 962433 - DNA, 25 bp, Mus musculus
taatcaaagaacttgtttttagcca

SEQ ID NO: 962434 - DNA, 25 bp, Mus musculus
taatcaaagatcttgtttttagcca

SEQ ID NO: 962435 - DNA, 25 bp, Mus musculus
taatcaagagatcttctcggacctg

SEQ ID NO: 962436 - DNA, 25 bp, Mus musculus
taatcaagagatgttctcggacctg

SEQ ID NO: 962437 - DNA, 25 bp, Mus musculus
taatcacaaaaaaataattggcctt

SEQ ID NO: 962438 - DNA, 25 bp, Mus musculus
taatcacaaaaatataattggcctt

SEQ ID NO: 962439 - DNA, 25 bp, Mus musculus
taatcactaataaacaagtgtgctg

SEQ ID NO: 962440 - DNA, 25 bp, Mus musculus
taatcactaataaagaagtgtgctg

SEQ ID NO: 962441 - DNA, 25 bp, Mus musculus
taatcactgaaaaaagtagttccta

SEQ ID NO: 962442 - DNA, 25 bp, Mus musculus
taatcactgaaaaatgtagttccta

SEQ ID NO: 962443 - DNA, 25 bp, Mus musculus
taatcagaagcgctgttatgatctg

SEQ ID NO: 962444 - DNA, 25 bp, Mus musculus
taatcagaagggctgttatgatctg

SEQ ID NO: 962445 - DNA, 25 bp, Mus musculus
taatcagcaaggagctagctgagcc

SEQ ID NO: 962446 - DNA, 25 bp, Mus musculus
taatcagcaaggtgctagctgagcc

SEQ ID NO: 962447 - DNA, 25 bp, Mus musculus
taatcagtacctcacagactccaaa

SEQ ID NO: 962448 - DNA, 25 bp, Mus musculus
taatcagtacctcagagactccaaa

SEQ ID NO: 962449 - DNA, 25 bp, Mus musculus
taatcagttcaactctgttatctcc

SEQ ID NO: 962450 - DNA, 25 bp, Mus musculus
taatcagttcaagtctgttatctcc

SEQ ID NO: 962451 - DNA, 25 bp, Mus musculus
taatcattcccacgtttctgtccag

SEQ ID NO: 962452 - DNA, 25 bp, Mus musculus
taatcattcccaggtttctgtccag

SEQ ID NO: 962453 - DNA, 25 bp, Mus musculus
taatccaaggaaatgtggatcacca

SEQ ID NO: 962454 - DNA, 25 bp, Mus musculus
taatccaaggtaatgtggatcacca

SEQ ID NO: 962455 - DNA, 25 bp, Mus musculus
taatccacagaacctgccttcagga

SEQ ID NO: 962456 - DNA, 25 bp, Mus musculus
taatccacagtacctgccttcagga

SEQ ID NO: 962457 - DNA, 25 bp, Mus musculus
taatcccaagcgatttgctgcagtc

SEQ ID NO: 962458 - DNA, 25 bp, Mus musculus
taatcccaagggatttgctgcagtc

SEQ ID NO: 962459 - DNA, 25 bp, Mus musculus
taatcctgttttcatggaaggaccc

SEQ ID NO: 962460 - DNA, 25 bp, Mus musculus
taatcctgttttgatggaaggaccc

SEQ ID NO: 962461 - DNA, 25 bp, Mus musculus
taatcgaaggatggctgctgagcag

SEQ ID NO: 962462 - DNA, 25 bp, Mus musculus
taatcgaaggttggctgctgagcag

SEQ ID NO: 962463 - DNA, 25 bp, Mus musculus
taatctgtgaagatgtccagctcgc

SEQ ID NO: 962464 - DNA, 25 bp, Mus musculus
taatctgtgaagttgtccagctcgc

SEQ ID NO: 962465 - DNA, 25 bp, Mus musculus
taatcttcactgggcccttcctcct

SEQ ID NO: 962466 - DNA, 25 bp, Mus musculus
taatcttcactggggccttcctcct

SEQ ID NO: 962467 - DNA, 25 bp, Mus musculus
taatcttggctataaaaaatgccag

SEQ ID NO: 962468 - DNA, 25 bp, Mus musculus
taatcttggctatataaaatgccag

SEQ ID NO: 962469 - DNA, 25 bp, Mus musculus
taatgaaagacacaaacaaactgtt

SEQ ID NO: 962470 - DNA, 25 bp, Mus musculus
taatgaaagacacggacatgaaacc

SEQ ID NO: 962471 - DNA, 25 bp, Mus musculus
taatgaaagacagaaacaaactgtt

SEQ ID NO: 962472 - DNA, 25 bp, Mus musculus
taatgaaagacagggacatgaaacc

SEQ ID NO: 962473 - DNA, 25 bp, Mus musculus
taatgaaagtcaactatgagcaaat

SEQ ID NO: 962474 - DNA, 25 bp, Mus musculus
taatgaaagtgaactatgagcaaat

SEQ ID NO: 962475 - DNA, 25 bp, Mus musculus
taatgaaggttcatctctcccttct

SEQ ID NO: 962476 - DNA, 25 bp, Mus musculus
taatgaaggttcatgtctcccttct

SEQ ID NO: 962477 - DNA, 25 bp, Mus musculus
taatgacaaaagcctgcagcaagaa

SEQ ID NO: 962478 - DNA, 25 bp, Mus musculus
taatgacaaaaggctgcagcaagaa

SEQ ID NO: 962479 - DNA, 25 bp, Mus musculus
taatgacactgacaatgagatggct

SEQ ID NO: 962480 - DNA, 25 bp, Mus musculus
taatgacactgagaatgagatggct

SEQ ID NO: 962481 - DNA, 25 bp, Mus musculus
taatgagaagattcaagttgtgtct

SEQ ID NO: 962482 - DNA, 25 bp, Mus musculus
taatgagaagcgagccttctgggga

SEQ ID NO: 962483 - DNA, 25 bp, Mus musculus
taatgagaagggagccttctgggga

SEQ ID NO: 962484 - DNA, 25 bp, Mus musculus
taatgagaagtttcaagttgtgtct

SEQ ID NO: 962485 - DNA, 25 bp, Mus musculus
taatgagagcatagatgatgaacat

SEQ ID NO: 962486 - DNA, 25 bp, Mus musculus
taatgagagcattgatgatgaacat

SEQ ID NO: 962487 - DNA, 25 bp, Mus musculus
taatgccagcaccccccgccgctcc

SEQ ID NO: 962488 - DNA, 25 bp, Mus musculus
taatgccagcacccgccgccgctcc

SEQ ID NO: 962489 - DNA, 25 bp, Mus musculus
taatgcccactgcaggaggtaaaag

SEQ ID NO: 962490 - DNA, 25 bp, Mus musculus
taatgcccactggaggaggtaaaag

SEQ ID NO: 962491 - DNA, 25 bp, Mus musculus
taatgccctcaacaccttgtctgaa

SEQ ID NO: 962492 - DNA, 25 bp, Mus musculus
taatgccctcaacagcttgtctgaa

SEQ ID NO: 962493 - DNA, 25 bp, Mus musculus
taatgctctcaacgatttgaggtct

SEQ ID NO: 962494 - DNA, 25 bp, Mus musculus
taatgctctcaaggatttgaggtct

SEQ ID NO: 962495 - DNA, 25 bp, Mus musculus
taatgctgacagctcctcatggact

SEQ ID NO: 962496 - DNA, 25 bp, Mus musculus
taatgctgacaggtcctcatggact

SEQ ID NO: 962497 - DNA, 25 bp, Mus musculus
taatgctgccaacggctcctccaat

SEQ ID NO: 962498 - DNA, 25 bp, Mus musculus
taatgctgccaagggctcctccaat

SEQ ID NO: 962499 - DNA, 25 bp, Mus musculus
taatggaacaaaagtggctgtgctg

SEQ ID NO: 962500 - DNA, 25 bp, Mus musculus
taatggaacaaatgtggctgtgctg

SEQ ID NO: 962501 - DNA, 25 bp, Mus musculus
taatggacggccattttgttcccaa

SEQ ID NO: 962502 - DNA, 25 bp, Mus musculus
taatggacgggcattttgttcccaa

SEQ ID NO: 962503 - DNA, 25 bp, Mus musculus
taatggaggccacgaaaacggcaac

SEQ ID NO: 962504 - DNA, 25 bp, Mus musculus
taatggaggccaggaaaacggcaac

SEQ ID NO: 962505 - DNA, 25 bp, Mus musculus
taatgggaaccaccaaggacacacc

SEQ ID NO: 962506 - DNA, 25 bp, Mus musculus
taatgggaacgaccaaggacacacc

SEQ ID NO: 962507 - DNA, 25 bp, Mus musculus
taatgggaagagtacatctcggatt

SEQ ID NO: 962508 - DNA, 25 bp, Mus musculus
taatgggaagtgtacatctcggatt

SEQ ID NO: 962509 - DNA, 25 bp, Mus musculus
taatgggcatcacactcagtacagg

SEQ ID NO: 962510 - DNA, 25 bp, Mus musculus
taatgggcatcacagtcagtacagg

SEQ ID NO: 962511 - DNA, 25 bp, Mus musculus
taatgggtatctatataaagctcaa

SEQ ID NO: 962512 - DNA, 25 bp, Mus musculus
taatgggtatctttataaagctcaa

SEQ ID NO: 962513 - DNA, 25 bp, Mus musculus
taatggtagcaaattaaaatgtcca

SEQ ID NO: 962514 - DNA, 25 bp, Mus musculus
taatggtagcaatttaaaatgtcca

SEQ ID NO: 962515 - DNA, 25 bp, Mus musculus
taatggttatccccaatgtcagata

SEQ ID NO: 962516 - DNA, 25 bp, Mus musculus
taatggttatcccctatgtcagata

SEQ ID NO: 962517 - DNA, 25 bp, Mus musculus
taatgtcaagcgcctgtccgggaat

SEQ ID NO: 962518 - DNA, 25 bp, Mus musculus
taatgtcaagggcctgtccgggaat

SEQ ID NO: 962519 - DNA, 25 bp, Mus musculus
taatgtgaagatgtttttatttcag

SEQ ID NO: 962520 - DNA, 25 bp, Mus musculus
taatgtgaagttgtttttatttcag

SEQ ID NO: 962521 - DNA, 25 bp, Mus musculus
taatgtgcttttagctgaggcagag

SEQ ID NO: 962522 - DNA, 25 bp, Mus musculus
taatgtgctttttgctgaggcagag

SEQ ID NO: 962523 - DNA, 25 bp, Mus musculus
taatgttagagacctggcagaaagc

SEQ ID NO: 962524 - DNA, 25 bp, Mus musculus
taatgttagagagctggcagaaagc

SEQ ID NO: 962525 - DNA, 25 bp, Mus musculus
taattactgctacccccatcttaga

SEQ ID NO: 962526 - DNA, 25 bp, Mus musculus
taattactgctacccctgtggcaat

SEQ ID NO: 962527 - DNA, 25 bp, Mus musculus
taattactgctaccgccatcttaga

SEQ ID NO: 962528 - DNA, 25 bp, Mus musculus
taattactgctaccgctgtggcaat

SEQ ID NO: 962529 - DNA, 25 bp, Mus musculus
taattatttgcctgatgaagaatgt

SEQ ID NO: 962530 - DNA, 25 bp, Mus musculus
taattatttggctgatgaagaatgt

SEQ ID NO: 962531 - DNA, 25 bp, Mus musculus
taattcacagaactgggaagcacgc

SEQ ID NO: 962532 - DNA, 25 bp, Mus musculus
taattcacagtactgggaagcacgc

SEQ ID NO: 962533 - DNA, 25 bp, Mus musculus
taattcagagctcagaaataccctg

SEQ ID NO: 962534 - DNA, 25 bp, Mus musculus
taattcagaggtcagaaataccctg

SEQ ID NO: 962535 - DNA, 25 bp, Mus musculus
taattcaggctgctcatcctaaatt

SEQ ID NO: 962536 - DNA, 25 bp, Mus musculus
taattcaggctggtcatcctaaatt

SEQ ID NO: 962537 - DNA, 25 bp, Mus musculus
taattcccagcaggtctctgggggt

SEQ ID NO: 962538 - DNA, 25 bp, Mus musculus
taattcccagctctctgggggtgca

SEQ ID NO: 962539 - DNA, 25 bp, Mus musculus
taattcccaggaggtctctgggggt

SEQ ID NO: 962540 - DNA, 25 bp, Mus musculus
taattcccaggtctctgggggtgca

SEQ ID NO: 962541 - DNA, 25 bp, Mus musculus
taattcctcacacacacactggatg

SEQ ID NO: 962542 - DNA, 25 bp, Mus musculus
taattcctcacagacacactggatg

SEQ ID NO: 962543 - DNA, 25 bp, Mus musculus
taattcttggtgctctctaggtatg

SEQ ID NO: 962544 - DNA, 25 bp, Mus musculus
taattcttggtggtctctaggtatg

SEQ ID NO: 962545 - DNA, 25 bp, Mus musculus
taattgacagattagctttatttgc

SEQ ID NO: 962546 - DNA, 25 bp, Mus musculus
taattgacagtttagctttatttgc

SEQ ID NO: 962547 - DNA, 25 bp, Mus musculus
taattgtgggagactgcagtgatga

SEQ ID NO: 962548 - DNA, 25 bp, Mus musculus
taattgtgggagtctgcagtgatga

SEQ ID NO: 962549 - DNA, 25 bp, Mus musculus
taatttagagatgaaatccttcagg

SEQ ID NO: 962550 - DNA, 25 bp, Mus musculus
taatttagagcggctccatagacaa

SEQ ID NO: 962551 - DNA, 25 bp, Mus musculus
taatttagaggggctccatagacaa

SEQ ID NO: 962552 - DNA, 25 bp, Mus musculus
taatttagagttgaaatccttcagg

SEQ ID NO: 962553 - DNA, 25 bp, Mus musculus
taatttctgaagaagggggctggtg

SEQ ID NO: 962554 - DNA, 25 bp, Mus musculus
taatttctgatgaagggggctggtg

SEQ ID NO: 962555 - DNA, 25 bp, Mus musculus
taatttcttaccaacgaatggagcc

SEQ ID NO: 962556 - DNA, 25 bp, Mus musculus
taatttcttaccaaggaatggagcc

SEQ ID NO: 962557 - DNA, 25 bp, Mus musculus
taatttgctgtggacatcggcctgg

SEQ ID NO: 962558 - DNA, 25 bp, Mus musculus
taatttgctgtggacctccttcaaa

SEQ ID NO: 962559 - DNA, 25 bp, Mus musculus
taatttgctgtggagatcggcctgg

SEQ ID NO: 962560 - DNA, 25 bp, Mus musculus
taatttgctgtggagctccttcaaa

SEQ ID NO: 962561 - DNA, 25 bp, Mus musculus
taatttgtctaaactgggattgagc

SEQ ID NO: 962562 - DNA, 25 bp, Mus musculus
taatttgtctaatctgggattgagc

SEQ ID NO: 962563 - DNA, 25 bp, Mus musculus
taattttctatgctgccattaacca

SEQ ID NO: 962564 - DNA, 25 bp, Mus musculus
taattttctatggtgccattaacca

SEQ ID NO: 962565 - DNA, 25 bp, Mus musculus
taattttggcagattaactaaactc

SEQ ID NO: 962566 - DNA, 25 bp, Mus musculus
taattttggcagtttaactaaactc

SEQ ID NO: 962567 - DNA, 25 bp, Mus musculus
tacaaaaagaatgaagacctgatta

SEQ ID NO: 962568 - DNA, 25 bp, Mus musculus
tacaaaaagattgaagacctgatta

SEQ ID NO: 962569 - DNA, 25 bp, Mus musculus
tacaaaaccaagaatgcccagcaag

SEQ ID NO: 962570 - DNA, 25 bp, Mus musculus
tacaaaaccaagtatgcccagcaag

SEQ ID NO: 962571 - DNA, 25 bp, Mus musculus
tacaaaactgattcggaagacaatc

SEQ ID NO: 962572 - DNA, 25 bp, Mus musculus
tacaaaactgtttcggaagacaatc

SEQ ID NO: 962573 - DNA, 25 bp, Mus musculus
tacaaaagcatttacggcttcagaa

SEQ ID NO: 962574 - DNA, 25 bp, Mus musculus
tacaaaagcatttagggcttcagaa

SEQ ID NO: 962575 - DNA, 25 bp, Mus musculus
tacaaaatagagatctaatccctgg

SEQ ID NO: 962576 - DNA, 25 bp, Mus musculus
tacaaaatagtgatctaatccctgg

SEQ ID NO: 962577 - DNA, 25 bp, Mus musculus
tacaaaccagaggccactacatttt

SEQ ID NO: 962578 - DNA, 25 bp, Mus musculus
tacaaaccagtggccactacatttt

SEQ ID NO: 962579 - DNA, 25 bp, Mus musculus
tacaaagcagctggagtttttggct

SEQ ID NO: 962580 - DNA, 25 bp, Mus musculus
tacaaagcagctggtgtttttggct

SEQ ID NO: 962581 - DNA, 25 bp, Mus musculus
tacaaagctccacgtggagtgtcat

SEQ ID NO: 962582 - DNA, 25 bp, Mus musculus
tacaaagctccaggtggagtgtcat

SEQ ID NO: 962583 - DNA, 25 bp, Mus musculus
tacaaagctgcagtatgaacaggcc

SEQ ID NO: 962584 - DNA, 25 bp, Mus musculus
tacaaagctggagtatgaacaggcc

SEQ ID NO: 962585 - DNA, 25 bp, Mus musculus
tacaaagtgaagagctcaggagctg

SEQ ID NO: 962586 - DNA, 25 bp, Mus musculus
tacaaagtgaagtgctcaggagctg

SEQ ID NO: 962587 - DNA, 25 bp, Mus musculus
tacaaatcagaatgtttctccatcc

SEQ ID NO: 962588 - DNA, 25 bp, Mus musculus
tacaaatcagtatgtttctccatcc

SEQ ID NO: 962589 - DNA, 25 bp, Mus musculus
tacaaatcattgcaggaggctgaga

SEQ ID NO: 962590 - DNA, 25 bp, Mus musculus
tacaaatcattggaggaggctgaga

SEQ ID NO: 962591 - DNA, 25 bp, Mus musculus
tacaaatcggctagataaagtggta

SEQ ID NO: 962592 - DNA, 25 bp, Mus musculus
tacaaatcgggtagataaagtggta

SEQ ID NO: 962593 - DNA, 25 bp, Mus musculus
tacaaatgcaggcaatgcaacgctg

SEQ ID NO: 962594 - DNA, 25 bp, Mus musculus
tacaaatgcagggaatgcaacgctg

SEQ ID NO: 962595 - DNA, 25 bp, Mus musculus
tacaacaagaagctagaggcagtca

SEQ ID NO: 962596 - DNA, 25 bp, Mus musculus
tacaacaagaaggtagaggcagtca

SEQ ID NO: 962597 - DNA, 25 bp, Mus musculus
tacaacaaggctcgcgtgccagggc

SEQ ID NO: 962598 - DNA, 25 bp, Mus musculus
tacaacaaggctcgggtgccagggc

SEQ ID NO: 962599 - DNA, 25 bp, Mus musculus
tacaacactgcaaccaaccagtggt

SEQ ID NO: 962600 - DNA, 25 bp, Mus musculus
tacaacactggaaccaaccagtggt

SEQ ID NO: 962601 - DNA, 25 bp, Mus musculus
tacaacagcgttaatggggcccaga

SEQ ID NO: 962602 - DNA, 25 bp, Mus musculus
tacaacagcgtttatggggcccaga

SEQ ID NO: 962603 - DNA, 25 bp, Mus musculus
tacaacatcaaacactccacgggca

SEQ ID NO: 962604 - DNA, 25 bp, Mus musculus
tacaacatcaaagactccacgggca

SEQ ID NO: 962605 - DNA, 25 bp, Mus musculus
tacaacatgcagatcgtgtcagtgg

SEQ ID NO: 962606 - DNA, 25 bp, Mus musculus
tacaacatgcagatggtgtcagtgg

SEQ ID NO: 962607 - DNA, 25 bp, Mus musculus
tacaaccaacagaccaacgacaaac

SEQ ID NO: 962608 - DNA, 25 bp, Mus musculus
tacaaccaacagtccaacgacaaac

SEQ ID NO: 962609 - DNA, 25 bp, Mus musculus
tacaaccactcacggcttcacacct

SEQ ID NO: 962610 - DNA, 25 bp, Mus musculus
tacaaccactcagggcttcacacct

SEQ ID NO: 962611 - DNA, 25 bp, Mus musculus
tacaaccagcgcctgaatgggaaac

SEQ ID NO: 962612 - DNA, 25 bp, Mus musculus
tacaaccagcgcgtgaatgggaaac

SEQ ID NO: 962613 - DNA, 25 bp, Mus musculus
tacaaccccacccacgtggaggatg

SEQ ID NO: 962614 - DNA, 25 bp, Mus musculus
tacaaccccacccactttctgtgtt

SEQ ID NO: 962615 - DNA, 25 bp, Mus musculus
tacaaccccacccaggtggaggatg

SEQ ID NO: 962616 - DNA, 25 bp, Mus musculus
tacaaccccacccagtttctgtgtt

SEQ ID NO: 962617 - DNA, 25 bp, Mus musculus
tacaacctagagaacaagcgagatg

SEQ ID NO: 962618 - DNA, 25 bp, Mus musculus
tacaacctagagaaccgagatgagc

SEQ ID NO: 962619 - DNA, 25 bp, Mus musculus
tacaacctagagaagaagcgagatg

SEQ ID NO: 962620 - DNA, 25 bp, Mus musculus
tacaacctagagaagcgagatgagc

SEQ ID NO: 962621 - DNA, 25 bp, Mus musculus
tacaacgctgacttagagaagctga

SEQ ID NO: 962622 - DNA, 25 bp, Mus musculus
tacaacgctgactttgagaagctga

SEQ ID NO: 962623 - DNA, 25 bp, Mus musculus
tacaactaccagggcagcccattcc

SEQ ID NO: 962624 - DNA, 25 bp, Mus musculus
tacaactacctgggcagcccattcc

SEQ ID NO: 962625 - DNA, 25 bp, Mus musculus
tacaactacgtgaaccaatggagac

SEQ ID NO: 962626 - DNA, 25 bp, Mus musculus
tacaactacgtgaagcaatggagac

SEQ ID NO: 962627 - DNA, 25 bp, Mus musculus
tacaactataagacggatgtttggg

SEQ ID NO: 962628 - DNA, 25 bp, Mus musculus
tacaactataagtcggatgtttggg

SEQ ID NO: 962629 - DNA, 25 bp, Mus musculus
tacaagaccaggcgttcaaggaagg

SEQ ID NO: 962630 - DNA, 25 bp, Mus musculus
tacaagaccaggggttcaaggaagg

SEQ ID NO: 962631 - DNA, 25 bp, Mus musculus
tacaagactgctaccagcaaaccaa

SEQ ID NO: 962632 - DNA, 25 bp, Mus musculus
tacaagactggtaccagcaaaccaa

SEQ ID NO: 962633 - DNA, 25 bp, Mus musculus
tacaagagcgatatgaaattgtaag

SEQ ID NO: 962634 - DNA, 25 bp, Mus musculus
tacaagagcgatttgaaattgtaag

SEQ ID NO: 962635 - DNA, 25 bp, Mus musculus
tacaagagctcgaacgcatacacag

SEQ ID NO: 962636 - DNA, 25 bp, Mus musculus
tacaagagctcgaaggcatacacag

SEQ ID NO: 962637 - DNA, 25 bp, Mus musculus
tacaagagctctgacctggaaggtg

SEQ ID NO: 962638 - DNA, 25 bp, Mus musculus
tacaagagctctgagctggaaggtg

SEQ ID NO: 962639 - DNA, 25 bp, Mus musculus
tacaagataaaaccaaaaagaagct

SEQ ID NO: 962640 - DNA, 25 bp, Mus musculus
tacaagataaaagcaaaaagaagct

SEQ ID NO: 962641 - DNA, 25 bp, Mus musculus
tacaagataaagctcacttcaattg

SEQ ID NO: 962642 - DNA, 25 bp, Mus musculus
tacaagataaaggtcacttcaattg

SEQ ID NO: 962643 - DNA, 25 bp, Mus musculus
tacaagatccacaggtgggagaacg

SEQ ID NO: 962644 - DNA, 25 bp, Mus musculus
tacaagatccactggtgggagaacg

SEQ ID NO: 962645 - DNA, 25 bp, Mus musculus
tacaagatccagacactgggcctgg

SEQ ID NO: 962646 - DNA, 25 bp, Mus musculus
tacaagatccagattcacaacgtga

SEQ ID NO: 962647 - DNA, 25 bp, Mus musculus
tacaagatccagtcactgggcctgg

SEQ ID NO: 962648 - DNA, 25 bp, Mus musculus
tacaagatccagtttcacaacgtga

SEQ ID NO: 962649 - DNA, 25 bp, Mus musculus
tacaagattgcgcagcccagacaca

SEQ ID NO: 962650 - DNA, 25 bp, Mus musculus
tacaagattgctcaactcagatcaa

SEQ ID NO: 962651 - DNA, 25 bp, Mus musculus
tacaagattgggcagcccagacaca

SEQ ID NO: 962652 - DNA, 25 bp, Mus musculus
tacaagattggtcaactcagatcaa

SEQ ID NO: 962653 - DNA, 25 bp, Mus musculus
tacaagcaagcagttacaccctgga

SEQ ID NO: 962654 - DNA, 25 bp, Mus musculus
tacaagcaaggagttacaccctgga

SEQ ID NO: 962655 - DNA, 25 bp, Mus musculus
tacaagccagcaatcagagcgaagc

SEQ ID NO: 962656 - DNA, 25 bp, Mus musculus
tacaagccagcagccatgcgaggcc

SEQ ID NO: 962657 - DNA, 25 bp, Mus musculus
tacaagccaggaatcagagcgaagc

SEQ ID NO: 962658 - DNA, 25 bp, Mus musculus
tacaagccaggagccatgcgaggcc

SEQ ID NO: 962659 - DNA, 25 bp, Mus musculus
tacaagcttcataaaattaacagac

SEQ ID NO: 962660 - DNA, 25 bp, Mus musculus
tacaagcttcataatattaacagac

SEQ ID NO: 962661 - DNA, 25 bp, Mus musculus
tacaaggacccccagagttgatggt

SEQ ID NO: 962662 - DNA, 25 bp, Mus musculus
tacaaggaccccgagagttgatggt

SEQ ID NO: 962663 - DNA, 25 bp, Mus musculus
tacaaggagaacctggacatatggt

SEQ ID NO: 962664 - DNA, 25 bp, Mus musculus
tacaaggagaacctggacttatggt

SEQ ID NO: 962665 - DNA, 25 bp, Mus musculus
tacaaggagaaccttgacatttggt

SEQ ID NO: 962666 - DNA, 25 bp, Mus musculus
tacaaggagaacgtggacatatggt

SEQ ID NO: 962667 - DNA, 25 bp, Mus musculus
tacaaggagaacgtggacttatggt

SEQ ID NO: 962668 - DNA, 25 bp, Mus musculus
tacaaggagaacgttgacatttggt

SEQ ID NO: 962669 - DNA, 25 bp, Mus musculus
tacaaggagaaggacgtggtgaata

SEQ ID NO: 962670 - DNA, 25 bp, Mus musculus
tacaaggagaaggaggtggtgaata

SEQ ID NO: 962671 - DNA, 25 bp, Mus musculus
tacaaggagagagtcagtgcatctg

SEQ ID NO: 962672 - DNA, 25 bp, Mus musculus
tacaaggagagagtgagtgcatctg

SEQ ID NO: 962673 - DNA, 25 bp, Mus musculus
tacaaggcactcaacgactataagt

SEQ ID NO: 962674 - DNA, 25 bp, Mus musculus
tacaaggcactcaaggactataagt

SEQ ID NO: 962675 - DNA, 25 bp, Mus musculus
tacaaggtagcaaacggtgtggaat

SEQ ID NO: 962676 - DNA, 25 bp, Mus musculus
tacaaggtagcaaagggtgtggaat

SEQ ID NO: 962677 - DNA, 25 bp, Mus musculus
tacaaggtgaccaacggacgtgcaa

SEQ ID NO: 962678 - DNA, 25 bp, Mus musculus
tacaaggtgaccaagggacgtgcaa

SEQ ID NO: 962679 - DNA, 25 bp, Mus musculus
tacaagtacattctgacctgtgcag

SEQ ID NO: 962680 - DNA, 25 bp, Mus musculus
tacaagtacattgtgacctgtgcag

SEQ ID NO: 962681 - DNA, 25 bp, Mus musculus
tacaagtctacaactctcccaggaa

SEQ ID NO: 962682 - DNA, 25 bp, Mus musculus
tacaagtctacatctctcccaggaa

SEQ ID NO: 962683 - DNA, 25 bp, Mus musculus
tacaataatgaccaatggacattga

SEQ ID NO: 962684 - DNA, 25 bp, Mus musculus
tacaataatgtccaatggacattga

SEQ ID NO: 962685 - DNA, 25 bp, Mus musculus
tacaatacaaataaagagagacaaa

SEQ ID NO: 962686 - DNA, 25 bp, Mus musculus
tacaatacaaattaagagagacaaa

SEQ ID NO: 962687 - DNA, 25 bp, Mus musculus
tacaataccagataataaatgacac

SEQ ID NO: 962688 - DNA, 25 bp, Mus musculus
tacaataccagatattaaatgacac

SEQ ID NO: 962689 - DNA, 25 bp, Mus musculus
tacaatatgcagaatctcatgaccg

SEQ ID NO: 962690 - DNA, 25 bp, Mus musculus
tacaatatgcagtatctcatgaccg

SEQ ID NO: 962691 - DNA, 25 bp, Mus musculus
tacaatcaagatttctgaccgagga

SEQ ID NO: 962692 - DNA, 25 bp, Mus musculus
tacaatcaagttttctgaccgagga

SEQ ID NO: 962693 - DNA, 25 bp, Mus musculus
tacaatgaaggcctgtctgtgtcag

SEQ ID NO: 962694 - DNA, 25 bp, Mus musculus
tacaatgaaggcgtgtctgtgtcag

SEQ ID NO: 962695 - DNA, 25 bp, Mus musculus
tacaatgagaagatctatgagctgc

SEQ ID NO: 962696 - DNA, 25 bp, Mus musculus
tacaatgagaagttctatgagctgc

SEQ ID NO: 962697 - DNA, 25 bp, Mus musculus
tacaatgcagctcgtctcatatctc

SEQ ID NO: 962698 - DNA, 25 bp, Mus musculus
tacaatgcagctggtctcatatctc

SEQ ID NO: 962699 - DNA, 25 bp, Mus musculus
tacaatgctaaccgcgcatttcaga

SEQ ID NO: 962700 - DNA, 25 bp, Mus musculus
tacaatgctaaccgggcatttcaga

SEQ ID NO: 962701 - DNA, 25 bp, Mus musculus
tacaatgctcagccctttggctcgg

SEQ ID NO: 962702 - DNA, 25 bp, Mus musculus
tacaatgctcaggcctttggctcgg

SEQ ID NO: 962703 - DNA, 25 bp, Mus musculus
tacaatgtaaagcaccttttccggc

SEQ ID NO: 962704 - DNA, 25 bp, Mus musculus
tacaatgtaaagcagcttttccggc

SEQ ID NO: 962705 - DNA, 25 bp, Mus musculus
tacaattgcacgctagtgcagtaca

SEQ ID NO: 962706 - DNA, 25 bp, Mus musculus
tacaattgcacggtagtgcagtaca

SEQ ID NO: 962707 - DNA, 25 bp, Mus musculus
tacacaaaaacctgttcagcagaca

SEQ ID NO: 962708 - DNA, 25 bp, Mus musculus
tacacaaaaagctgttcagcagaca

SEQ ID NO: 962709 - DNA, 25 bp, Mus musculus
tacacaacagcaaacgaatttgcag

SEQ ID NO: 962710 - DNA, 25 bp, Mus musculus
tacacaacagcaaaggaatttgcag

SEQ ID NO: 962711 - DNA, 25 bp, Mus musculus
tacacaacggattttatccttcacc

SEQ ID NO: 962712 - DNA, 25 bp, Mus musculus
tacacaacggtttttatccttcacc

SEQ ID NO: 962713 - DNA, 25 bp, Mus musculus
tacacaagcacaccacggccctgcc

SEQ ID NO: 962714 - DNA, 25 bp, Mus musculus
tacacaagcacagcacggccctgcc

SEQ ID NO: 962715 - DNA, 25 bp, Mus musculus
tacacaataatgcagtgatagaagg

SEQ ID NO: 962716 - DNA, 25 bp, Mus musculus
tacacaataatggagtgatagaagg

SEQ ID NO: 962717 - DNA, 25 bp, Mus musculus
tacacaatggagcatatccgtgtgg

SEQ ID NO: 962718 - DNA, 25 bp, Mus musculus
tacacaatggaggatatccgtgtgg

SEQ ID NO: 962719 - DNA, 25 bp, Mus musculus
tacacactccgacacctttccacca

SEQ ID NO: 962720 - DNA, 25 bp, Mus musculus
tacacactccgacagctttccacca

SEQ ID NO: 962721 - DNA, 25 bp, Mus musculus
tacacagaagccaagcgtccaccag

SEQ ID NO: 962722 - DNA, 25 bp, Mus musculus
tacacagaagcctagcgtccaccag

SEQ ID NO: 962723 - DNA, 25 bp, Mus musculus
tacacagagaatgacggtaagatga

SEQ ID NO: 962724 - DNA, 25 bp, Mus musculus
tacacagagaatgagggtaagatga

SEQ ID NO: 962725 - DNA, 25 bp, Mus musculus
tacacagagccaacaatgacaacac

SEQ ID NO: 962726 - DNA, 25 bp, Mus musculus
tacacagagccatcaatgacaacac

SEQ ID NO: 962727 - DNA, 25 bp, Mus musculus
tacacagagcctgacgtgtttaaat

SEQ ID NO: 962728 - DNA, 25 bp, Mus musculus
tacacagagcctgaggtgtttaaat

SEQ ID NO: 962729 - DNA, 25 bp, Mus musculus
tacacagaggaccacgtggtctcca

SEQ ID NO: 962730 - DNA, 25 bp, Mus musculus
tacacagaggaccaggtggtctcca

SEQ ID NO: 962731 - DNA, 25 bp, Mus musculus
tacacagaggcgctgaaggaatatg

SEQ ID NO: 962732 - DNA, 25 bp, Mus musculus
tacacagaggcggtgaaggaatatg

SEQ ID NO: 962733 - DNA, 25 bp, Mus musculus
tacacagccagcatctgttcctggc

SEQ ID NO: 962734 - DNA, 25 bp, Mus musculus
tacacagccagcatgtgttcctggc

SEQ ID NO: 962735 - DNA, 25 bp, Mus musculus
tacacagccaggagtcctgtctcaa

SEQ ID NO: 962736 - DNA, 25 bp, Mus musculus
tacacagccaggtgtcctgtctcaa

SEQ ID NO: 962737 - DNA, 25 bp, Mus musculus
tacacagctgaacgagagactagaa

SEQ ID NO: 962738 - DNA, 25 bp, Mus musculus
tacacagctgaaggagagactagaa

SEQ ID NO: 962739 - DNA, 25 bp, Mus musculus
tacacaggacatcatgcctatgcct

SEQ ID NO: 962740 - DNA, 25 bp, Mus musculus
tacacaggacttcatgcctatgcct

SEQ ID NO: 962741 - DNA, 25 bp, Mus musculus
tacacagtccggctgtattcagcct

SEQ ID NO: 962742 - DNA, 25 bp, Mus musculus
tacacagtccgggtgtattcagcct

SEQ ID NO: 962743 - DNA, 25 bp, Mus musculus
tacacatatgaggacttgctgaacc

SEQ ID NO: 962744 - DNA, 25 bp, Mus musculus
tacacatatgaggagttgctgaacc

SEQ ID NO: 962745 - DNA, 25 bp, Mus musculus
tacacatcaaagctttggtgtactt

SEQ ID NO: 962746 - DNA, 25 bp, Mus musculus
tacacatcaaaggtttggtgtactt

SEQ ID NO: 962747 - DNA, 25 bp, Mus musculus
tacacatcccaacgtcgagacatca

SEQ ID NO: 962748 - DNA, 25 bp, Mus musculus
tacacatcccaaggtcgagacatca

SEQ ID NO: 962749 - DNA, 25 bp, Mus musculus
tacacattgctgcacatggtgcagt

SEQ ID NO: 962750 - DNA, 25 bp, Mus musculus
tacacattgctggacatggtgcagt

SEQ ID NO: 962751 - DNA, 25 bp, Mus musculus
tacaccacttatggccctacaaaga

SEQ ID NO: 962752 - DNA, 25 bp, Mus musculus
tacaccacttatgggcctacaaaga

SEQ ID NO: 962753 - DNA, 25 bp, Mus musculus
tacaccatccagaaactcatcgagg

SEQ ID NO: 962754 - DNA, 25 bp, Mus musculus
tacaccatccagtaactcatcgagg

SEQ ID NO: 962755 - DNA, 25 bp, Mus musculus
tacaccattggtctccaggcaccgc

SEQ ID NO: 962756 - DNA, 25 bp, Mus musculus
tacaccattggtctgcaggcaccgc

SEQ ID NO: 962757 - DNA, 25 bp, Mus musculus
tacacccagacaagaaggtatcgca

SEQ ID NO: 962758 - DNA, 25 bp, Mus musculus
tacacccagacaagtaggtatcgca

SEQ ID NO: 962759 - DNA, 25 bp, Mus musculus
tacaccctcaagattgtagaagaag

SEQ ID NO: 962760 - DNA, 25 bp, Mus musculus
tacaccctcaagtttgtagaagaag

SEQ ID NO: 962761 - DNA, 25 bp, Mus musculus
tacaccgctccaatcagggtatgaa

SEQ ID NO: 962762 - DNA, 25 bp, Mus musculus
tacaccgctccaatgagggtatgaa

SEQ ID NO: 962763 - DNA, 25 bp, Mus musculus
tacacctcttatatcgttctctgac

SEQ ID NO: 962764 - DNA, 25 bp, Mus musculus
tacacctcttatatggttctctgac

SEQ ID NO: 962765 - DNA, 25 bp, Mus musculus
tacaccttccagcacttcacggagc

SEQ ID NO: 962766 - DNA, 25 bp, Mus musculus
tacaccttccaggacttcacggagc

SEQ ID NO: 962767 - DNA, 25 bp, Mus musculus
tacaccttccgccactttcgtgatc

SEQ ID NO: 962768 - DNA, 25 bp, Mus musculus
tacaccttccgccagtttcgtgatc

SEQ ID NO: 962769 - DNA, 25 bp, Mus musculus
tacaccttctgcagcaaatctcccg

SEQ ID NO: 962770 - DNA, 25 bp, Mus musculus
tacaccttctgcaggaaatctcccg

SEQ ID NO: 962771 - DNA, 25 bp, Mus musculus
tacacgaccgtgcgtggtatgaagg

SEQ ID NO: 962772 - DNA, 25 bp, Mus musculus
tacacgaccgtgggtggtatgaagg

SEQ ID NO: 962773 - DNA, 25 bp, Mus musculus
tacacgcagacactggacatttggt

SEQ ID NO: 962774 - DNA, 25 bp, Mus musculus
tacacgcagacagtggacatttggt

SEQ ID NO: 962775 - DNA, 25 bp, Mus musculus
tacacggagtctgacggaaccttca

SEQ ID NO: 962776 - DNA, 25 bp, Mus musculus
tacacggagtctgagggaaccttca

SEQ ID NO: 962777 - DNA, 25 bp, Mus musculus
tacacggtccagcatgagagtcatt

SEQ ID NO: 962778 - DNA, 25 bp, Mus musculus
tacacggtccaggatgagagtcatt

SEQ ID NO: 962779 - DNA, 25 bp, Mus musculus
tacacgtctgcccgtgtgctgatgt

SEQ ID NO: 962780 - DNA, 25 bp, Mus musculus
tacacgtctgccggtgtgctgatgt

SEQ ID NO: 962781 - DNA, 25 bp, Mus musculus
tacactagagttgtaaggagaacac

SEQ ID NO: 962782 - DNA, 25 bp, Mus musculus
tacactagagttgttaggagaacac

SEQ ID NO: 962783 - DNA, 25 bp, Mus musculus
tacactattggtgacgttccaattt

SEQ ID NO: 962784 - DNA, 25 bp, Mus musculus
tacactattggtgaggttccaattt

SEQ ID NO: 962785 - DNA, 25 bp, Mus musculus
tacactccagcaacactatggctct

SEQ ID NO: 962786 - DNA, 25 bp, Mus musculus
tacactccaggaacactatggctct

SEQ ID NO: 962787 - DNA, 25 bp, Mus musculus
tacactctactgagggaagtgccac

SEQ ID NO: 962788 - DNA, 25 bp, Mus musculus
tacactctactgtgggaagtgccac

SEQ ID NO: 962789 - DNA, 25 bp, Mus musculus
tacactgaccctcacatagtgtttc

SEQ ID NO: 962790 - DNA, 25 bp, Mus musculus
tacactgaccctcagatagtgtttc

SEQ ID NO: 962791 - DNA, 25 bp, Mus musculus
tacactgttgatggccgccccatcc

SEQ ID NO: 962792 - DNA, 25 bp, Mus musculus
tacactgttgttggccgccccatcc

SEQ ID NO: 962793 - DNA, 25 bp, Mus musculus
tacacttcaacatgtttgatgtggg

SEQ ID NO: 962794 - DNA, 25 bp, Mus musculus
tacacttcaacggtctgagcgcaag

SEQ ID NO: 962795 - DNA, 25 bp, Mus musculus
tacacttcaagatgtttgatgtggg

SEQ ID NO: 962796 - DNA, 25 bp, Mus musculus
tacacttcaagggtctgagcgcaag

SEQ ID NO: 962797 - DNA, 25 bp, Mus musculus
tacacttctggacaccacatgtgtc

SEQ ID NO: 962798 - DNA, 25 bp, Mus musculus
tacacttctggacgaaaatatgtcg

SEQ ID NO: 962799 - DNA, 25 bp, Mus musculus
tacacttctggagaccacatgtgtc

SEQ ID NO: 962800 - DNA, 25 bp, Mus musculus
tacacttctggaggaaaatatgtcg

SEQ ID NO: 962801 - DNA, 25 bp, Mus musculus
tacactttggaacacattcaagtca

SEQ ID NO: 962802 - DNA, 25 bp, Mus musculus
tacactttggaacagattcaagtca

SEQ ID NO: 962803 - DNA, 25 bp, Mus musculus
tacagaaaagcgtgtgtttgacgtg

SEQ ID NO: 962804 - DNA, 25 bp, Mus musculus
tacagaaaagggtgtgtttgacgtg

SEQ ID NO: 962805 - DNA, 25 bp, Mus musculus
tacagaaatcgacctgaggaaacgt

SEQ ID NO: 962806 - DNA, 25 bp, Mus musculus
tacagaaatcgagctgaggaaacgt

SEQ ID NO: 962807 - DNA, 25 bp, Mus musculus
tacagaactcccacatgtatgcaca

SEQ ID NO: 962808 - DNA, 25 bp, Mus musculus
tacagaactcccacttgtatgcaca

SEQ ID NO: 962809 - DNA, 25 bp, Mus musculus
tacagaagacagcaacccgctttga

SEQ ID NO: 962810 - DNA, 25 bp, Mus musculus
tacagaagacaggaacccgctttga

SEQ ID NO: 962811 - DNA, 25 bp, Mus musculus
tacagaagagacaggtgagaactca

SEQ ID NO: 962812 - DNA, 25 bp, Mus musculus
tacagaagaggacatctcagcaatg

SEQ ID NO: 962813 - DNA, 25 bp, Mus musculus
tacagaagaggagatctcagcaatg

SEQ ID NO: 962814 - DNA, 25 bp, Mus musculus
tacagaagagtcaggtgagaactca

SEQ ID NO: 962815 - DNA, 25 bp, Mus musculus
tacagaagctgacgtttaagagtgc

SEQ ID NO: 962816 - DNA, 25 bp, Mus musculus
tacagaagctgaggtttaagagtgc

SEQ ID NO: 962817 - DNA, 25 bp, Mus musculus
tacagacaagctgaccttgaacaga

SEQ ID NO: 962818 - DNA, 25 bp, Mus musculus
tacagacaaggtgaccttgaacaga

SEQ ID NO: 962819 - DNA, 25 bp, Mus musculus
tacagacatgattcacaatcgcagc

SEQ ID NO: 962820 - DNA, 25 bp, Mus musculus
tacagacatgcgcagattcacaatc

SEQ ID NO: 962821 - DNA, 25 bp, Mus musculus
tacagacatgggcagattcacaatc

SEQ ID NO: 962822 - DNA, 25 bp, Mus musculus
tacagacatgtttcacaatcgcagc

SEQ ID NO: 962823 - DNA, 25 bp, Mus musculus
tacagaccaaagatggatgcatcta

SEQ ID NO: 962824 - DNA, 25 bp, Mus musculus
tacagaccaaagttggatgcatcta

SEQ ID NO: 962825 - DNA, 25 bp, Mus musculus
tacagactggatgggaacttctcca

SEQ ID NO: 962826 - DNA, 25 bp, Mus musculus
tacagactggttgggaacttctcca

SEQ ID NO: 962827 - DNA, 25 bp, Mus musculus
tacagagaagctcggacactgattc

SEQ ID NO: 962828 - DNA, 25 bp, Mus musculus
tacagagaaggtcggacactgattc

SEQ ID NO: 962829 - DNA, 25 bp, Mus musculus
tacagagaagtcaacggcaaggcat

SEQ ID NO: 962830 - DNA, 25 bp, Mus musculus
tacagagaagtcaagggcaaggcat

SEQ ID NO: 962831 - DNA, 25 bp, Mus musculus
tacagagaccagctctttggccagt

SEQ ID NO: 962832 - DNA, 25 bp, Mus musculus
tacagagaccaggtctttggccagt

SEQ ID NO: 962833 - DNA, 25 bp, Mus musculus
tacagagagacacgccatccattta

SEQ ID NO: 962834 - DNA, 25 bp, Mus musculus
tacagagagacaggccatccattta

SEQ ID NO: 962835 - DNA, 25 bp, Mus musculus
tacagagagcagattctgccctttc

SEQ ID NO: 962836 - DNA, 25 bp, Mus musculus
tacagagagcagtttctgccctttc

SEQ ID NO: 962837 - DNA, 25 bp, Mus musculus
tacagagcaaagctggagaacgagg

SEQ ID NO: 962838 - DNA, 25 bp, Mus musculus
tacagagcaaaggtggagaacgagg

SEQ ID NO: 962839 - DNA, 25 bp, Mus musculus
tacagagctaagaatgtgagactat

SEQ ID NO: 962840 - DNA, 25 bp, Mus musculus
tacagagctaagtatgtgagactat

SEQ ID NO: 962841 - DNA, 25 bp, Mus musculus
tacagaggtgaccaacaggccatcg

SEQ ID NO: 962842 - DNA, 25 bp, Mus musculus
tacagaggtgcgcttactgtaagtg

SEQ ID NO: 962843 - DNA, 25 bp, Mus musculus
tacagaggtgggcttactgtaagtg

SEQ ID NO: 962844 - DNA, 25 bp, Mus musculus
tacagaggtgtccaacaggccatcg

SEQ ID NO: 962845 - DNA, 25 bp, Mus musculus
tacagataagcaactgctgaagaag

SEQ ID NO: 962846 - DNA, 25 bp, Mus musculus
tacagataagctgttctcattgtta

SEQ ID NO: 962847 - DNA, 25 bp, Mus musculus
tacagataaggaactgctgaagaag

SEQ ID NO: 962848 - DNA, 25 bp, Mus musculus
tacagataaggtgttctcattgtta

SEQ ID NO: 962849 - DNA, 25 bp, Mus musculus
tacagattcgctgacgtaccatcgt

SEQ ID NO: 962850 - DNA, 25 bp, Mus musculus
tacagattcgctgaggtaccatcgt

SEQ ID NO: 962851 - DNA, 25 bp, Mus musculus
tacagcaaacagatgcgtgtacatc

SEQ ID NO: 962852 - DNA, 25 bp, Mus musculus
tacagcaaacagccatttcgtagag

SEQ ID NO: 962853 - DNA, 25 bp, Mus musculus
tacagcaaacaggcatttcgtagag

SEQ ID NO: 962854 - DNA, 25 bp, Mus musculus
tacagcaaacagttgcgtgtacatc

SEQ ID NO: 962855 - DNA, 25 bp, Mus musculus
tacagcaaaccacgactagacaagg

SEQ ID NO: 962856 - DNA, 25 bp, Mus musculus
tacagcaaaccaggactagacaagg

SEQ ID NO: 962857 - DNA, 25 bp, Mus musculus
tacagcaaataacgagacagtgatg

SEQ ID NO: 962858 - DNA, 25 bp, Mus musculus
tacagcaaataaggagacagtgatg

SEQ ID NO: 962859 - DNA, 25 bp, Mus musculus
tacagcacacagccagaggtgttaa

SEQ ID NO: 962860 - DNA, 25 bp, Mus musculus
tacagcacacaggcagaggtgttaa

SEQ ID NO: 962861 - DNA, 25 bp, Mus musculus
tacagcagaccacgaaacataagca

SEQ ID NO: 962862 - DNA, 25 bp, Mus musculus
tacagcagaccaggaaacataagca

SEQ ID NO: 962863 - DNA, 25 bp, Mus musculus
tacagcagagcatgctttcgcagca

SEQ ID NO: 962864 - DNA, 25 bp, Mus musculus
tacagcagaggatgctttcgcagca

SEQ ID NO: 962865 - DNA, 25 bp, Mus musculus
tacagcagcccacgacttggagtga

SEQ ID NO: 962866 - DNA, 25 bp, Mus musculus
tacagcagcccaggacttggagtga

SEQ ID NO: 962867 - DNA, 25 bp, Mus musculus
tacagcagcctaaaaaagggcaaga

SEQ ID NO: 962868 - DNA, 25 bp, Mus musculus
tacagcagcctaaataagggcaaga

SEQ ID NO: 962869 - DNA, 25 bp, Mus musculus
tacagcataacacggtcttggcagc

SEQ ID NO: 962870 - DNA, 25 bp, Mus musculus
tacagcataacagggtcttggcagc

SEQ ID NO: 962871 - DNA, 25 bp, Mus musculus
tacagcattactcacagaaagctga

SEQ ID NO: 962872 - DNA, 25 bp, Mus musculus
tacagcattactcacagagagccgc

SEQ ID NO: 962873 - DNA, 25 bp, Mus musculus
tacagcattactcagagaaagctga

SEQ ID NO: 962874 - DNA, 25 bp, Mus musculus
tacagcattactcagagagagccgc

SEQ ID NO: 962875 - DNA, 25 bp, Mus musculus
tacagccaggatcaggtagatgact

SEQ ID NO: 962876 - DNA, 25 bp, Mus musculus
tacagccaggatctgagtgttcgag

SEQ ID NO: 962877 - DNA, 25 bp, Mus musculus
tacagccaggatgaggtagatgact

SEQ ID NO: 962878 - DNA, 25 bp, Mus musculus
tacagccaggatgtgagtgttcgag

SEQ ID NO: 962879 - DNA, 25 bp, Mus musculus
tacagccgagggcacccgaaggctg

SEQ ID NO: 962880 - DNA, 25 bp, Mus musculus
tacagccgaggggacccgaaggctg

SEQ ID NO: 962881 - DNA, 25 bp, Mus musculus
tacagcctcacaatagaacagttga

SEQ ID NO: 962882 - DNA, 25 bp, Mus musculus
tacagcctcacattagaacagttga

SEQ ID NO: 962883 - DNA, 25 bp, Mus musculus
tacagcctcagtgacgccataactg

SEQ ID NO: 962884 - DNA, 25 bp, Mus musculus
tacagcctcagtgaggccataactg

SEQ ID NO: 962885 - DNA, 25 bp, Mus musculus
tacagcctccagctgtcatccatca

SEQ ID NO: 962886 - DNA, 25 bp, Mus musculus
tacagcctccaggtgtcatccatca

SEQ ID NO: 962887 - DNA, 25 bp, Mus musculus
tacagcgctgacttagagaaacgga

SEQ ID NO: 962888 - DNA, 25 bp, Mus musculus
tacagcgctgacttaggcctgcatg

SEQ ID NO: 962889 - DNA, 25 bp, Mus musculus
tacagcgctgactttgagaaacgga

SEQ ID NO: 962890 - DNA, 25 bp, Mus musculus
tacagcgctgactttggcctgcatg

SEQ ID NO: 962891 - DNA, 25 bp, Mus musculus
tacagcgctgtgatgatgaccagcc

SEQ ID NO: 962892 - DNA, 25 bp, Mus musculus
tacagcgctgtgttgatgaccagcc

SEQ ID NO: 962893 - DNA, 25 bp, Mus musculus
tacagctaaagacaatggactcgct

SEQ ID NO: 962894 - DNA, 25 bp, Mus musculus
tacagctaaagagaatggactcgct

SEQ ID NO: 962895 - DNA, 25 bp, Mus musculus
tacagctacctaccatgtccaaaat

SEQ ID NO: 962896 - DNA, 25 bp, Mus musculus
tacagctacctagcatgtccaaaat

SEQ ID NO: 962897 - DNA, 25 bp, Mus musculus
tacagctcagcaaatggagacagag

SEQ ID NO: 962898 - DNA, 25 bp, Mus musculus
tacagctcagcaacaagaagaaatt

SEQ ID NO: 962899 - DNA, 25 bp, Mus musculus
tacagctcagcaagcagtggctgga

SEQ ID NO: 962900 - DNA, 25 bp, Mus musculus
tacagctcagccgaatttcacagcc

SEQ ID NO: 962901 - DNA, 25 bp, Mus musculus
tacagctcaggaaatggagacagag

SEQ ID NO: 962902 - DNA, 25 bp, Mus musculus
tacagctcaggaacaagaagaaatt

SEQ ID NO: 962903 - DNA, 25 bp, Mus musculus
tacagctcaggaagcagtggctgga

SEQ ID NO: 962904 - DNA, 25 bp, Mus musculus
tacagctcaggcgaatttcacagcc

SEQ ID NO: 962905 - DNA, 25 bp, Mus musculus
tacagctccatgcatggttcctggc

SEQ ID NO: 962906 - DNA, 25 bp, Mus musculus
tacagctccatggatggttcctggc

SEQ ID NO: 962907 - DNA, 25 bp, Mus musculus
tacagcttcgctcggtggatgtggc

SEQ ID NO: 962908 - DNA, 25 bp, Mus musculus
tacagcttcgctgggtggatgtggc

SEQ ID NO: 962909 - DNA, 25 bp, Mus musculus
tacagcttttacaaccttcaaaacc

SEQ ID NO: 962910 - DNA, 25 bp, Mus musculus
tacagcttttacaagcttcaaaacc

SEQ ID NO: 962911 - DNA, 25 bp, Mus musculus
tacaggaaatacatcctgtctgtgc

SEQ ID NO: 962912 - DNA, 25 bp, Mus musculus
tacaggaaatacatgctgtctgtgc

SEQ ID NO: 962913 - DNA, 25 bp, Mus musculus
tacaggaagccaaaattctgaagca

SEQ ID NO: 962914 - DNA, 25 bp, Mus musculus
tacaggaagccataattctgaagca

SEQ ID NO: 962915 - DNA, 25 bp, Mus musculus
tacaggagaagtcgtgcatggatgt

SEQ ID NO: 962916 - DNA, 25 bp, Mus musculus
tacaggagaagtcgtggcctgcttg

SEQ ID NO: 962917 - DNA, 25 bp, Mus musculus
tacaggagaagtggtgcatggatgt

SEQ ID NO: 962918 - DNA, 25 bp, Mus musculus
tacaggagaagtggtggcctgcttg

SEQ ID NO: 962919 - DNA, 25 bp, Mus musculus
tacaggagatatcagcaacaaaagc

SEQ ID NO: 962920 - DNA, 25 bp, Mus musculus
tacaggagatatgagcaacaaaagc

SEQ ID NO: 962921 - DNA, 25 bp, Mus musculus
tacaggagatatgcccaacaaaagc

SEQ ID NO: 962922 - DNA, 25 bp, Mus musculus
tacaggagatatgcgcaacaaaagc

SEQ ID NO: 962923 - DNA, 25 bp, Mus musculus
tacaggaggccacgaagtccttctt

SEQ ID NO: 962924 - DNA, 25 bp, Mus musculus
tacaggaggccaggaagtccttctt

SEQ ID NO: 962925 - DNA, 25 bp, Mus musculus
tacaggatagagactaatgctcata

SEQ ID NO: 962926 - DNA, 25 bp, Mus musculus
tacaggatagagtctaatgctcata

SEQ ID NO: 962927 - DNA, 25 bp, Mus musculus
tacaggcaagctgagctccacctga

SEQ ID NO: 962928 - DNA, 25 bp, Mus musculus
tacaggcaaggtgagctccacctga

SEQ ID NO: 962929 - DNA, 25 bp, Mus musculus
tacaggccagacattgttggatttg

SEQ ID NO: 962930 - DNA, 25 bp, Mus musculus
tacaggccagactttgttggatttg

SEQ ID NO: 962931 - DNA, 25 bp, Mus musculus
tacaggcgagatgatttttgatcct

SEQ ID NO: 962932 - DNA, 25 bp, Mus musculus
tacaggcgagttgatttttgatcct

SEQ ID NO: 962933 - DNA, 25 bp, Mus musculus
tacagggagcacctcaattctgatg

SEQ ID NO: 962934 - DNA, 25 bp, Mus musculus
tacagggagcacctgaattctgatg

SEQ ID NO: 962935 - DNA, 25 bp, Mus musculus
tacagggtctatgacctaattatag

SEQ ID NO: 962936 - DNA, 25 bp, Mus musculus
tacagggtctatgagctaattatag

SEQ ID NO: 962937 - DNA, 25 bp, Mus musculus
tacaggtacaggcacgcaaaggctc

SEQ ID NO: 962938 - DNA, 25 bp, Mus musculus
tacaggtacaggcaggcaaaggctc

SEQ ID NO: 962939 - DNA, 25 bp, Mus musculus
tacaggtgatcgagtcagcaatgga

SEQ ID NO: 962940 - DNA, 25 bp, Mus musculus
tacaggtgatcgtgtcagcaatgga

SEQ ID NO: 962941 - DNA, 25 bp, Mus musculus
tacaggtgctgaaacgtattcccaa

SEQ ID NO: 962942 - DNA, 25 bp, Mus musculus
tacaggtgctgaaaggtattcccaa

SEQ ID NO: 962943 - DNA, 25 bp, Mus musculus
tacaggttccagatctcttgctacc

SEQ ID NO: 962944 - DNA, 25 bp, Mus musculus
tacaggttccagttctcttgctacc

SEQ ID NO: 962945 - DNA, 25 bp, Mus musculus
tacagtaaaaccccatccaaaatat

SEQ ID NO: 962946 - DNA, 25 bp, Mus musculus
tacagtaaaagcccatccaaaatat

SEQ ID NO: 962947 - DNA, 25 bp, Mus musculus
tacagtaaatggaagatcaagatcg

SEQ ID NO: 962948 - DNA, 25 bp, Mus musculus
tacagtaaatggtagatcaagatcg

SEQ ID NO: 962949 - DNA, 25 bp, Mus musculus
tacagtacagccaaatttccagggc

SEQ ID NO: 962950 - DNA, 25 bp, Mus musculus
tacagtacaggcaaatttccagggc

SEQ ID NO: 962951 - DNA, 25 bp, Mus musculus
tacagtaggggacatcactattgct

SEQ ID NO: 962952 - DNA, 25 bp, Mus musculus
tacagtaggggagatcactattgct

SEQ ID NO: 962953 - DNA, 25 bp, Mus musculus
tacagtcactaccacgtgcagaccc

SEQ ID NO: 962954 - DNA, 25 bp, Mus musculus
tacagtcactaccaggtgcagaccc

SEQ ID NO: 962955 - DNA, 25 bp, Mus musculus
tacagtcagtacctaccgtgctgtg

SEQ ID NO: 962956 - DNA, 25 bp, Mus musculus
tacagtcagtacctagatcgacagc

SEQ ID NO: 962957 - DNA, 25 bp, Mus musculus
tacagtcagtaccttccgtgctgtg

SEQ ID NO: 962958 - DNA, 25 bp, Mus musculus
tacagtcagtaccttgatcgacagc

SEQ ID NO: 962959 - DNA, 25 bp, Mus musculus
tacagtcatacactccagacaagac

SEQ ID NO: 962960 - DNA, 25 bp, Mus musculus
tacagtcatacagtccagacaagac

SEQ ID NO: 962961 - DNA, 25 bp, Mus musculus
tacagtcctaagagtgacttggtac

SEQ ID NO: 962962 - DNA, 25 bp, Mus musculus
tacagtcctaagtgtgacttggtac

SEQ ID NO: 962963 - DNA, 25 bp, Mus musculus
tacagtcctcagccaaacaggtatg

SEQ ID NO: 962964 - DNA, 25 bp, Mus musculus
tacagtcctcaggcaaacaggtatg

SEQ ID NO: 962965 - DNA, 25 bp, Mus musculus
tacagtgacaagattgacagttatg

SEQ ID NO: 962966 - DNA, 25 bp, Mus musculus
tacagtgacaagtttgacagttatg

SEQ ID NO: 962967 - DNA, 25 bp, Mus musculus
tacagtgaccaccctggaccagcta

SEQ ID NO: 962968 - DNA, 25 bp, Mus musculus
tacagtgaccacgctggaccagcta

SEQ ID NO: 962969 - DNA, 25 bp, Mus musculus
tacagtgatcagcttcagcgtcctc

SEQ ID NO: 962970 - DNA, 25 bp, Mus musculus
tacagtgatcaggttcagcgtcctc

SEQ ID NO: 962971 - DNA, 25 bp, Mus musculus
tacagtgcacagctcgtatgcatgg

SEQ ID NO: 962972 - DNA, 25 bp, Mus musculus
tacagtgcacagctggtatgcatgg

SEQ ID NO: 962973 - DNA, 25 bp, Mus musculus
tacagtgcctcacagaccatgatgg

SEQ ID NO: 962974 - DNA, 25 bp, Mus musculus
tacagtgcctcagagaccatgatgg

SEQ ID NO: 962975 - DNA, 25 bp, Mus musculus
tacagtgcgcgccatgaggctgtag

SEQ ID NO: 962976 - DNA, 25 bp, Mus musculus
tacagtgcgcgcgatgaggctgtag

SEQ ID NO: 962977 - DNA, 25 bp, Mus musculus
tacagtgtgcctctcgatgcacttc

SEQ ID NO: 962978 - DNA, 25 bp, Mus musculus
tacagtgtgcctctggatgcacttc

SEQ ID NO: 962979 - DNA, 25 bp, Mus musculus
tacagtgtttaataaagtagattat

SEQ ID NO: 962980 - DNA, 25 bp, Mus musculus
tacagtgtttaatatagtagattat

SEQ ID NO: 962981 - DNA, 25 bp, Mus musculus
tacagttaagcaagctgtgctgaat

SEQ ID NO: 962982 - DNA, 25 bp, Mus musculus
tacagttaaggaagctgtgctgaat

SEQ ID NO: 962983 - DNA, 25 bp, Mus musculus
tacagttaagtactcttttcacaga

SEQ ID NO: 962984 - DNA, 25 bp, Mus musculus
tacagttaagtagtcttttcacaga

SEQ ID NO: 962985 - DNA, 25 bp, Mus musculus
tacagtttcagactttctaagctga

SEQ ID NO: 962986 - DNA, 25 bp, Mus musculus
tacagtttcagagtttctaagctga

SEQ ID NO: 962987 - DNA, 25 bp, Mus musculus
tacataaaagagcaactcattatac

SEQ ID NO: 962988 - DNA, 25 bp, Mus musculus
tacataaaagaggaactcattatac

SEQ ID NO: 962989 - DNA, 25 bp, Mus musculus
tacatacagccacagaagtgacagg

SEQ ID NO: 962990 - DNA, 25 bp, Mus musculus
tacatacagccacgaaacaaagctt

SEQ ID NO: 962991 - DNA, 25 bp, Mus musculus
tacatacagccacgaaggaatctgc

SEQ ID NO: 962992 - DNA, 25 bp, Mus musculus
tacatacagccagagaagtgacagg

SEQ ID NO: 962993 - DNA, 25 bp, Mus musculus
tacatacagccaggaaacaaagctt

SEQ ID NO: 962994 - DNA, 25 bp, Mus musculus
tacatacagccaggaaggaatctgc

SEQ ID NO: 962995 - DNA, 25 bp, Mus musculus
tacatacgacagctccctcctagct

SEQ ID NO: 962996 - DNA, 25 bp, Mus musculus
tacatacgacagctcggctacttga

SEQ ID NO: 962997 - DNA, 25 bp, Mus musculus
tacatacgacagctgcctcctagct

SEQ ID NO: 962998 - DNA, 25 bp, Mus musculus
tacatacgacagctgggctacttga

SEQ ID NO: 962999 - DNA, 25 bp, Mus musculus
tacatcaaaactcccacataccgtg

SEQ ID NO: 963000 - DNA, 25 bp, Mus musculus
tacatcaaaactccgacataccgtg

SEQ ID NO: 963001 - DNA, 25 bp, Mus musculus
tacatcaaagaccaggtgtttggat

SEQ ID NO: 963002 - DNA, 25 bp, Mus musculus
tacatcaaagccaagaaattcttca

SEQ ID NO: 963003 - DNA, 25 bp, Mus musculus
tacatcaaaggcaagaaattcttca

SEQ ID NO: 963004 - DNA, 25 bp, Mus musculus
tacatcaaagtccaggtgtttggat

SEQ ID NO: 963005 - DNA, 25 bp, Mus musculus
tacatcaagcgccccaacagcctcg

SEQ ID NO: 963006 - DNA, 25 bp, Mus musculus
tacatcaagcgcgccaacagcctcg

SEQ ID NO: 963007 - DNA, 25 bp, Mus musculus
tacatcactaaagaagaaatgctgg

SEQ ID NO: 963008 - DNA, 25 bp, Mus musculus
tacatcactaaagatgaaatgctgg

SEQ ID NO: 963009 - DNA, 25 bp, Mus musculus
tacatcagaagagactcacgatgaa

SEQ ID NO: 963010 - DNA, 25 bp, Mus musculus
tacatcagaagagagtcacgatgaa

SEQ ID NO: 963011 - DNA, 25 bp, Mus musculus
tacatccaggcttgccccgttgctc

SEQ ID NO: 963012 - DNA, 25 bp, Mus musculus
tacatccagggttgccccgttgctc

SEQ ID NO: 963013 - DNA, 25 bp, Mus musculus
tacatccatctcatggacgacgacg

SEQ ID NO: 963014 - DNA, 25 bp, Mus musculus
tacatccatctcttggacgacgacg

SEQ ID NO: 963015 - DNA, 25 bp, Mus musculus
tacatccctctgcatcggttaagca

SEQ ID NO: 963016 - DNA, 25 bp, Mus musculus
tacatccctctgctgaattccaagg

SEQ ID NO: 963017 - DNA, 25 bp, Mus musculus
tacatccctctggatcggttaagca

SEQ ID NO: 963018 - DNA, 25 bp, Mus musculus
tacatccctctggtgaattccaagg

SEQ ID NO: 963019 - DNA, 25 bp, Mus musculus
tacatccctgcagccggccctctct

SEQ ID NO: 963020 - DNA, 25 bp, Mus musculus
tacatccctggagccggccctctct

SEQ ID NO: 963021 - DNA, 25 bp, Mus musculus
tacatcgactaccagagagatcctg

SEQ ID NO: 963022 - DNA, 25 bp, Mus musculus
tacatcgactacgagagagatcctg

SEQ ID NO: 963023 - DNA, 25 bp, Mus musculus
tacatcgcccctgacatcctgcagg

SEQ ID NO: 963024 - DNA, 25 bp, Mus musculus
tacatcgcccctgagatcctgcagg

SEQ ID NO: 963025 - DNA, 25 bp, Mus musculus
tacatcggctctcgccttggaggat

SEQ ID NO: 963026 - DNA, 25 bp, Mus musculus
tacatcggctctcggcttggaggat

SEQ ID NO: 963027 - DNA, 25 bp, Mus musculus
tacatcgtcctctccacccggagag

SEQ ID NO: 963028 - DNA, 25 bp, Mus musculus
tacatcgtcctctcgacccggagag

SEQ ID NO: 963029 - DNA, 25 bp, Mus musculus
tacatcgtggtgaatgttgtatggg

SEQ ID NO: 963030 - DNA, 25 bp, Mus musculus
tacatcgtggtgcacagtgaacttt

SEQ ID NO: 963031 - DNA, 25 bp, Mus musculus
tacatcgtggtggacagtgaacttt

SEQ ID NO: 963032 - DNA, 25 bp, Mus musculus
tacatcgtggtgtatgttgtatggg

SEQ ID NO: 963033 - DNA, 25 bp, Mus musculus
tacatctatcagccatggcgagtgc

SEQ ID NO: 963034 - DNA, 25 bp, Mus musculus
tacatctatcaggcatggcgagtgc

SEQ ID NO: 963035 - DNA, 25 bp, Mus musculus
tacatctcagcccagggctttgacc

SEQ ID NO: 963036 - DNA, 25 bp, Mus musculus
tacatctcagccccctggtttgata

SEQ ID NO: 963037 - DNA, 25 bp, Mus musculus
tacatctcaggccagggctttgacc

SEQ ID NO: 963038 - DNA, 25 bp, Mus musculus
tacatctcaggcccctggtttgata

SEQ ID NO: 963039 - DNA, 25 bp, Mus musculus
tacatctggcagcgccgccacgcat

SEQ ID NO: 963040 - DNA, 25 bp, Mus musculus
tacatctggcagggccgccacgcat

SEQ ID NO: 963041 - DNA, 25 bp, Mus musculus
tacatgaaagctggcttaatgaact

SEQ ID NO: 963042 - DNA, 25 bp, Mus musculus
tacatgaaaggtggcttaatgaact

SEQ ID NO: 963043 - DNA, 25 bp, Mus musculus
tacatgagcaaacgaagtttgcttg

SEQ ID NO: 963044 - DNA, 25 bp, Mus musculus
tacatgagcaaaggaagtttgcttg

SEQ ID NO: 963045 - DNA, 25 bp, Mus musculus
tacatgatccagaaaaagagccgtg

SEQ ID NO: 963046 - DNA, 25 bp, Mus musculus
tacatgatccagtaaaagagccgtg

SEQ ID NO: 963047 - DNA, 25 bp, Mus musculus
tacatgatctggatctccacagcag

SEQ ID NO: 963048 - DNA, 25 bp, Mus musculus
tacatgatctggttctccacagcag

SEQ ID NO: 963049 - DNA, 25 bp, Mus musculus
tacatgatgatcgtcgaccctgcca

SEQ ID NO: 963050 - DNA, 25 bp, Mus musculus
tacatgatgatcgtcgcgggatccg

SEQ ID NO: 963051 - DNA, 25 bp, Mus musculus
tacatgatgatcgtcgtttggcctg

SEQ ID NO: 963052 - DNA, 25 bp, Mus musculus
tacatgatgatcgtggaccctgcca

SEQ ID NO: 963053 - DNA, 25 bp, Mus musculus
tacatgatgatcgtggcgggatccg

SEQ ID NO: 963054 - DNA, 25 bp, Mus musculus
tacatgatgatcgtggtttggcctg

SEQ ID NO: 963055 - DNA, 25 bp, Mus musculus
tacatgcagcagattcaagtcaatc

SEQ ID NO: 963056 - DNA, 25 bp, Mus musculus
tacatgcagcagtttcaagtcaatc

SEQ ID NO: 963057 - DNA, 25 bp, Mus musculus
tacatggaggagctgcggcggcagc

SEQ ID NO: 963058 - DNA, 25 bp, Mus musculus
tacatggaggaggtgcggcggcagc

SEQ ID NO: 963059 - DNA, 25 bp, Mus musculus
tacatggccaagcggagtttggtgg

SEQ ID NO: 963060 - DNA, 25 bp, Mus musculus
tacatggccaaggggagtttggtgg

SEQ ID NO: 963061 - DNA, 25 bp, Mus musculus
tacatgtgcaacagcgtcatccagg

SEQ ID NO: 963062 - DNA, 25 bp, Mus musculus
tacatgtgcaacccgtcatccagga

SEQ ID NO: 963063 - DNA, 25 bp, Mus musculus
tacatgtgcaacgcgtcatccagga

SEQ ID NO: 963064 - DNA, 25 bp, Mus musculus
tacatgtgcaactgcgtcatccagg

SEQ ID NO: 963065 - DNA, 25 bp, Mus musculus
tacatgtgtaaccaggtgatccaag

SEQ ID NO: 963066 - DNA, 25 bp, Mus musculus
tacatgtgtaacgaggtgatccaag

SEQ ID NO: 963067 - DNA, 25 bp, Mus musculus
tacattaacccgatcatccccttta

SEQ ID NO: 963068 - DNA, 25 bp, Mus musculus
tacattaacccgttcatccccttta

SEQ ID NO: 963069 - DNA, 25 bp, Mus musculus
tacattaacgtgcttcattatgatg

SEQ ID NO: 963070 - DNA, 25 bp, Mus musculus
tacattaacgtggttcattatgatg

SEQ ID NO: 963071 - DNA, 25 bp, Mus musculus
tacattaatgattccattggcttac

SEQ ID NO: 963072 - DNA, 25 bp, Mus musculus
tacattaatgctaccgtcttgattc

SEQ ID NO: 963073 - DNA, 25 bp, Mus musculus
tacattaatggtaccgtcttgattc

SEQ ID NO: 963074 - DNA, 25 bp, Mus musculus
tacattaatgtttccattggcttac

SEQ ID NO: 963075 - DNA, 25 bp, Mus musculus
tacattagtgggaagcagctatact

SEQ ID NO: 963076 - DNA, 25 bp, Mus musculus
tacattagtgggtagcagctatact

SEQ ID NO: 963077 - DNA, 25 bp, Mus musculus
tacattatatatgcaagttctgctg

SEQ ID NO: 963078 - DNA, 25 bp, Mus musculus
tacattatatctacatcaaatgggt

SEQ ID NO: 963079 - DNA, 25 bp, Mus musculus
tacattatatgtacatcaaatgggt

SEQ ID NO: 963080 - DNA, 25 bp, Mus musculus
tacattatatttgcaagttctgctg

SEQ ID NO: 963081 - DNA, 25 bp, Mus musculus
tacattattgagcccactgcagatg

SEQ ID NO: 963082 - DNA, 25 bp, Mus musculus
tacattattgaggccactgcagatg

SEQ ID NO: 963083 - DNA, 25 bp, Mus musculus
tacattatttagctgcttactaaat

SEQ ID NO: 963084 - DNA, 25 bp, Mus musculus
tacattatttaggtgcttactaaat

SEQ ID NO: 963085 - DNA, 25 bp, Mus musculus
tacattcaagcatttacttacaaga

SEQ ID NO: 963086 - DNA, 25 bp, Mus musculus
tacattcaaggatttacttacaaga

SEQ ID NO: 963087 - DNA, 25 bp, Mus musculus
tacattctccatcgagcagcctggt

SEQ ID NO: 963088 - DNA, 25 bp, Mus musculus
tacattctccatggagcagcctggt

SEQ ID NO: 963089 - DNA, 25 bp, Mus musculus
tacattcttcagctcgttatcaacc

SEQ ID NO: 963090 - DNA, 25 bp, Mus musculus
tacattcttcaggtcgttatcaacc

SEQ ID NO: 963091 - DNA, 25 bp, Mus musculus
tacattgcaatgcatgagtttcatc

SEQ ID NO: 963092 - DNA, 25 bp, Mus musculus
tacattgcaatggatgagtttcatc

SEQ ID NO: 963093 - DNA, 25 bp, Mus musculus
tacattgcagattcatcgtgagaac

SEQ ID NO: 963094 - DNA, 25 bp, Mus musculus
tacattgcagtttcatcgtgagaac

SEQ ID NO: 963095 - DNA, 25 bp, Mus musculus
tacattgtcacaccttcttctgaca

SEQ ID NO: 963096 - DNA, 25 bp, Mus musculus
tacattgtcacagcttcttctgaca

SEQ ID NO: 963097 - DNA, 25 bp, Mus musculus
tacattgtctatgactttctgatgt

SEQ ID NO: 963098 - DNA, 25 bp, Mus musculus
tacattgtctatgagtttctgatgt

SEQ ID NO: 963099 - DNA, 25 bp, Mus musculus
tacatttacgagctgatcaaagaga

SEQ ID NO: 963100 - DNA, 25 bp, Mus musculus
tacatttacgaggtgatcaaagaga

SEQ ID NO: 963101 - DNA, 25 bp, Mus musculus
tacatttataacaaccccaccgatg

SEQ ID NO: 963102 - DNA, 25 bp, Mus musculus
tacatttataacaagcccaccgatg

SEQ ID NO: 963103 - DNA, 25 bp, Mus musculus
tacatttcaaagcttagcgatgcaa

SEQ ID NO: 963104 - DNA, 25 bp, Mus musculus
tacatttcaaaggttagcgatgcaa

SEQ ID NO: 963105 - DNA, 25 bp, Mus musculus
tacatttcagacatcccgcttacgc

SEQ ID NO: 963106 - DNA, 25 bp, Mus musculus
tacatttcagatcctcctaccacca

SEQ ID NO: 963107 - DNA, 25 bp, Mus musculus
tacatttcagtcatcccgcttacgc

SEQ ID NO: 963108 - DNA, 25 bp, Mus musculus
tacatttcagttcctcctaccacca

SEQ ID NO: 963109 - DNA, 25 bp, Mus musculus
tacatttctgagcgcctgcacccta

SEQ ID NO: 963110 - DNA, 25 bp, Mus musculus
tacatttctgagggcctgcacccta

SEQ ID NO: 963111 - DNA, 25 bp, Mus musculus
taccaaaaagcacatggagacacgg

SEQ ID NO: 963112 - DNA, 25 bp, Mus musculus
taccaaaaagcacattgtccatccc

SEQ ID NO: 963113 - DNA, 25 bp, Mus musculus
taccaaaaagcagatggagacacgg

SEQ ID NO: 963114 - DNA, 25 bp, Mus musculus
taccaaaaagcagattgtccatccc

SEQ ID NO: 963115 - DNA, 25 bp, Mus musculus
taccaaaaatagcgaccagttcgtg

SEQ ID NO: 963116 - DNA, 25 bp, Mus musculus
taccaaaaattgcgaccagttcgtg

SEQ ID NO: 963117 - DNA, 25 bp, Mus musculus
taccaaagtcttctgatttgaactg

SEQ ID NO: 963118 - DNA, 25 bp, Mus musculus
taccaaagtcttgtgatttgaactg

SEQ ID NO: 963119 - DNA, 25 bp, Mus musculus
taccaacaagcactcagacttgtgc

SEQ ID NO: 963120 - DNA, 25 bp, Mus musculus
taccaacaaggactcagacttgtgc

SEQ ID NO: 963121 - DNA, 25 bp, Mus musculus
taccaacattgctgcacatttcaat

SEQ ID NO: 963122 - DNA, 25 bp, Mus musculus
taccaacattgctgcatcctctccc

SEQ ID NO: 963123 - DNA, 25 bp, Mus musculus
taccaacattgctggacatttcaat

SEQ ID NO: 963124 - DNA, 25 bp, Mus musculus
taccaacattgctggatcctctccc

SEQ ID NO: 963125 - DNA, 25 bp, Mus musculus
taccaagaactggacgccccaggtg

SEQ ID NO: 963126 - DNA, 25 bp, Mus musculus
taccaagaactggaggccccaggtg

SEQ ID NO: 963127 - DNA, 25 bp, Mus musculus
taccaagactttgaagcccgctacg

SEQ ID NO: 963128 - DNA, 25 bp, Mus musculus
taccaagactttgatgcccgctacg

SEQ ID NO: 963129 - DNA, 25 bp, Mus musculus
taccaagccatgctacactgtggga

SEQ ID NO: 963130 - DNA, 25 bp, Mus musculus
taccaagccatggtacactgtggga

SEQ ID NO: 963131 - DNA, 25 bp, Mus musculus
taccaagctgagtcagctgttgctc

SEQ ID NO: 963132 - DNA, 25 bp, Mus musculus
taccaagctgagtctgctgttgctc

SEQ ID NO: 963133 - DNA, 25 bp, Mus musculus
taccaagtagacagcattttcaaaa

SEQ ID NO: 963134 - DNA, 25 bp, Mus musculus
taccaagtagactgcattttcaaaa

SEQ ID NO: 963135 - DNA, 25 bp, Mus musculus
taccaagtctgtcgtttgtcccatc

SEQ ID NO: 963136 - DNA, 25 bp, Mus musculus
taccaagtctgtggtttgtcccatc

SEQ ID NO: 963137 - DNA, 25 bp, Mus musculus
taccaatgagctctacatgatgatg

SEQ ID NO: 963138 - DNA, 25 bp, Mus musculus
taccaatgagctgtacatgatgatg

SEQ ID NO: 963139 - DNA, 25 bp, Mus musculus
taccaatggagatgcatgacctact

SEQ ID NO: 963140 - DNA, 25 bp, Mus musculus
taccaatggagatgcgctagatgac

SEQ ID NO: 963141 - DNA, 25 bp, Mus musculus
taccaatggagatggatgacctact

SEQ ID NO: 963142 - DNA, 25 bp, Mus musculus
taccaatggagatgggctagatgac

SEQ ID NO: 963143 - DNA, 25 bp, Mus musculus
taccacaaacaacgttcatgccatc

SEQ ID NO: 963144 - DNA, 25 bp, Mus musculus
taccacaaacaaggttcatgccatc

SEQ ID NO: 963145 - DNA, 25 bp, Mus musculus
taccacaaatccaaatggaacataa

SEQ ID NO: 963146 - DNA, 25 bp, Mus musculus
taccacaaatcctaatggaacataa

SEQ ID NO: 963147 - DNA, 25 bp, Mus musculus
taccacaacacaacaatcttgggat

SEQ ID NO: 963148 - DNA, 25 bp, Mus musculus
taccacaacacatcaatcttgggat

SEQ ID NO: 963149 - DNA, 25 bp, Mus musculus
taccaccagcagattcggctcgtcc

SEQ ID NO: 963150 - DNA, 25 bp, Mus musculus
taccaccagcagtttcggctcgtcc

SEQ ID NO: 963151 - DNA, 25 bp, Mus musculus
taccaccattttcgaagaaccatat

SEQ ID NO: 963152 - DNA, 25 bp, Mus musculus
taccaccattttggaagaaccatat

SEQ ID NO: 963153 - DNA, 25 bp, Mus musculus
taccacccagcacctagaagaaaaa

SEQ ID NO: 963154 - DNA, 25 bp, Mus musculus
taccacccagcagctagaagaaaaa

SEQ ID NO: 963155 - DNA, 25 bp, Mus musculus
taccacgagatgcccattgagccgc

SEQ ID NO: 963156 - DNA, 25 bp, Mus musculus
taccacgagatggccattgagccgc

SEQ ID NO: 963157 - DNA, 25 bp, Mus musculus
taccacgcagccctgaaggcatctg

SEQ ID NO: 963158 - DNA, 25 bp, Mus musculus
taccacgcaggcctgaaggcatctg

SEQ ID NO: 963159 - DNA, 25 bp, Mus musculus
taccacggcatgcacaggaatctgg

SEQ ID NO: 963160 - DNA, 25 bp, Mus musculus
taccacggcatgcacggtgtgtctg

SEQ ID NO: 963161 - DNA, 25 bp, Mus musculus
taccacggcatgcagaggaatctgg

SEQ ID NO: 963162 - DNA, 25 bp, Mus musculus
taccacggcatgcagggtgtgtctg

SEQ ID NO: 963163 - DNA, 25 bp, Mus musculus
taccacgggcagagacttaaagttc

SEQ ID NO: 963164 - DNA, 25 bp, Mus musculus
taccacgggcagtgacttaaagttc

SEQ ID NO: 963165 - DNA, 25 bp, Mus musculus
taccactctccgatcaacaggttcc

SEQ ID NO: 963166 - DNA, 25 bp, Mus musculus
taccactctccgttcaacaggttcc

SEQ ID NO: 963167 - DNA, 25 bp, Mus musculus
taccactctgcacggaacatcatgg

SEQ ID NO: 963168 - DNA, 25 bp, Mus musculus
taccactctgcagggaacatcatgg

SEQ ID NO: 963169 - DNA, 25 bp, Mus musculus
taccactgcaaaaacgacaactgcc

SEQ ID NO: 963170 - DNA, 25 bp, Mus musculus
taccactgcaaaaaggacaactgcc

SEQ ID NO: 963171 - DNA, 25 bp, Mus musculus
taccactgcccaaactcaccagagg

SEQ ID NO: 963172 - DNA, 25 bp, Mus musculus
taccactgcccaaagtcaccagagg

SEQ ID NO: 963173 - DNA, 25 bp, Mus musculus
taccagaaatagcagcagttgacct

SEQ ID NO: 963174 - DNA, 25 bp, Mus musculus
taccagaaataggagcagttgacct

SEQ ID NO: 963175 - DNA, 25 bp, Mus musculus
taccagaatgagcatcccagaaagc

SEQ ID NO: 963176 - DNA, 25 bp, Mus musculus
taccagaatgaggatcccagaaagc

SEQ ID NO: 963177 - DNA, 25 bp, Mus musculus
taccagacaagaagccaagcctggc

SEQ ID NO: 963178 - DNA, 25 bp, Mus musculus
taccagacaagaagcgaagcaagcc

SEQ ID NO: 963179 - DNA, 25 bp, Mus musculus
taccagacaagaaggcaagcctggc

SEQ ID NO: 963180 - DNA, 25 bp, Mus musculus
taccagacaagaagggaagcaagcc

SEQ ID NO: 963181 - DNA, 25 bp, Mus musculus
taccagaccaagattgagacactcc

SEQ ID NO: 963182 - DNA, 25 bp, Mus musculus
taccagaccaagtttgagacactcc

SEQ ID NO: 963183 - DNA, 25 bp, Mus musculus
taccagagcaagcactataatgatg

SEQ ID NO: 963184 - DNA, 25 bp, Mus musculus
taccagagcaaggactataatgatg

SEQ ID NO: 963185 - DNA, 25 bp, Mus musculus
taccagataaaaaatgacacctacg

SEQ ID NO: 963186 - DNA, 25 bp, Mus musculus
taccagataataaatgacacctacg

SEQ ID NO: 963187 - DNA, 25 bp, Mus musculus
taccagatcaagcacttccgggaga

SEQ ID NO: 963188 - DNA, 25 bp, Mus musculus
taccagatcaaggacttccgggaga

SEQ ID NO: 963189 - DNA, 25 bp, Mus musculus
taccagcaaatgagcgcgaacagct

SEQ ID NO: 963190 - DNA, 25 bp, Mus musculus
taccagcaaatgagggcgaacagct

SEQ ID NO: 963191 - DNA, 25 bp, Mus musculus
taccagcagcaatatggaaggagcc

SEQ ID NO: 963192 - DNA, 25 bp, Mus musculus
taccagcagctatatggaaggagcc

SEQ ID NO: 963193 - DNA, 25 bp, Mus musculus
taccagccacagcagctcttaggga

SEQ ID NO: 963194 - DNA, 25 bp, Mus musculus
taccagccacaggagctcttaggga

SEQ ID NO: 963195 - DNA, 25 bp, Mus musculus
taccagcctgtgcaatagtcactgc

SEQ ID NO: 963196 - DNA, 25 bp, Mus musculus
taccagcctgtgcgtccgaagcagt

SEQ ID NO: 963197 - DNA, 25 bp, Mus musculus
taccagcctgtggaatagtcactgc

SEQ ID NO: 963198 - DNA, 25 bp, Mus musculus
taccagcctgtgggtccgaagcagt

SEQ ID NO: 963199 - DNA, 25 bp, Mus musculus
taccagctagaaacgagatgtccct

SEQ ID NO: 963200 - DNA, 25 bp, Mus musculus
taccagctagaaacttctcctctgt

SEQ ID NO: 963201 - DNA, 25 bp, Mus musculus
taccagctagaatcgagatgtccct

SEQ ID NO: 963202 - DNA, 25 bp, Mus musculus
taccagctagaatcttctcctctgt

SEQ ID NO: 963203 - DNA, 25 bp, Mus musculus
taccagctgaagacttgattgcaat

SEQ ID NO: 963204 - DNA, 25 bp, Mus musculus
taccagctgaagtcttgattgcaat

SEQ ID NO: 963205 - DNA, 25 bp, Mus musculus
taccaggagaagcatgccctgcaag

SEQ ID NO: 963206 - DNA, 25 bp, Mus musculus
taccaggagaaggatgccctgcaag

SEQ ID NO: 963207 - DNA, 25 bp, Mus musculus
taccaggcagctgatgacaccgaga

SEQ ID NO: 963208 - DNA, 25 bp, Mus musculus
taccaggcaggtgatgacaccgaga

SEQ ID NO: 963209 - DNA, 25 bp, Mus musculus
taccaggccaagcagaacgatttcg

SEQ ID NO: 963210 - DNA, 25 bp, Mus musculus
taccaggccaaggagaacgatttcg

SEQ ID NO: 963211 - DNA, 25 bp, Mus musculus
taccagggagcacggacaatgctgt

SEQ ID NO: 963212 - DNA, 25 bp, Mus musculus
taccagggaggacggacaatgctgt

SEQ ID NO: 963213 - DNA, 25 bp, Mus musculus
taccagggcaaacggaagtttgcca

SEQ ID NO: 963214 - DNA, 25 bp, Mus musculus
taccagggcaaagggaagtttgcca

SEQ ID NO: 963215 - DNA, 25 bp, Mus musculus
taccagggcaccaacgctgctttgg

SEQ ID NO: 963216 - DNA, 25 bp, Mus musculus
taccagggcaccaacttctccagcc

SEQ ID NO: 963217 - DNA, 25 bp, Mus musculus
taccagggcaccaaggctgctttgg

SEQ ID NO: 963218 - DNA, 25 bp, Mus musculus
taccagggcaccaagttctccagcc

SEQ ID NO: 963219 - DNA, 25 bp, Mus musculus
taccagtagaacaacagactaagtc

SEQ ID NO: 963220 - DNA, 25 bp, Mus musculus
taccagtagaacaactatcatctca

SEQ ID NO: 963221 - DNA, 25 bp, Mus musculus
taccagtagaacaagagactaagtc

SEQ ID NO: 963222 - DNA, 25 bp, Mus musculus
taccagtagaacaagtatcatctca

SEQ ID NO: 963223 - DNA, 25 bp, Mus musculus
taccagtatagatgaaggcaaaaga

SEQ ID NO: 963224 - DNA, 25 bp, Mus musculus
taccagtatagatgtaggcaaaaga

SEQ ID NO: 963225 - DNA, 25 bp, Mus musculus
taccagtctttacctgacctgaata

SEQ ID NO: 963226 - DNA, 25 bp, Mus musculus
taccagtctttagctgacctgaata

SEQ ID NO: 963227 - DNA, 25 bp, Mus musculus
taccagtgaaatccctgcccagaaa

SEQ ID NO: 963228 - DNA, 25 bp, Mus musculus
taccagtgaaatgcctgcccagaaa

SEQ ID NO: 963229 - DNA, 25 bp, Mus musculus
taccagtggctgcaccagtgaacag

SEQ ID NO: 963230 - DNA, 25 bp, Mus musculus
taccagtggctgcagcagtgaacag

SEQ ID NO: 963231 - DNA, 25 bp, Mus musculus
taccagtgttacaggattcaactaa

SEQ ID NO: 963232 - DNA, 25 bp, Mus musculus
taccagtgttactggattcaactaa

SEQ ID NO: 963233 - DNA, 25 bp, Mus musculus
taccatacagaaatgcgatgaagaa

SEQ ID NO: 963234 - DNA, 25 bp, Mus musculus
taccatacagtaatgcgatgaagaa

SEQ ID NO: 963235 - DNA, 25 bp, Mus musculus
taccatcaaaaacgtggacagtgct

SEQ ID NO: 963236 - DNA, 25 bp, Mus musculus
taccatcaaaaaggtggacagtgct

SEQ ID NO: 963237 - DNA, 25 bp, Mus musculus
taccatcaacctctactttggctcc

SEQ ID NO: 963238 - DNA, 25 bp, Mus musculus
taccatcaacctcttctttggctcc

SEQ ID NO: 963239 - DNA, 25 bp, Mus musculus
taccatccccagctcactggatggt

SEQ ID NO: 963240 - DNA, 25 bp, Mus musculus
taccatccccaggtcactggatggt

SEQ ID NO: 963241 - DNA, 25 bp, Mus musculus
taccatctgaagagtctactcggat

SEQ ID NO: 963242 - DNA, 25 bp, Mus musculus
taccatctgaagtgtctactcggat

SEQ ID NO: 963243 - DNA, 25 bp, Mus musculus
taccatgaagtacacgctggacatt

SEQ ID NO: 963244 - DNA, 25 bp, Mus musculus
taccatgaagtacaggctggacatt

SEQ ID NO: 963245 - DNA, 25 bp, Mus musculus
taccatgcaacaccctgctgttcat

SEQ ID NO: 963246 - DNA, 25 bp, Mus musculus
taccatgcaacagcctgctgttcat

SEQ ID NO: 963247 - DNA, 25 bp, Mus musculus
taccatgcagcttactccatgtttg

SEQ ID NO: 963248 - DNA, 25 bp, Mus musculus
taccatgcaggttactccatgtttg

SEQ ID NO: 963249 - DNA, 25 bp, Mus musculus
taccatgtcaagatttctgactttg

SEQ ID NO: 963250 - DNA, 25 bp, Mus musculus
taccatgtcaagttttctgactttg

SEQ ID NO: 963251 - DNA, 25 bp, Mus musculus
taccatgtccaaaaaattgcggtag

SEQ ID NO: 963252 - DNA, 25 bp, Mus musculus
taccatgtccaaaatattgcggtag

SEQ ID NO: 963253 - DNA, 25 bp, Mus musculus
taccatgtgaagatccgctcgctgt

SEQ ID NO: 963254 - DNA, 25 bp, Mus musculus
taccatgtgaagttccgctcgctgt

SEQ ID NO: 963255 - DNA, 25 bp, Mus musculus
taccatgtgcagcacccaaggctgg

SEQ ID NO: 963256 - DNA, 25 bp, Mus musculus
taccatgtgcaggacccaaggctgg

SEQ ID NO: 963257 - DNA, 25 bp, Mus musculus
tacccaaattgacacgtagctacat

SEQ ID NO: 963258 - DNA, 25 bp, Mus musculus
tacccaaattgacaggtagctacat

SEQ ID NO: 963259 - DNA, 25 bp, Mus musculus
tacccaactctgaactctctgcagg

SEQ ID NO: 963260 - DNA, 25 bp, Mus musculus
tacccaactctgaagtctctgcagg

SEQ ID NO: 963261 - DNA, 25 bp, Mus musculus
tacccaattgtgctctgccatctgc

SEQ ID NO: 963262 - DNA, 25 bp, Mus musculus
tacccaattgtggtctgccatctgc

SEQ ID NO: 963263 - DNA, 25 bp, Mus musculus
tacccacagcaaccaccctactgga

SEQ ID NO: 963264 - DNA, 25 bp, Mus musculus
tacccacagcaagcaccctactgga

SEQ ID NO: 963265 - DNA, 25 bp, Mus musculus
tacccaccccagcgcaggaatgaca

SEQ ID NO: 963266 - DNA, 25 bp, Mus musculus
tacccaccccagggcaggaatgaca

SEQ ID NO: 963267 - DNA, 25 bp, Mus musculus
tacccacggaaacgccatgtagaag

SEQ ID NO: 963268 - DNA, 25 bp, Mus musculus
tacccacggaaaggccatgtagaag

SEQ ID NO: 963269 - DNA, 25 bp, Mus musculus
tacccagaagcacggcactagaaag

SEQ ID NO: 963270 - DNA, 25 bp, Mus musculus
tacccagaagcacggcattagaaag

SEQ ID NO: 963271 - DNA, 25 bp, Mus musculus
tacccagaaggacggcactagaaag

SEQ ID NO: 963272 - DNA, 25 bp, Mus musculus
tacccagaaggacggcattagaaag

SEQ ID NO: 963273 - DNA, 25 bp, Mus musculus
tacccagccaaacccctggactatt

SEQ ID NO: 963274 - DNA, 25 bp, Mus musculus
tacccagccaaagccctggactatt

SEQ ID NO: 963275 - DNA, 25 bp, Mus musculus
taccccaaatcacgtaccaactgga

SEQ ID NO: 963276 - DNA, 25 bp, Mus musculus
taccccaaatcaggtaccaactgga

SEQ ID NO: 963277 - DNA, 25 bp, Mus musculus
taccccaacaatgcaccttccggtt

SEQ ID NO: 963278 - DNA, 25 bp, Mus musculus
taccccaacattgcaccttccggtt

SEQ ID NO: 963279 - DNA, 25 bp, Mus musculus
taccccagcagaacattccgcttga

SEQ ID NO: 963280 - DNA, 25 bp, Mus musculus
taccccagcagaactttccgcttga

SEQ ID NO: 963281 - DNA, 25 bp, Mus musculus
taccccagctgtggcaggtcctcga

SEQ ID NO: 963282 - DNA, 25 bp, Mus musculus
taccccagctgtgggaggtcctcga

SEQ ID NO: 963283 - DNA, 25 bp, Mus musculus
taccccatggagctactaaagactc

SEQ ID NO: 963284 - DNA, 25 bp, Mus musculus
taccccatggaggtactaaagactc

SEQ ID NO: 963285 - DNA, 25 bp, Mus musculus
tacccccgcatgaacagtgggcggc

SEQ ID NO: 963286 - DNA, 25 bp, Mus musculus
tacccccgcatgaagagtgggcggc

SEQ ID NO: 963287 - DNA, 25 bp, Mus musculus
taccccgagcgcccccgtccagagg

SEQ ID NO: 963288 - DNA, 25 bp, Mus musculus
taccccgagcgcccgcgtccagagg

SEQ ID NO: 963289 - DNA, 25 bp, Mus musculus
taccccggtctgcacgctttggatg

SEQ ID NO: 963290 - DNA, 25 bp, Mus musculus
taccccggtctgcaggctttggatg

SEQ ID NO: 963291 - DNA, 25 bp, Mus musculus
tacccctatgcaagagctgcaaaag

SEQ ID NO: 963292 - DNA, 25 bp, Mus musculus
tacccctatgcatgagctgcaaaag

SEQ ID NO: 963293 - DNA, 25 bp, Mus musculus
taccccttcacacgaatcagcagga

SEQ ID NO: 963294 - DNA, 25 bp, Mus musculus
taccccttcacaggaatcagcagga

SEQ ID NO: 963295 - DNA, 25 bp, Mus musculus
tacccgacagacatacttcctgcca

SEQ ID NO: 963296 - DNA, 25 bp, Mus musculus
tacccgacagcaaggtctatatgga

SEQ ID NO: 963297 - DNA, 25 bp, Mus musculus
tacccgacagcgtgtgaacaaagac

SEQ ID NO: 963298 - DNA, 25 bp, Mus musculus
tacccgacaggaaggtctatatgga

SEQ ID NO: 963299 - DNA, 25 bp, Mus musculus
tacccgacagggtgtgaacaaagac

SEQ ID NO: 963300 - DNA, 25 bp, Mus musculus
tacccgacagtcatacttcctgcca

SEQ ID NO: 963301 - DNA, 25 bp, Mus musculus
tacccgaccctcaacgtgccctatg

SEQ ID NO: 963302 - DNA, 25 bp, Mus musculus
tacccgaccctcaaggtgccctatg

SEQ ID NO: 963303 - DNA, 25 bp, Mus musculus
tacccgccaggtggctgggatgagg

SEQ ID NO: 963304 - DNA, 25 bp, Mus musculus
tacccgccaggtgggtgggatgagg

SEQ ID NO: 963305 - DNA, 25 bp, Mus musculus
tacccgctggtggacggtgtcaccg

SEQ ID NO: 963306 - DNA, 25 bp, Mus musculus
tacccgctggtggagggtgtcaccg

SEQ ID NO: 963307 - DNA, 25 bp, Mus musculus
taccctaaatcacgtactacttggc

SEQ ID NO: 963308 - DNA, 25 bp, Mus musculus
taccctaaatcaggtactacttggc

SEQ ID NO: 963309 - DNA, 25 bp, Mus musculus
taccctactcatcacaggcaaactg

SEQ ID NO: 963310 - DNA, 25 bp, Mus musculus
taccctactcatgacaggcaaactg

SEQ ID NO: 963311 - DNA, 25 bp, Mus musculus
taccctacttccattcaatgctgcc

SEQ ID NO: 963312 - DNA, 25 bp, Mus musculus
taccctacttcctttcaatgctgcc

SEQ ID NO: 963313 - DNA, 25 bp, Mus musculus
taccctagcaaaccattgacaaagg

SEQ ID NO: 963314 - DNA, 25 bp, Mus musculus
taccctagcaaacctttgacaaagg

SEQ ID NO: 963315 - DNA, 25 bp, Mus musculus
taccctcctctgcacttgttgacct

SEQ ID NO: 963316 - DNA, 25 bp, Mus musculus
taccctcctctgcagttgttgacct

SEQ ID NO: 963317 - DNA, 25 bp, Mus musculus
taccctgactcacgttctgcggacg

SEQ ID NO: 963318 - DNA, 25 bp, Mus musculus
taccctgactcaggttctgcggacg

SEQ ID NO: 963319 - DNA, 25 bp, Mus musculus
taccctggtgatcgagaaatgcaaa

SEQ ID NO: 963320 - DNA, 25 bp, Mus musculus
taccctggtgttcgagaaatgcaaa

SEQ ID NO: 963321 - DNA, 25 bp, Mus musculus
tacccttggctgacctatatgaaga

SEQ ID NO: 963322 - DNA, 25 bp, Mus musculus
tacccttggctgtcctatatgaaga

SEQ ID NO: 963323 - DNA, 25 bp, Mus musculus
taccgcaaagagcaacaggtgatgg

SEQ ID NO: 963324 - DNA, 25 bp, Mus musculus
taccgcaaagtgcaacaggtgatgg

SEQ ID NO: 963325 - DNA, 25 bp, Mus musculus
taccgcaacgaggtctccattgagg

SEQ ID NO: 963326 - DNA, 25 bp, Mus musculus
taccgcaacgtggtctccattgagg

SEQ ID NO: 963327 - DNA, 25 bp, Mus musculus
taccgcaagcagcagtctctggtcc

SEQ ID NO: 963328 - DNA, 25 bp, Mus musculus
taccgcaagcaggagtctctggtcc

SEQ ID NO: 963329 - DNA, 25 bp, Mus musculus
taccgcagcttcaaaatattgtatc

SEQ ID NO: 963330 - DNA, 25 bp, Mus musculus
taccgcagcttctaaatattgtatc

SEQ ID NO: 963331 - DNA, 25 bp, Mus musculus
taccgctccgcccgtgttggtggaa

SEQ ID NO: 963332 - DNA, 25 bp, Mus musculus
taccgctccgccggtgttggtggaa

SEQ ID NO: 963333 - DNA, 25 bp, Mus musculus
taccgctctgagctcccgcccactg

SEQ ID NO: 963334 - DNA, 25 bp, Mus musculus
taccgctctgaggtcccgcccactg

SEQ ID NO: 963335 - DNA, 25 bp, Mus musculus
taccgggaagagcaatgttttggtg

SEQ ID NO: 963336 - DNA, 25 bp, Mus musculus
taccgggaagaggaatgttttggtg

SEQ ID NO: 963337 - DNA, 25 bp, Mus musculus
taccgggacctgaacctggagaacc

SEQ ID NO: 963338 - DNA, 25 bp, Mus musculus
taccgggacctgaagctggagaacc

SEQ ID NO: 963339 - DNA, 25 bp, Mus musculus
taccggtggtggctcaggctccagc

SEQ ID NO: 963340 - DNA, 25 bp, Mus musculus
taccggtggtggctgaggctccagc

SEQ ID NO: 963341 - DNA, 25 bp, Mus musculus
taccgtagcccacaaaaatatgaag

SEQ ID NO: 963342 - DNA, 25 bp, Mus musculus
taccgtagcccacagcaagtccctc

SEQ ID NO: 963343 - DNA, 25 bp, Mus musculus
taccgtagcccagaaaaatatgaag

SEQ ID NO: 963344 - DNA, 25 bp, Mus musculus
taccgtagcccagagcaagtccctc

SEQ ID NO: 963345 - DNA, 25 bp, Mus musculus
taccgttgcaatcatacaatccctg

SEQ ID NO: 963346 - DNA, 25 bp, Mus musculus
taccgttgcaatgatacaatccctg

SEQ ID NO: 963347 - DNA, 25 bp, Mus musculus
tacctaaatgactgataatggtctt

SEQ ID NO: 963348 - DNA, 25 bp, Mus musculus
tacctaaatgcacaggatccttgtc

SEQ ID NO: 963349 - DNA, 25 bp, Mus musculus
tacctaaatggacaggatccttgtc

SEQ ID NO: 963350 - DNA, 25 bp, Mus musculus
tacctaaatgtctgataatggtctt

SEQ ID NO: 963351 - DNA, 25 bp, Mus musculus
tacctaactgcccccaccaagcgca

SEQ ID NO: 963352 - DNA, 25 bp, Mus musculus
tacctaactggccccaccaagcgca

SEQ ID NO: 963353 - DNA, 25 bp, Mus musculus
tacctaagagagctgagcgcttaca

SEQ ID NO: 963354 - DNA, 25 bp, Mus musculus
tacctaagagaggtgagcgcttaca

SEQ ID NO: 963355 - DNA, 25 bp, Mus musculus
tacctacaagagaactctgaaggca

SEQ ID NO: 963356 - DNA, 25 bp, Mus musculus
tacctacaagagcagagtcaaacac

SEQ ID NO: 963357 - DNA, 25 bp, Mus musculus
tacctacaagaggagagtcaaacac

SEQ ID NO: 963358 - DNA, 25 bp, Mus musculus
tacctacaagagtactctgaaggca

SEQ ID NO: 963359 - DNA, 25 bp, Mus musculus
tacctacccctcaagaaaagctact

SEQ ID NO: 963360 - DNA, 25 bp, Mus musculus
tacctacccctcaagccttcctgcc

SEQ ID NO: 963361 - DNA, 25 bp, Mus musculus
tacctacccctctagaaaagctact

SEQ ID NO: 963362 - DNA, 25 bp, Mus musculus
tacctacccctctagccttcctgcc

SEQ ID NO: 963363 - DNA, 25 bp, Mus musculus
tacctacgcaataacagtttctaat

SEQ ID NO: 963364 - DNA, 25 bp, Mus musculus
tacctacgcaataagagtttctaat

SEQ ID NO: 963365 - DNA, 25 bp, Mus musculus
tacctactggaaaacacagaaaata

SEQ ID NO: 963366 - DNA, 25 bp, Mus musculus
tacctactggaaaagacagaaaata

SEQ ID NO: 963367 - DNA, 25 bp, Mus musculus
tacctatgacaacgcttacacggat

SEQ ID NO: 963368 - DNA, 25 bp, Mus musculus
tacctatgacaaggcttacacggat

SEQ ID NO: 963369 - DNA, 25 bp, Mus musculus
tacctcaacagacatttgctccaag

SEQ ID NO: 963370 - DNA, 25 bp, Mus musculus
tacctcaacagagatttgctccaag

SEQ ID NO: 963371 - DNA, 25 bp, Mus musculus
tacctcaaccagcataacttgaata

SEQ ID NO: 963372 - DNA, 25 bp, Mus musculus
tacctcaaccaggataacttgaata

SEQ ID NO: 963373 - DNA, 25 bp, Mus musculus
tacctcagtgctaatcattgcagcg

SEQ ID NO: 963374 - DNA, 25 bp, Mus musculus
tacctcagtggtaatcattgcagcg

SEQ ID NO: 963375 - DNA, 25 bp, Mus musculus
tacctcatggcggtatcagtgagtg

SEQ ID NO: 963376 - DNA, 25 bp, Mus musculus
tacctcatgggggtatcagtgagtg

SEQ ID NO: 963377 - DNA, 25 bp, Mus musculus
tacctcattggtctaatctctgacc

SEQ ID NO: 963378 - DNA, 25 bp, Mus musculus
tacctcattggtcttatctctgacc

SEQ ID NO: 963379 - DNA, 25 bp, Mus musculus
tacctccacgagccgagcctgtcac

SEQ ID NO: 963380 - DNA, 25 bp, Mus musculus
tacctccacgaggcgagcctgtcac

SEQ ID NO: 963381 - DNA, 25 bp, Mus musculus
tacctcccccactgcatgatgcaga

SEQ ID NO: 963382 - DNA, 25 bp, Mus musculus
tacctcccccactggatgatgcaga

SEQ ID NO: 963383 - DNA, 25 bp, Mus musculus
tacctcctggcttgcatcttgtcta

SEQ ID NO: 963384 - DNA, 25 bp, Mus musculus
tacctcctggcttggatcttgtcta

SEQ ID NO: 963385 - DNA, 25 bp, Mus musculus
tacctcctttcgcttcaagcacaaa

SEQ ID NO: 963386 - DNA, 25 bp, Mus musculus
tacctcctttcggttcaagcacaaa

SEQ ID NO: 963387 - DNA, 25 bp, Mus musculus
tacctcgcacagaggaagtatggcg

SEQ ID NO: 963388 - DNA, 25 bp, Mus musculus
tacctcgcacagtggaagtatggcg

SEQ ID NO: 963389 - DNA, 25 bp, Mus musculus
tacctcgcgtagagagaggccatcg

SEQ ID NO: 963390 - DNA, 25 bp, Mus musculus
tacctcgcgtagtgagaggccatcg

SEQ ID NO: 963391 - DNA, 25 bp, Mus musculus
tacctctcagccccaagctggatgg

SEQ ID NO: 963392 - DNA, 25 bp, Mus musculus
tacctctcagctgacgtgctagtga

SEQ ID NO: 963393 - DNA, 25 bp, Mus musculus
tacctctcaggcccaagctggatgg

SEQ ID NO: 963394 - DNA, 25 bp, Mus musculus
tacctctcaggtgacgtgctagtga

SEQ ID NO: 963395 - DNA, 25 bp, Mus musculus
tacctctccaagagcttgtatgtct

SEQ ID NO: 963396 - DNA, 25 bp, Mus musculus
tacctctccaagtgcttgtatgtct

SEQ ID NO: 963397 - DNA, 25 bp, Mus musculus
tacctctgaaagctggttccatggt

SEQ ID NO: 963398 - DNA, 25 bp, Mus musculus
tacctctgaaaggtggttccatggt

SEQ ID NO: 963399 - DNA, 25 bp, Mus musculus
tacctctggatgacgtcacgctggc

SEQ ID NO: 963400 - DNA, 25 bp, Mus musculus
tacctctggatgagtcttcggagcc

SEQ ID NO: 963401 - DNA, 25 bp, Mus musculus
tacctctggatgatgaacagcgtca

SEQ ID NO: 963402 - DNA, 25 bp, Mus musculus
tacctctggatgtcgtcacgctggc

SEQ ID NO: 963403 - DNA, 25 bp, Mus musculus
tacctctggatgtgtcttcggagcc

SEQ ID NO: 963404 - DNA, 25 bp, Mus musculus
tacctctggatgttgaacagcgtca

SEQ ID NO: 963405 - DNA, 25 bp, Mus musculus
tacctctggcaaaaagcgtgcccac

SEQ ID NO: 963406 - DNA, 25 bp, Mus musculus
tacctctggcaaaatgcgtgcccac

SEQ ID NO: 963407 - DNA, 25 bp, Mus musculus
tacctctgtggcaacggtgacagct

SEQ ID NO: 963408 - DNA, 25 bp, Mus musculus
tacctctgtggcaagggtgacagct

SEQ ID NO: 963409 - DNA, 25 bp, Mus musculus
tacctcttagctctctttgagcccg

SEQ ID NO: 963410 - DNA, 25 bp, Mus musculus
tacctcttaggtctctttgagcccg

SEQ ID NO: 963411 - DNA, 25 bp, Mus musculus
tacctcttcaggctctgtgttccga

SEQ ID NO: 963412 - DNA, 25 bp, Mus musculus
tacctcttcagggtctgtgttccga

SEQ ID NO: 963413 - DNA, 25 bp, Mus musculus
tacctctttaaacatactatcgtgg

SEQ ID NO: 963414 - DNA, 25 bp, Mus musculus
tacctctttaaagatactatcgtgg

SEQ ID NO: 963415 - DNA, 25 bp, Mus musculus
tacctctttgtccacgtggacactc

SEQ ID NO: 963416 - DNA, 25 bp, Mus musculus
tacctctttgtccaggtggacactc

SEQ ID NO: 963417 - DNA, 25 bp, Mus musculus
tacctgaagtggcaccttgtttttc

SEQ ID NO: 963418 - DNA, 25 bp, Mus musculus
tacctgaagtggcagcttgtttttc

SEQ ID NO: 963419 - DNA, 25 bp, Mus musculus
tacctgacagcggaactctgggcct

SEQ ID NO: 963420 - DNA, 25 bp, Mus musculus
tacctgacaggggaactctgggcct

SEQ ID NO: 963421 - DNA, 25 bp, Mus musculus
tacctgaccacgctgattgggatac

SEQ ID NO: 963422 - DNA, 25 bp, Mus musculus
tacctgaccacgctttggctccttc

SEQ ID NO: 963423 - DNA, 25 bp, Mus musculus
tacctgaccacggtgattgggatac

SEQ ID NO: 963424 - DNA, 25 bp, Mus musculus
tacctgaccacggtttggctccttc

SEQ ID NO: 963425 - DNA, 25 bp, Mus musculus
tacctgcaactcaacgatggatgcc

SEQ ID NO: 963426 - DNA, 25 bp, Mus musculus
tacctgcaactcaacgtctaaggta

SEQ ID NO: 963427 - DNA, 25 bp, Mus musculus
tacctgcaactcaaggatggatgcc

SEQ ID NO: 963428 - DNA, 25 bp, Mus musculus
tacctgcaactcaaggtctaaggta

SEQ ID NO: 963429 - DNA, 25 bp, Mus musculus
tacctgcacaggatatatgtgcctc

SEQ ID NO: 963430 - DNA, 25 bp, Mus musculus
tacctgcacaggctggccagagcgg

SEQ ID NO: 963431 - DNA, 25 bp, Mus musculus
tacctgcacagggtggccagagcgg

SEQ ID NO: 963432 - DNA, 25 bp, Mus musculus
tacctgcacaggttatatgtgcctc

SEQ ID NO: 963433 - DNA, 25 bp, Mus musculus
tacctgcaccagagacggaaaaccc

SEQ ID NO: 963434 - DNA, 25 bp, Mus musculus
tacctgcaccagcattctaatccct

SEQ ID NO: 963435 - DNA, 25 bp, Mus musculus
tacctgcaccaggattctaatccct

SEQ ID NO: 963436 - DNA, 25 bp, Mus musculus
tacctgcaccagtgacggaaaaccc

SEQ ID NO: 963437 - DNA, 25 bp, Mus musculus
tacctgcacctggaagcaccctgct

SEQ ID NO: 963438 - DNA, 25 bp, Mus musculus
tacctgcacctggaagcattttgtt

SEQ ID NO: 963439 - DNA, 25 bp, Mus musculus
tacctgcacctggatgcaccctgct

SEQ ID NO: 963440 - DNA, 25 bp, Mus musculus
tacctgcacctggatgcattttgtt

SEQ ID NO: 963441 - DNA, 25 bp, Mus musculus
tacctgcacgctgggagtgtggatt

SEQ ID NO: 963442 - DNA, 25 bp, Mus musculus
tacctgcacggtgggagtgtggatt

SEQ ID NO: 963443 - DNA, 25 bp, Mus musculus
tacctgccacagagctgagtacgtg

SEQ ID NO: 963444 - DNA, 25 bp, Mus musculus
tacctgccacagtgctgagtacgtg

SEQ ID NO: 963445 - DNA, 25 bp, Mus musculus
tacctgctgacacggcgcgtgtatg

SEQ ID NO: 963446 - DNA, 25 bp, Mus musculus
tacctgctgacagggcgcgtgtatg

SEQ ID NO: 963447 - DNA, 25 bp, Mus musculus
tacctgctggaacgagcagcggtca

SEQ ID NO: 963448 - DNA, 25 bp, Mus musculus
tacctgctggaacgtgtgaccccac

SEQ ID NO: 963449 - DNA, 25 bp, Mus musculus
tacctgctggaaggagcagcggtca

SEQ ID NO: 963450 - DNA, 25 bp, Mus musculus
tacctgctggaaggtgtgaccccac

SEQ ID NO: 963451 - DNA, 25 bp, Mus musculus
tacctgcttacccgtatgacccata

SEQ ID NO: 963452 - DNA, 25 bp, Mus musculus
tacctgcttaccggtatgacccata

SEQ ID NO: 963453 - DNA, 25 bp, Mus musculus
tacctggaagagtgcctgctcactg

SEQ ID NO: 963454 - DNA, 25 bp, Mus musculus
tacctggaagctggcttcagtaagt

SEQ ID NO: 963455 - DNA, 25 bp, Mus musculus
tacctggaaggtggcttcagtaagt

SEQ ID NO: 963456 - DNA, 25 bp, Mus musculus
tacctggaagtgtgcctgctcactg

SEQ ID NO: 963457 - DNA, 25 bp, Mus musculus
tacctggcatccaatctgaaaaggc

SEQ ID NO: 963458 - DNA, 25 bp, Mus musculus
tacctggcatccagagggaactctc

SEQ ID NO: 963459 - DNA, 25 bp, Mus musculus
tacctggcatccagtctgaaatgcc

SEQ ID NO: 963460 - DNA, 25 bp, Mus musculus
tacctggcatcctatctgaaaaggc

SEQ ID NO: 963461 - DNA, 25 bp, Mus musculus
tacctggcatcctgagggaactctc

SEQ ID NO: 963462 - DNA, 25 bp, Mus musculus
tacctggcatcctgtctgaaatgcc

SEQ ID NO: 963463 - DNA, 25 bp, Mus musculus
tacctggcccctgacgtgctggagg

SEQ ID NO: 963464 - DNA, 25 bp, Mus musculus
tacctggcccctgaggtgctggagg

SEQ ID NO: 963465 - DNA, 25 bp, Mus musculus
tacctggggaaacgagtgctgaagg

SEQ ID NO: 963466 - DNA, 25 bp, Mus musculus
tacctggggaaaggagtgctgaagg

SEQ ID NO: 963467 - DNA, 25 bp, Mus musculus
tacctggggacacaattgccctaga

SEQ ID NO: 963468 - DNA, 25 bp, Mus musculus
tacctggggacagaattgccctaga

SEQ ID NO: 963469 - DNA, 25 bp, Mus musculus
tacctggttttgatcaacaacatgc

SEQ ID NO: 963470 - DNA, 25 bp, Mus musculus
tacctggttttgttcaacaacatgc

SEQ ID NO: 963471 - DNA, 25 bp, Mus musculus
tacctgtcagcgctttgtggagaag

SEQ ID NO: 963472 - DNA, 25 bp, Mus musculus
tacctgtcagcggtttgtggagaag

SEQ ID NO: 963473 - DNA, 25 bp, Mus musculus
tacctgtgaggacacgaagacaggt

SEQ ID NO: 963474 - DNA, 25 bp, Mus musculus
tacctgtgaggagacgaagacaggt

SEQ ID NO: 963475 - DNA, 25 bp, Mus musculus
tacctgtgcaaacacgtcgccagta

SEQ ID NO: 963476 - DNA, 25 bp, Mus musculus
tacctgtgcaaacaggtcgccagta

SEQ ID NO: 963477 - DNA, 25 bp, Mus musculus
tacctgtgtctgcacggaaggagta

SEQ ID NO: 963478 - DNA, 25 bp, Mus musculus
tacctgtgtctggacggaaggagta

SEQ ID NO: 963479 - DNA, 25 bp, Mus musculus
taccttacactccacgaacactatg

SEQ ID NO: 963480 - DNA, 25 bp, Mus musculus
taccttacactccaggaacactatg

SEQ ID NO: 963481 - DNA, 25 bp, Mus musculus
taccttcagcttcacgaatgcactg

SEQ ID NO: 963482 - DNA, 25 bp, Mus musculus
taccttcagcttcaggaatgcactg

SEQ ID NO: 963483 - DNA, 25 bp, Mus musculus
taccttccagctgtgaaccccaaga

SEQ ID NO: 963484 - DNA, 25 bp, Mus musculus
taccttccaggtgtgaaccccaaga

SEQ ID NO: 963485 - DNA, 25 bp, Mus musculus
taccttcccaagctcatcagtggtg

SEQ ID NO: 963486 - DNA, 25 bp, Mus musculus
taccttcccaaggtcatcagtggtg

SEQ ID NO: 963487 - DNA, 25 bp, Mus musculus
taccttctgtaactgtttgcttttt

SEQ ID NO: 963488 - DNA, 25 bp, Mus musculus
taccttctgttactgtttgcttttt

SEQ ID NO: 963489 - DNA, 25 bp, Mus musculus
taccttgaatcactgaaaccattcg

SEQ ID NO: 963490 - DNA, 25 bp, Mus musculus
taccttgaatcagtgaaaccattcg

SEQ ID NO: 963491 - DNA, 25 bp, Mus musculus
taccttgtgcaaccgcccagacttc

SEQ ID NO: 963492 - DNA, 25 bp, Mus musculus
taccttgtgcaagcgcccagacttc

SEQ ID NO: 963493 - DNA, 25 bp, Mus musculus
taccttgtggtcaaagcttctttgg

SEQ ID NO: 963494 - DNA, 25 bp, Mus musculus
taccttgtggtcaatgcttctttgg

SEQ ID NO: 963495 - DNA, 25 bp, Mus musculus
tacctttgagtacacgtgatttgaa

SEQ ID NO: 963496 - DNA, 25 bp, Mus musculus
tacctttgagtacaggtgatttgaa

SEQ ID NO: 963497 - DNA, 25 bp, Mus musculus
tacgaaccacacagtaccagcaagg

SEQ ID NO: 963498 - DNA, 25 bp, Mus musculus
tacgaaccacactgtaccagcaagg

SEQ ID NO: 963499 - DNA, 25 bp, Mus musculus
tacgaacgtgcatgaggctgtagag

SEQ ID NO: 963500 - DNA, 25 bp, Mus musculus
tacgaacgtggatgaggctgtagag

SEQ ID NO: 963501 - DNA, 25 bp, Mus musculus
tacgaaggaagagacattgctgctg

SEQ ID NO: 963502 - DNA, 25 bp, Mus musculus
tacgaaggaagagagattgctgctg

SEQ ID NO: 963503 - DNA, 25 bp, Mus musculus
tacgacaaataacatgcacgccatc

SEQ ID NO: 963504 - DNA, 25 bp, Mus musculus
tacgacaaataagatgcacgccatc

SEQ ID NO: 963505 - DNA, 25 bp, Mus musculus
tacgacaatgaagacgtggggtcag

SEQ ID NO: 963506 - DNA, 25 bp, Mus musculus
tacgacaatgaagaggtggggtcag

SEQ ID NO: 963507 - DNA, 25 bp, Mus musculus
tacgacacttttgtcgattacgatg

SEQ ID NO: 963508 - DNA, 25 bp, Mus musculus
tacgacacttttgtggattacgatg

SEQ ID NO: 963509 - DNA, 25 bp, Mus musculus
tacgacagagataacatagaagttg

SEQ ID NO: 963510 - DNA, 25 bp, Mus musculus
tacgacagagttaacatagaagttg

SEQ ID NO: 963511 - DNA, 25 bp, Mus musculus
tacgacctctatcactctcgacaca

SEQ ID NO: 963512 - DNA, 25 bp, Mus musculus
tacgacctctatcagtctcgacaca

SEQ ID NO: 963513 - DNA, 25 bp, Mus musculus
tacgactacactcagggtagtacaa

SEQ ID NO: 963514 - DNA, 25 bp, Mus musculus
tacgactacagaagtgacctctagg

SEQ ID NO: 963515 - DNA, 25 bp, Mus musculus
tacgactacagaagtgacctctggt

SEQ ID NO: 963516 - DNA, 25 bp, Mus musculus
tacgactacagatgtgacctctagg

SEQ ID NO: 963517 - DNA, 25 bp, Mus musculus
tacgactacagatgtgacctctggt

SEQ ID NO: 963518 - DNA, 25 bp, Mus musculus
tacgactacagtcagggtagtacaa

SEQ ID NO: 963519 - DNA, 25 bp, Mus musculus
tacgactcagatgtccctggatgtg

SEQ ID NO: 963520 - DNA, 25 bp, Mus musculus
tacgactcagttgtccctggatgtg

SEQ ID NO: 963521 - DNA, 25 bp, Mus musculus
tacgactctgcacctcttcgctctt

SEQ ID NO: 963522 - DNA, 25 bp, Mus musculus
tacgactctggacctcttcgctctt

SEQ ID NO: 963523 - DNA, 25 bp, Mus musculus
tacgacttggctttgtggctggtgt

SEQ ID NO: 963524 - DNA, 25 bp, Mus musculus
tacgacttgggtttgtggctggtgt

SEQ ID NO: 963525 - DNA, 25 bp, Mus musculus
tacgagacttggcaggatgacctgg

SEQ ID NO: 963526 - DNA, 25 bp, Mus musculus
tacgagacttgggaggatgacctgg

SEQ ID NO: 963527 - DNA, 25 bp, Mus musculus
tacgagatcaagaaggtgttcgcca

SEQ ID NO: 963528 - DNA, 25 bp, Mus musculus
tacgagatcatgaaggtgttcgcca

SEQ ID NO: 963529 - DNA, 25 bp, Mus musculus
tacgaggaagcgctcctgcaggcag

SEQ ID NO: 963530 - DNA, 25 bp, Mus musculus
tacgaggaagcgctgctgcaggcag

SEQ ID NO: 963531 - DNA, 25 bp, Mus musculus
tacgagtgtcgacattcctaatcat

SEQ ID NO: 963532 - DNA, 25 bp, Mus musculus
tacgagtgtcgagattcctaatcat

SEQ ID NO: 963533 - DNA, 25 bp, Mus musculus
tacgatacagcgtcgagatgggcgg

SEQ ID NO: 963534 - DNA, 25 bp, Mus musculus
tacgatacagggtcgagatgggcgg

SEQ ID NO: 963535 - DNA, 25 bp, Mus musculus
tacgatatcacaaatgttaactcat

SEQ ID NO: 963536 - DNA, 25 bp, Mus musculus
tacgatatcacatatgttaactcat

SEQ ID NO: 963537 - DNA, 25 bp, Mus musculus
tacgatgaagactgccaaagtggct

SEQ ID NO: 963538 - DNA, 25 bp, Mus musculus
tacgatgaagcctgtcatggtatcc

SEQ ID NO: 963539 - DNA, 25 bp, Mus musculus
tacgatgaaggctgtcatggtatcc

SEQ ID NO: 963540 - DNA, 25 bp, Mus musculus
tacgatgaagtctgccaaagtggct

SEQ ID NO: 963541 - DNA, 25 bp, Mus musculus
tacgatgctatgccactgggaaatc

SEQ ID NO: 963542 - DNA, 25 bp, Mus musculus
tacgatgctatggcactgggaaatc

SEQ ID NO: 963543 - DNA, 25 bp, Mus musculus
tacgcaacagggcaaaacactgtct

SEQ ID NO: 963544 - DNA, 25 bp, Mus musculus
tacgcaacaggggaaaacactgtct

SEQ ID NO: 963545 - DNA, 25 bp, Mus musculus
tacgcacactatcaacacctgggta

SEQ ID NO: 963546 - DNA, 25 bp, Mus musculus
tacgcacactatgaacacctgggta

SEQ ID NO: 963547 - DNA, 25 bp, Mus musculus
tacgcacagaagcgatacctggagg

SEQ ID NO: 963548 - DNA, 25 bp, Mus musculus
tacgcacagaagggatacctggagg

SEQ ID NO: 963549 - DNA, 25 bp, Mus musculus
tacgcaccaaagctgtgactttgag

SEQ ID NO: 963550 - DNA, 25 bp, Mus musculus
tacgcaccaaaggtgtgactttgag

SEQ ID NO: 963551 - DNA, 25 bp, Mus musculus
tacgccaaggccttcaccattatca

SEQ ID NO: 963552 - DNA, 25 bp, Mus musculus
tacgccaagggcttcaccattatca

SEQ ID NO: 963553 - DNA, 25 bp, Mus musculus
tacgcccagaagcacgtactctatc

SEQ ID NO: 963554 - DNA, 25 bp, Mus musculus
tacgcccagaagcaggtactctatc

SEQ ID NO: 963555 - DNA, 25 bp, Mus musculus
tacgcccaggtcaacgactatgaga

SEQ ID NO: 963556 - DNA, 25 bp, Mus musculus
tacgcccaggtcaacgagtccatga

SEQ ID NO: 963557 - DNA, 25 bp, Mus musculus
tacgcccaggtcaaggactatgaga

SEQ ID NO: 963558 - DNA, 25 bp, Mus musculus
tacgcccaggtcaaggagtccatga

SEQ ID NO: 963559 - DNA, 25 bp, Mus musculus
tacgcggagaagctcatcgattatg

SEQ ID NO: 963560 - DNA, 25 bp, Mus musculus
tacgcggagaaggtcatcgattatg

SEQ ID NO: 963561 - DNA, 25 bp, Mus musculus
tacgctctatcctacggactctgac

SEQ ID NO: 963562 - DNA, 25 bp, Mus musculus
tacgctctatcctagggactctgac

SEQ ID NO: 963563 - DNA, 25 bp, Mus musculus
tacgctctggagaacatgtttcgag

SEQ ID NO: 963564 - DNA, 25 bp, Mus musculus
tacgctctggagaagatgtttcgag

SEQ ID NO: 963565 - DNA, 25 bp, Mus musculus
tacgctgcgccaaattttcacctga

SEQ ID NO: 963566 - DNA, 25 bp, Mus musculus
tacgctgcgccatattttcacctga

SEQ ID NO: 963567 - DNA, 25 bp, Mus musculus
tacgctgtgcagataactggactat

SEQ ID NO: 963568 - DNA, 25 bp, Mus musculus
tacgctgtgcagttaactggactat

SEQ ID NO: 963569 - DNA, 25 bp, Mus musculus
tacgcttcctgaagggatgggctct

SEQ ID NO: 963570 - DNA, 25 bp, Mus musculus
tacgcttcctgatgggatgggctct

SEQ ID NO: 963571 - DNA, 25 bp, Mus musculus
tacggaccaaatcgaatgaataaaa

SEQ ID NO: 963572 - DNA, 25 bp, Mus musculus
tacggaccaaatggaatgaataaaa

SEQ ID NO: 963573 - DNA, 25 bp, Mus musculus
tacggactacgggacattcttggca

SEQ ID NO: 963574 - DNA, 25 bp, Mus musculus
tacggactacgggagattcttggca

SEQ ID NO: 963575 - DNA, 25 bp, Mus musculus
tacggactagcccagcaggtggcca

SEQ ID NO: 963576 - DNA, 25 bp, Mus musculus
tacggactagcgccctgcacacagt

SEQ ID NO: 963577 - DNA, 25 bp, Mus musculus
tacggactaggccagcaggtggcca

SEQ ID NO: 963578 - DNA, 25 bp, Mus musculus
tacggactagggccctgcacacagt

SEQ ID NO: 963579 - DNA, 25 bp, Mus musculus
tacggaggcacacctttacacgccg

SEQ ID NO: 963580 - DNA, 25 bp, Mus musculus
tacggaggcacagctttacacgccg

SEQ ID NO: 963581 - DNA, 25 bp, Mus musculus
tacggagttatacgtatcagaagag

SEQ ID NO: 963582 - DNA, 25 bp, Mus musculus
tacggagttataggtatcagaagag

SEQ ID NO: 963583 - DNA, 25 bp, Mus musculus
tacggattccgcagcggagaagacc

SEQ ID NO: 963584 - DNA, 25 bp, Mus musculus
tacggattccgcaggggagaagacc

SEQ ID NO: 963585 - DNA, 25 bp, Mus musculus
tacggcagaacgcaccctcaccctc

SEQ ID NO: 963586 - DNA, 25 bp, Mus musculus
tacggcagaacgcagcctcaccctc

SEQ ID NO: 963587 - DNA, 25 bp, Mus musculus
tacggcatccggagtcacctcttct

SEQ ID NO: 963588 - DNA, 25 bp, Mus musculus
tacggcatccggtgtcacctcttct

SEQ ID NO: 963589 - DNA, 25 bp, Mus musculus
tacggccaagagacggttccggagg

SEQ ID NO: 963590 - DNA, 25 bp, Mus musculus
tacggccaagagtcggttccggagg

SEQ ID NO: 963591 - DNA, 25 bp, Mus musculus
tacggccgcgccatcactcggaacc

SEQ ID NO: 963592 - DNA, 25 bp, Mus musculus
tacggccgcgccatgactcggaacc

SEQ ID NO: 963593 - DNA, 25 bp, Mus musculus
tacggcctctaccgcacacacctgc

SEQ ID NO: 963594 - DNA, 25 bp, Mus musculus
tacggcctctaccggacacacctgc

SEQ ID NO: 963595 - DNA, 25 bp, Mus musculus
tacggcgatttgctcgctttgacag

SEQ ID NO: 963596 - DNA, 25 bp, Mus musculus
tacggcgatttggtcgctttgacag

SEQ ID NO: 963597 - DNA, 25 bp, Mus musculus
tacggcggagaggaacactcgggcc

SEQ ID NO: 963598 - DNA, 25 bp, Mus musculus
tacggcggagatgaagttggcgctc

SEQ ID NO: 963599 - DNA, 25 bp, Mus musculus
tacggcggagtggaacactcgggcc

SEQ ID NO: 963600 - DNA, 25 bp, Mus musculus
tacggcggagttgaagttggcgctc

SEQ ID NO: 963601 - DNA, 25 bp, Mus musculus
tacgggaatgcacacgagagaaatg

SEQ ID NO: 963602 - DNA, 25 bp, Mus musculus
tacgggaatgcacaggagagaaatg

SEQ ID NO: 963603 - DNA, 25 bp, Mus musculus
tacgggatcacacgtatatccattc

SEQ ID NO: 963604 - DNA, 25 bp, Mus musculus
tacgggatcacaggtatatccattc

SEQ ID NO: 963605 - DNA, 25 bp, Mus musculus
tacgggcactggcacgcctgtacgg

SEQ ID NO: 963606 - DNA, 25 bp, Mus musculus
tacgggcactggcacggctggtcta

SEQ ID NO: 963607 - DNA, 25 bp, Mus musculus
tacgggcactggcaggcctgtacgg

SEQ ID NO: 963608 - DNA, 25 bp, Mus musculus
tacgggcactggcagggctggtcta

SEQ ID NO: 963609 - DNA, 25 bp, Mus musculus
tacggtgcatacaaccaacatgctg

SEQ ID NO: 963610 - DNA, 25 bp, Mus musculus
tacggtgcatacaagcaacatgctg

SEQ ID NO: 963611 - DNA, 25 bp, Mus musculus
tacggtggtggagtccacctgtcaa

SEQ ID NO: 963612 - DNA, 25 bp, Mus musculus
tacggtggtggagtgcacctgtcaa

SEQ ID NO: 963613 - DNA, 25 bp, Mus musculus
tacggtgttcagcgactgctgacct

SEQ ID NO: 963614 - DNA, 25 bp, Mus musculus
tacggtgttcagctcactgcaagac

SEQ ID NO: 963615 - DNA, 25 bp, Mus musculus
tacggtgttcagggactgctgacct

SEQ ID NO: 963616 - DNA, 25 bp, Mus musculus
tacggtgttcaggtcactgcaagac

SEQ ID NO: 963617 - DNA, 25 bp, Mus musculus
tacgtacatctccgtacgaataagt

SEQ ID NO: 963618 - DNA, 25 bp, Mus musculus
tacgtacatctcggtacgaataagt

SEQ ID NO: 963619 - DNA, 25 bp, Mus musculus
tacgtagactccgacggacatctct

SEQ ID NO: 963620 - DNA, 25 bp, Mus musculus
tacgtagactccgagggacatctct

SEQ ID NO: 963621 - DNA, 25 bp, Mus musculus
tacgtcaaagtcatagttgatattc

SEQ ID NO: 963622 - DNA, 25 bp, Mus musculus
tacgtcaaagtcattgttgatattc

SEQ ID NO: 963623 - DNA, 25 bp, Mus musculus
tacgtcaccgaggaccttccacaac

SEQ ID NO: 963624 - DNA, 25 bp, Mus musculus
tacgtcaccgaggagcttccacaac

SEQ ID NO: 963625 - DNA, 25 bp, Mus musculus
tacgtcactccaaggaacagccatg

SEQ ID NO: 963626 - DNA, 25 bp, Mus musculus
tacgtcactccatggaacagccatg

SEQ ID NO: 963627 - DNA, 25 bp, Mus musculus
tacgtcagttgtaggatcgaaatgt

SEQ ID NO: 963628 - DNA, 25 bp, Mus musculus
tacgtcagttgttggatcgaaatgt

SEQ ID NO: 963629 - DNA, 25 bp, Mus musculus
tacgtcatcaatcacgctggagaca

SEQ ID NO: 963630 - DNA, 25 bp, Mus musculus
tacgtcatcaatcaggctggagaca

SEQ ID NO: 963631 - DNA, 25 bp, Mus musculus
tacgtcatccgcattgaccaggatg

SEQ ID NO: 963632 - DNA, 25 bp, Mus musculus
tacgtcatccgctttgaccaggatg

SEQ ID NO: 963633 - DNA, 25 bp, Mus musculus
tacgtcattgctacagccagtgtgg

SEQ ID NO: 963634 - DNA, 25 bp, Mus musculus
tacgtcattggtacagccagtgtgg

SEQ ID NO: 963635 - DNA, 25 bp, Mus musculus
tacgtccatctgcacgggaaggagg

SEQ ID NO: 963636 - DNA, 25 bp, Mus musculus
tacgtccatctgcaggggaaggagg

SEQ ID NO: 963637 - DNA, 25 bp, Mus musculus
tacgtccgagacatcgagatcgagg

SEQ ID NO: 963638 - DNA, 25 bp, Mus musculus
tacgtccgagacatggagatcgagg

SEQ ID NO: 963639 - DNA, 25 bp, Mus musculus
tacgtcctcgcaggctatgatggcc

SEQ ID NO: 963640 - DNA, 25 bp, Mus musculus
tacgtcctcggaggctatgatggcc

SEQ ID NO: 963641 - DNA, 25 bp, Mus musculus
tacgtcctctacaacctcggcttct

SEQ ID NO: 963642 - DNA, 25 bp, Mus musculus
tacgtcctctacaagctcggcttct

SEQ ID NO: 963643 - DNA, 25 bp, Mus musculus
tacgtcctgcagagcgacgtttttc

SEQ ID NO: 963644 - DNA, 25 bp, Mus musculus
tacgtcctgcagtgcgacgtttttc

SEQ ID NO: 963645 - DNA, 25 bp, Mus musculus
tacgtgaagccccgcaacaaggaac

SEQ ID NO: 963646 - DNA, 25 bp, Mus musculus
tacgtgaagcccggcaacaaggaac

SEQ ID NO: 963647 - DNA, 25 bp, Mus musculus
tacgtgaaggatctggtggttcaga

SEQ ID NO: 963648 - DNA, 25 bp, Mus musculus
tacgtgaaggatgtggtggttcaga

SEQ ID NO: 963649 - DNA, 25 bp, Mus musculus
tacgtgacagaaatggctcagggat

SEQ ID NO: 963650 - DNA, 25 bp, Mus musculus
tacgtgacagtaatggctcagggat

SEQ ID NO: 963651 - DNA, 25 bp, Mus musculus
tacgtgagacagcacgacatagcca

SEQ ID NO: 963652 - DNA, 25 bp, Mus musculus
tacgtgagacagcaggacatagcca

SEQ ID NO: 963653 - DNA, 25 bp, Mus musculus
tacgtgcaggcgcacgtcaagtgct

SEQ ID NO: 963654 - DNA, 25 bp, Mus musculus
tacgtgcaggcgcaggtcaagtgct

SEQ ID NO: 963655 - DNA, 25 bp, Mus musculus
tacgtgccagatatactgtcttgtt

SEQ ID NO: 963656 - DNA, 25 bp, Mus musculus
tacgtgccagatattctgtcttgtt

SEQ ID NO: 963657 - DNA, 25 bp, Mus musculus
tacgtgcgcccacacccagcacccc

SEQ ID NO: 963658 - DNA, 25 bp, Mus musculus
tacgtgcgcccagacccagcacccc

SEQ ID NO: 963659 - DNA, 25 bp, Mus musculus
tacgtggatgggaacgaagagataa

SEQ ID NO: 963660 - DNA, 25 bp, Mus musculus
tacgtggatgggaaggaagagataa

SEQ ID NO: 963661 - DNA, 25 bp, Mus musculus
tacgtggcagctggatcagacattg

SEQ ID NO: 963662 - DNA, 25 bp, Mus musculus
tacgtggcaggtggatcagacattg

SEQ ID NO: 963663 - DNA, 25 bp, Mus musculus
tacgtgggagcacgaactgtggaat

SEQ ID NO: 963664 - DNA, 25 bp, Mus musculus
tacgtgggagcaggaactgtggaat

SEQ ID NO: 963665 - DNA, 25 bp, Mus musculus
tacgttcactcgagacctatgaaag

SEQ ID NO: 963666 - DNA, 25 bp, Mus musculus
tacgttcactcgtgacctatgaaag

SEQ ID NO: 963667 - DNA, 25 bp, Mus musculus
tacgttggcaatctggactatggtg

SEQ ID NO: 963668 - DNA, 25 bp, Mus musculus
tacgttggcaatgtggactatggtg

SEQ ID NO: 963669 - DNA, 25 bp, Mus musculus
tacgttttcattctgatctctgggc

SEQ ID NO: 963670 - DNA, 25 bp, Mus musculus
tacgttttcattgtgatctctgggc

SEQ ID NO: 963671 - DNA, 25 bp, Mus musculus
tacgtttttcagaatgccggacaca

SEQ ID NO: 963672 - DNA, 25 bp, Mus musculus
tacgtttttcagtatgccggacaca

SEQ ID NO: 963673 - DNA, 25 bp, Mus musculus
tactaagaggatcttatttcactat

SEQ ID NO: 963674 - DNA, 25 bp, Mus musculus
tactaagaggttcttatttcactat

SEQ ID NO: 963675 - DNA, 25 bp, Mus musculus
tactaagatactgacggaatttgta

SEQ ID NO: 963676 - DNA, 25 bp, Mus musculus
tactaagatactgagggaatttgta

SEQ ID NO: 963677 - DNA, 25 bp, Mus musculus
tactaatttatgccggaaccctctg

SEQ ID NO: 963678 - DNA, 25 bp, Mus musculus
tactaatttatggcggaaccctctg

SEQ ID NO: 963679 - DNA, 25 bp, Mus musculus
tactacacagaccccttggttcgac

SEQ ID NO: 963680 - DNA, 25 bp, Mus musculus
tactacacagtccccttggttcgac

SEQ ID NO: 963681 - DNA, 25 bp, Mus musculus
tactacactaggccccagtttgatc

SEQ ID NO: 963682 - DNA, 25 bp, Mus musculus
tactacactagggcccagtttgatc

SEQ ID NO: 963683 - DNA, 25 bp, Mus musculus
tactacagactgcttgggaacttct

SEQ ID NO: 963684 - DNA, 25 bp, Mus musculus
tactacagactggttgggaacttct

SEQ ID NO: 963685 - DNA, 25 bp, Mus musculus
tactacatagctcgcttttttctca

SEQ ID NO: 963686 - DNA, 25 bp, Mus musculus
tactacatagctggcttttttctca

SEQ ID NO: 963687 - DNA, 25 bp, Mus musculus
tactacatctccaaacctatctacc

SEQ ID NO: 963688 - DNA, 25 bp, Mus musculus
tactacatctgcaaacctatctacc

SEQ ID NO: 963689 - DNA, 25 bp, Mus musculus
tactacattataaatgcaagttctg

SEQ ID NO: 963690 - DNA, 25 bp, Mus musculus
tactacattataactacatcaaatg

SEQ ID NO: 963691 - DNA, 25 bp, Mus musculus
tactacattatatatgcaagttctg

SEQ ID NO: 963692 - DNA, 25 bp, Mus musculus
tactacattatatctacatcaaatg

SEQ ID NO: 963693 - DNA, 25 bp, Mus musculus
tactacgaagctggcataggagagg

SEQ ID NO: 963694 - DNA, 25 bp, Mus musculus
tactacgaaggtggcataggagagg

SEQ ID NO: 963695 - DNA, 25 bp, Mus musculus
tactacgcagcccctaataagtgtg

SEQ ID NO: 963696 - DNA, 25 bp, Mus musculus
tactacgcaggccctaataagtgtg

SEQ ID NO: 963697 - DNA, 25 bp, Mus musculus
tactactacatcaccaaacctatct

SEQ ID NO: 963698 - DNA, 25 bp, Mus musculus
tactactacatctccaaacctatct

SEQ ID NO: 963699 - DNA, 25 bp, Mus musculus
tactactgaaaaccccaagtaccac

SEQ ID NO: 963700 - DNA, 25 bp, Mus musculus
tactactgaataccccaagtaccac

SEQ ID NO: 963701 - DNA, 25 bp, Mus musculus
tactagacatacagaatgctcctga

SEQ ID NO: 963702 - DNA, 25 bp, Mus musculus
tactagacatacagtatgctcctga

SEQ ID NO: 963703 - DNA, 25 bp, Mus musculus
tactagagacagctgtaaaaccacc

SEQ ID NO: 963704 - DNA, 25 bp, Mus musculus
tactagagacaggtgtaaaaccacc

SEQ ID NO: 963705 - DNA, 25 bp, Mus musculus
tactagcatttcaacgatattacct

SEQ ID NO: 963706 - DNA, 25 bp, Mus musculus
tactagcatttcaaggatattacct

SEQ ID NO: 963707 - DNA, 25 bp, Mus musculus
tactatcacgattgtggctgaggag

SEQ ID NO: 963708 - DNA, 25 bp, Mus musculus
tactatcacgtttgtggctgaggag

SEQ ID NO: 963709 - DNA, 25 bp, Mus musculus
tactatccacatatcgaacagcctt

SEQ ID NO: 963710 - DNA, 25 bp, Mus musculus
tactatccacatatggaacagcctt

SEQ ID NO: 963711 - DNA, 25 bp, Mus musculus
tactatcgccaaatacctggacaac

SEQ ID NO: 963712 - DNA, 25 bp, Mus musculus
tactatcgccaattacctggacaac

SEQ ID NO: 963713 - DNA, 25 bp, Mus musculus
tactatctgacaagcacaaacggga

SEQ ID NO: 963714 - DNA, 25 bp, Mus musculus
tactatctgacacaagtggtccttc

SEQ ID NO: 963715 - DNA, 25 bp, Mus musculus
tactatctgacagaagtggtccttc

SEQ ID NO: 963716 - DNA, 25 bp, Mus musculus
tactatctgacatgcacaaacggga

SEQ ID NO: 963717 - DNA, 25 bp, Mus musculus
tactatgaaaagcgatggatcttta

SEQ ID NO: 963718 - DNA, 25 bp, Mus musculus
tactatgaaaagctgacgtgcacag

SEQ ID NO: 963719 - DNA, 25 bp, Mus musculus
tactatgaaaagggatggatcttta

SEQ ID NO: 963720 - DNA, 25 bp, Mus musculus
tactatgaaaaggtgacgtgcacag

SEQ ID NO: 963721 - DNA, 25 bp, Mus musculus
tactatgaacttaatatggctattt

SEQ ID NO: 963722 - DNA, 25 bp, Mus musculus
tactatgaactttatatggctattt

SEQ ID NO: 963723 - DNA, 25 bp, Mus musculus
tactatgaaggcgtcaatatgacat

SEQ ID NO: 963724 - DNA, 25 bp, Mus musculus
tactatgaaggcgtcggtatgcaat

SEQ ID NO: 963725 - DNA, 25 bp, Mus musculus
tactatgaaggcgtgaatatgacat

SEQ ID NO: 963726 - DNA, 25 bp, Mus musculus
tactatgaaggcgtgggtatgcaat

SEQ ID NO: 963727 - DNA, 25 bp, Mus musculus
tactatgaccagccagaagatgaat

SEQ ID NO: 963728 - DNA, 25 bp, Mus musculus
tactatgaccaggcagaagatgaat

SEQ ID NO: 963729 - DNA, 25 bp, Mus musculus
tactatgagaagataaagaaagacc

SEQ ID NO: 963730 - DNA, 25 bp, Mus musculus
tactatgagaagattaagaaagacc

SEQ ID NO: 963731 - DNA, 25 bp, Mus musculus
tactatggcatgagcgacagccgct

SEQ ID NO: 963732 - DNA, 25 bp, Mus musculus
tactatggcatgagggacagccgct

SEQ ID NO: 963733 - DNA, 25 bp, Mus musculus
tactatggtaaacatccctcaagaa

SEQ ID NO: 963734 - DNA, 25 bp, Mus musculus
tactatggtaaagatccctcaagaa

SEQ ID NO: 963735 - DNA, 25 bp, Mus musculus
tactatgtttagcgcagtgcttgac

SEQ ID NO: 963736 - DNA, 25 bp, Mus musculus
tactatgtttagggcagtgcttgac

SEQ ID NO: 963737 - DNA, 25 bp, Mus musculus
tactattagatgaatatgcaggtcc

SEQ ID NO: 963738 - DNA, 25 bp, Mus musculus
tactattagatgtatatgcaggtcc

SEQ ID NO: 963739 - DNA, 25 bp, Mus musculus
tactattattcacctgtggaaagaa

SEQ ID NO: 963740 - DNA, 25 bp, Mus musculus
tactattattcagctgtggaaagaa

SEQ ID NO: 963741 - DNA, 25 bp, Mus musculus
tactcacctgcttcaaccagatgtg

SEQ ID NO: 963742 - DNA, 25 bp, Mus musculus
tactcacctggttcaaccagatgtg

SEQ ID NO: 963743 - DNA, 25 bp, Mus musculus
tactcacttgaaccccatctctgag

SEQ ID NO: 963744 - DNA, 25 bp, Mus musculus
tactcacttgaagcccatctctgag

SEQ ID NO: 963745 - DNA, 25 bp, Mus musculus
tactcagaacgttacgactatcctg

SEQ ID NO: 963746 - DNA, 25 bp, Mus musculus
tactcagaacgttaggactatcctg

SEQ ID NO: 963747 - DNA, 25 bp, Mus musculus
tactcagacatacacctgaagaagc

SEQ ID NO: 963748 - DNA, 25 bp, Mus musculus
tactcagacatagacctgaagaagc

SEQ ID NO: 963749 - DNA, 25 bp, Mus musculus
tactcaggaccccacctctgtcagc

SEQ ID NO: 963750 - DNA, 25 bp, Mus musculus
tactcaggaccccacgaccttgcca

SEQ ID NO: 963751 - DNA, 25 bp, Mus musculus
tactcaggaccccagctctgtcagc

SEQ ID NO: 963752 - DNA, 25 bp, Mus musculus
tactcaggaccccaggaccttgcca

SEQ ID NO: 963753 - DNA, 25 bp, Mus musculus
tactcagtcacccacgggaccttgg

SEQ ID NO: 963754 - DNA, 25 bp, Mus musculus
tactcagtcacccaggggaccttgg

SEQ ID NO: 963755 - DNA, 25 bp, Mus musculus
tactcataagaatggctatgctcct

SEQ ID NO: 963756 - DNA, 25 bp, Mus musculus
tactcataagtatggctatgctcct

SEQ ID NO: 963757 - DNA, 25 bp, Mus musculus
tactcatctcagcgctgtccaagaa

SEQ ID NO: 963758 - DNA, 25 bp, Mus musculus
tactcatctcagggctgtccaagaa

SEQ ID NO: 963759 - DNA, 25 bp, Mus musculus
tactcatgtacacaacatgatgagt

SEQ ID NO: 963760 - DNA, 25 bp, Mus musculus
tactcatgtacagaacatgatgagt

SEQ ID NO: 963761 - DNA, 25 bp, Mus musculus
tactccaaagcgttatgagccagat

SEQ ID NO: 963762 - DNA, 25 bp, Mus musculus
tactccaaaggattcgaacttctgg

SEQ ID NO: 963763 - DNA, 25 bp, Mus musculus
tactccaaaggattggaacttctgg

SEQ ID NO: 963764 - DNA, 25 bp, Mus musculus
tactccaaagggttatgagccagat

SEQ ID NO: 963765 - DNA, 25 bp, Mus musculus
tactccaagcagcctgagctgatga

SEQ ID NO: 963766 - DNA, 25 bp, Mus musculus
tactccaagcaggctgagctgatga

SEQ ID NO: 963767 - DNA, 25 bp, Mus musculus
tactccaaggcaaacgtgttgaacg

SEQ ID NO: 963768 - DNA, 25 bp, Mus musculus
tactccaaggcaaaggtgttgaacg

SEQ ID NO: 963769 - DNA, 25 bp, Mus musculus
tactccaccaagccttacctgatga

SEQ ID NO: 963770 - DNA, 25 bp, Mus musculus
tactccaccaaggcttacctgatga

SEQ ID NO: 963771 - DNA, 25 bp, Mus musculus
tactccagactacggaacgacacag

SEQ ID NO: 963772 - DNA, 25 bp, Mus musculus
tactccagactagggaacgacacag

SEQ ID NO: 963773 - DNA, 25 bp, Mus musculus
tactccagagaacgtctgtgcaagt

SEQ ID NO: 963774 - DNA, 25 bp, Mus musculus
tactccagagaaggtctgtgcaagt

SEQ ID NO: 963775 - DNA, 25 bp, Mus musculus
tactccagagcatgcaaaagtcatg

SEQ ID NO: 963776 - DNA, 25 bp, Mus musculus
tactccagaggatgcaaaagtcatg

SEQ ID NO: 963777 - DNA, 25 bp, Mus musculus
tactccatcaattgtagggatcccg

SEQ ID NO: 963778 - DNA, 25 bp, Mus musculus
tactccatcatttgtagggatcccg

SEQ ID NO: 963779 - DNA, 25 bp, Mus musculus
tactccatggatcatttggcaagtc

SEQ ID NO: 963780 - DNA, 25 bp, Mus musculus
tactccatggatgatttggcaagtc

SEQ ID NO: 963781 - DNA, 25 bp, Mus musculus
tactcccaatatgaagactcttcag

SEQ ID NO: 963782 - DNA, 25 bp, Mus musculus
tactcccaatttgaagactcttcag

SEQ ID NO: 963783 - DNA, 25 bp, Mus musculus
tactcccaggcgggcctggtgtgcc

SEQ ID NO: 963784 - DNA, 25 bp, Mus musculus
tactcccaggggggcctggtgtgcc

SEQ ID NO: 963785 - DNA, 25 bp, Mus musculus
tactcccccatgcagaagatttagc

SEQ ID NO: 963786 - DNA, 25 bp, Mus musculus
tactcccccatggagaagatttagc

SEQ ID NO: 963787 - DNA, 25 bp, Mus musculus
tactccctgctccacctcaccactc

SEQ ID NO: 963788 - DNA, 25 bp, Mus musculus
tactccctgctccagctcaccactc

SEQ ID NO: 963789 - DNA, 25 bp, Mus musculus
tactccgccaagctggataatgcca

SEQ ID NO: 963790 - DNA, 25 bp, Mus musculus
tactccgccaaggtggataatgcca

SEQ ID NO: 963791 - DNA, 25 bp, Mus musculus
tactccgggcagaccccagcatccg

SEQ ID NO: 963792 - DNA, 25 bp, Mus musculus
tactccgggcagacgccagcatccg

SEQ ID NO: 963793 - DNA, 25 bp, Mus musculus
tactccgtgcagaactgaactttgg

SEQ ID NO: 963794 - DNA, 25 bp, Mus musculus
tactccgtgcagtactgaactttgg

SEQ ID NO: 963795 - DNA, 25 bp, Mus musculus
tactcctcagctggaattttggagg

SEQ ID NO: 963796 - DNA, 25 bp, Mus musculus
tactcctcaggtggaattttggagg

SEQ ID NO: 963797 - DNA, 25 bp, Mus musculus
tactcctgagggcaattccgtcatc

SEQ ID NO: 963798 - DNA, 25 bp, Mus musculus
tactcctgagggcatttccgtcatc

SEQ ID NO: 963799 - DNA, 25 bp, Mus musculus
tactcctgctggcggctggagaatc

SEQ ID NO: 963800 - DNA, 25 bp, Mus musculus
tactcctgctgggggctggagaatc

SEQ ID NO: 963801 - DNA, 25 bp, Mus musculus
tactcctggtaccaccaccagcgag

SEQ ID NO: 963802 - DNA, 25 bp, Mus musculus
tactcctggtaccagcaccagcgag

SEQ ID NO: 963803 - DNA, 25 bp, Mus musculus
tactcctggtatcaccatcagcgat

SEQ ID NO: 963804 - DNA, 25 bp, Mus musculus
tactcctggtatcagcatcagcgat

SEQ ID NO: 963805 - DNA, 25 bp, Mus musculus
tactcctgtacccgtgcccgtcatg

SEQ ID NO: 963806 - DNA, 25 bp, Mus musculus
tactcctgtaccggtgcccgtcatg

SEQ ID NO: 963807 - DNA, 25 bp, Mus musculus
tactcctttgctgctgctgttgtgg

SEQ ID NO: 963808 - DNA, 25 bp, Mus musculus
tactcctttggtgctgctgttgtgg

SEQ ID NO: 963809 - DNA, 25 bp, Mus musculus
tactcgagccagcttctctccacta

SEQ ID NO: 963810 - DNA, 25 bp, Mus musculus
tactcgagccaggttctctccacta

SEQ ID NO: 963811 - DNA, 25 bp, Mus musculus
tactcgatggcgcagaggtgtctgt

SEQ ID NO: 963812 - DNA, 25 bp, Mus musculus
tactcgatggcggagaggtgtctgt

SEQ ID NO: 963813 - DNA, 25 bp, Mus musculus
tactcggcaaagatggctcacatga

SEQ ID NO: 963814 - DNA, 25 bp, Mus musculus
tactcggcaaagttggctcacatga

SEQ ID NO: 963815 - DNA, 25 bp, Mus musculus
tactctaccagacagtcttttatcc

SEQ ID NO: 963816 - DNA, 25 bp, Mus musculus
tactctaccagagagtcttttatcc

SEQ ID NO: 963817 - DNA, 25 bp, Mus musculus
tactctacgacacgaacctgccaga

SEQ ID NO: 963818 - DNA, 25 bp, Mus musculus
tactctacgacaggaacctgccaga

SEQ ID NO: 963819 - DNA, 25 bp, Mus musculus
tactctcaacagatcacagtcagtc

SEQ ID NO: 963820 - DNA, 25 bp, Mus musculus
tactctcaacagttcacagtcagtc

SEQ ID NO: 963821 - DNA, 25 bp, Mus musculus
tactctcacaatcctctgtcagaaa

SEQ ID NO: 963822 - DNA, 25 bp, Mus musculus
tactctcacaatctgtcctactgaa

SEQ ID NO: 963823 - DNA, 25 bp, Mus musculus
tactctcacaatgctctgtcagaaa

SEQ ID NO: 963824 - DNA, 25 bp, Mus musculus
tactctcacaatgtgtcctactgaa

SEQ ID NO: 963825 - DNA, 25 bp, Mus musculus
tactctgagaagcttcgggaactgg

SEQ ID NO: 963826 - DNA, 25 bp, Mus musculus
tactctgagaaggttcgggaactgg

SEQ ID NO: 963827 - DNA, 25 bp, Mus musculus
tactctgatccttcatggcagtgaa

SEQ ID NO: 963828 - DNA, 25 bp, Mus musculus
tactctgatccttcttggcagtgaa

SEQ ID NO: 963829 - DNA, 25 bp, Mus musculus
tactctgcaaccaacgcctttgtag

SEQ ID NO: 963830 - DNA, 25 bp, Mus musculus
tactctgcaaccaaggcctttgtag

SEQ ID NO: 963831 - DNA, 25 bp, Mus musculus
tactctgcccttctccgtggggccc

SEQ ID NO: 963832 - DNA, 25 bp, Mus musculus
tactctgcccttgtccgtggggccc

SEQ ID NO: 963833 - DNA, 25 bp, Mus musculus
tactctggacagaaaggaattcagt

SEQ ID NO: 963834 - DNA, 25 bp, Mus musculus
tactctggacagtaaggaattcagt

SEQ ID NO: 963835 - DNA, 25 bp, Mus musculus
tactctgggcaccctaataattttc

SEQ ID NO: 963836 - DNA, 25 bp, Mus musculus
tactctgggcacgctaataattttc

SEQ ID NO: 963837 - DNA, 25 bp, Mus musculus
tactctgtaaaaaacgttctctata

SEQ ID NO: 963838 - DNA, 25 bp, Mus musculus
tactctgtaaaaaaggttctctata

SEQ ID NO: 963839 - DNA, 25 bp, Mus musculus
tactctgtccctcgcgtggggacag

SEQ ID NO: 963840 - DNA, 25 bp, Mus musculus
tactctgtccctggcgtggggacag

SEQ ID NO: 963841 - DNA, 25 bp, Mus musculus
tactctgtgaagactagggacagga

SEQ ID NO: 963842 - DNA, 25 bp, Mus musculus
tactctgtgaagccccgagaccaga

SEQ ID NO: 963843 - DNA, 25 bp, Mus musculus
tactctgtgaagcgacaggaagatg

SEQ ID NO: 963844 - DNA, 25 bp, Mus musculus
tactctgtgaaggcccgagaccaga

SEQ ID NO: 963845 - DNA, 25 bp, Mus musculus
tactctgtgaagggacaggaagatg

SEQ ID NO: 963846 - DNA, 25 bp, Mus musculus
tactctgtgaagtctagggacagga

SEQ ID NO: 963847 - DNA, 25 bp, Mus musculus
tactctgtgccacacatcctgcagt

SEQ ID NO: 963848 - DNA, 25 bp, Mus musculus
tactctgtgccacccatgaatgtcc

SEQ ID NO: 963849 - DNA, 25 bp, Mus musculus
tactctgtgccagacatcctgcagt

SEQ ID NO: 963850 - DNA, 25 bp, Mus musculus
tactctgtgccagccatgaatgtcc

SEQ ID NO: 963851 - DNA, 25 bp, Mus musculus
tactctgtggagctcagctacatgg

SEQ ID NO: 963852 - DNA, 25 bp, Mus musculus
tactctgtggaggtcagctacatgg

SEQ ID NO: 963853 - DNA, 25 bp, Mus musculus
tactctgtttcactggaaacaagtt

SEQ ID NO: 963854 - DNA, 25 bp, Mus musculus
tactctgtttcagtggaaacaagtt

SEQ ID NO: 963855 - DNA, 25 bp, Mus musculus
tactcttacaaacgtgtatgatgga

SEQ ID NO: 963856 - DNA, 25 bp, Mus musculus
tactcttacaaaggtgtatgatgga

SEQ ID NO: 963857 - DNA, 25 bp, Mus musculus
tactctttcatcaacggtgacactt

SEQ ID NO: 963858 - DNA, 25 bp, Mus musculus
tactctttcatcaagggtgacactt

SEQ ID NO: 963859 - DNA, 25 bp, Mus musculus
tactgaaaccagagctctagaagga

SEQ ID NO: 963860 - DNA, 25 bp, Mus musculus
tactgaaacctgagctctagaagga

SEQ ID NO: 963861 - DNA, 25 bp, Mus musculus
tactgaagaacactgcctttttagt

SEQ ID NO: 963862 - DNA, 25 bp, Mus musculus
tactgaagaacagtgcctttttagt

SEQ ID NO: 963863 - DNA, 25 bp, Mus musculus
tactgacggtcacatatatgaaatc

SEQ ID NO: 963864 - DNA, 25 bp, Mus musculus
tactgacggtcagatatatgaaatc

SEQ ID NO: 963865 - DNA, 25 bp, Mus musculus
tactgagaagctcctggcggctgtc

SEQ ID NO: 963866 - DNA, 25 bp, Mus musculus
tactgagaaggtcctggcggctgtc

SEQ ID NO: 963867 - DNA, 25 bp, Mus musculus
tactgagtcttaagtatgttcaaag

SEQ ID NO: 963868 - DNA, 25 bp, Mus musculus
tactgagtcttatgtatgttcaaag

SEQ ID NO: 963869 - DNA, 25 bp, Mus musculus
tactgatagttgccttatcttccgt

SEQ ID NO: 963870 - DNA, 25 bp, Mus musculus
tactgatagttgcggatgacggagg

SEQ ID NO: 963871 - DNA, 25 bp, Mus musculus
tactgatagttggcttatcttccgt

SEQ ID NO: 963872 - DNA, 25 bp, Mus musculus
tactgatagttggggatgacggagg

SEQ ID NO: 963873 - DNA, 25 bp, Mus musculus
tactgatgtcgcagcgacactgggt

SEQ ID NO: 963874 - DNA, 25 bp, Mus musculus
tactgatgtcgcagggacactgggt

SEQ ID NO: 963875 - DNA, 25 bp, Mus musculus
tactgattttagctctgatctcact

SEQ ID NO: 963876 - DNA, 25 bp, Mus musculus
tactgattttaggtctgatctcact

SEQ ID NO: 963877 - DNA, 25 bp, Mus musculus
tactgcaaagattgctatgccaaaa

SEQ ID NO: 963878 - DNA, 25 bp, Mus musculus
tactgcaaagtttgctatgccaaaa

SEQ ID NO: 963879 - DNA, 25 bp, Mus musculus
tactgcacacagcagagcctgtctc

SEQ ID NO: 963880 - DNA, 25 bp, Mus musculus
tactgcacacaggagagcctgtctc

SEQ ID NO: 963881 - DNA, 25 bp, Mus musculus
tactgcagagatttattctccgaat

SEQ ID NO: 963882 - DNA, 25 bp, Mus musculus
tactgcagagattttttctccgaat

SEQ ID NO: 963883 - DNA, 25 bp, Mus musculus
tactgcagagcctgaagagatccgc

SEQ ID NO: 963884 - DNA, 25 bp, Mus musculus
tactgcagaggctgaagagatccgc

SEQ ID NO: 963885 - DNA, 25 bp, Mus musculus
tactgcagtgcatgagtcgggtaat

SEQ ID NO: 963886 - DNA, 25 bp, Mus musculus
tactgcagtggatgagtcgggtaat

SEQ ID NO: 963887 - DNA, 25 bp, Mus musculus
tactgcatagaggaagaaaaggata

SEQ ID NO: 963888 - DNA, 25 bp, Mus musculus
tactgcatagtggaagaaaaggata

SEQ ID NO: 963889 - DNA, 25 bp, Mus musculus
tactgccatgacattctacggagaa

SEQ ID NO: 963890 - DNA, 25 bp, Mus musculus
tactgccatgactttctacggagaa

SEQ ID NO: 963891 - DNA, 25 bp, Mus musculus
tactgcccaggacgcacagtccctc

SEQ ID NO: 963892 - DNA, 25 bp, Mus musculus
tactgcccaggaggcacagtccctc

SEQ ID NO: 963893 - DNA, 25 bp, Mus musculus
tactgcccggaacccagacatggag

SEQ ID NO: 963894 - DNA, 25 bp, Mus musculus
tactgcccggtacccagacatggag

SEQ ID NO: 963895 - DNA, 25 bp, Mus musculus
tactgctcctcacacaggaaggaaa

SEQ ID NO: 963896 - DNA, 25 bp, Mus musculus
tactgctcctcacagaggaaggaaa

SEQ ID NO: 963897 - DNA, 25 bp, Mus musculus
tactgctgtgcatttccagccactt

SEQ ID NO: 963898 - DNA, 25 bp, Mus musculus
tactgctgtggatttccagccactt

SEQ ID NO: 963899 - DNA, 25 bp, Mus musculus
tactgcttctcccacgtgccgtgga

SEQ ID NO: 963900 - DNA, 25 bp, Mus musculus
tactgcttctcccaggtgccgtgga

SEQ ID NO: 963901 - DNA, 25 bp, Mus musculus
tactgcttgtagcagacttatgacg

SEQ ID NO: 963902 - DNA, 25 bp, Mus musculus
tactgcttgtaggagacttatgacg

SEQ ID NO: 963903 - DNA, 25 bp, Mus musculus
tactggcaagagagtgctaacagcc

SEQ ID NO: 963904 - DNA, 25 bp, Mus musculus
tactggcaagagtgtgctaacagcc

SEQ ID NO: 963905 - DNA, 25 bp, Mus musculus
tactggcaagctggtctacttcacc

SEQ ID NO: 963906 - DNA, 25 bp, Mus musculus
tactggcaagctggtctatttcacc

SEQ ID NO: 963907 - DNA, 25 bp, Mus musculus
tactggcaaggtggtctacttcacc

SEQ ID NO: 963908 - DNA, 25 bp, Mus musculus
tactggcaaggtggtctatttcacc

SEQ ID NO: 963909 - DNA, 25 bp, Mus musculus
tactggcacgatcctcaccacgatg

SEQ ID NO: 963910 - DNA, 25 bp, Mus musculus
tactggcacgttcctcaccacgatg

SEQ ID NO: 963911 - DNA, 25 bp, Mus musculus
tactggccacagcaccagctgccaa

SEQ ID NO: 963912 - DNA, 25 bp, Mus musculus
tactggccacaggaccagctgccaa

SEQ ID NO: 963913 - DNA, 25 bp, Mus musculus
tactggctgtctcaccaagtaactt

SEQ ID NO: 963914 - DNA, 25 bp, Mus musculus
tactggctgtctcgtttaacttgca

SEQ ID NO: 963915 - DNA, 25 bp, Mus musculus
tactggctgtctgaccaagtaactt

SEQ ID NO: 963916 - DNA, 25 bp, Mus musculus
tactggctgtctggtttaacttgca

SEQ ID NO: 963917 - DNA, 25 bp, Mus musculus
tactggcttcctcacgaacctcagc

SEQ ID NO: 963918 - DNA, 25 bp, Mus musculus
tactggcttcctcaggaacctcagc

SEQ ID NO: 963919 - DNA, 25 bp, Mus musculus
tactgggaagatctcaggaaacaag

SEQ ID NO: 963920 - DNA, 25 bp, Mus musculus
tactgggaagttctcaggaaacaag

SEQ ID NO: 963921 - DNA, 25 bp, Mus musculus
tactgggcagctgtctgtgctggtg

SEQ ID NO: 963922 - DNA, 25 bp, Mus musculus
tactgggcaggtgtctgtgctggtg

SEQ ID NO: 963923 - DNA, 25 bp, Mus musculus
tactgggttcctctcggcttcgtgc

SEQ ID NO: 963924 - DNA, 25 bp, Mus musculus
tactgggttcctctgggcttcgtgc

SEQ ID NO: 963925 - DNA, 25 bp, Mus musculus
tactgtacagctggtacctgttgca

SEQ ID NO: 963926 - DNA, 25 bp, Mus musculus
tactgtacaggtggtacctgttgca

SEQ ID NO: 963927 - DNA, 25 bp, Mus musculus
tactgtatgccccgagcacagatat

SEQ ID NO: 963928 - DNA, 25 bp, Mus musculus
tactgtatgcccggagcacagatat

SEQ ID NO: 963929 - DNA, 25 bp, Mus musculus
tactgtcatcctagtctcattggga

SEQ ID NO: 963930 - DNA, 25 bp, Mus musculus
tactgtcatccttgtctcattggga

SEQ ID NO: 963931 - DNA, 25 bp, Mus musculus
tactgtccaggacacacaatgtaag

SEQ ID NO: 963932 - DNA, 25 bp, Mus musculus
tactgtccaggagacacaatgtaag

SEQ ID NO: 963933 - DNA, 25 bp, Mus musculus
tactgtcccgctgtgccagccttcc

SEQ ID NO: 963934 - DNA, 25 bp, Mus musculus
tactgtcccggtgtgccagccttcc

SEQ ID NO: 963935 - DNA, 25 bp, Mus musculus
tactgtgaagacattgacgagtgtg

SEQ ID NO: 963936 - DNA, 25 bp, Mus musculus
tactgtgaagctgtggtccggtgtt

SEQ ID NO: 963937 - DNA, 25 bp, Mus musculus
tactgtgaaggtgtggtccggtgtt

SEQ ID NO: 963938 - DNA, 25 bp, Mus musculus
tactgtgaagtcattgacgagtgtg

SEQ ID NO: 963939 - DNA, 25 bp, Mus musculus
tactgtgagaggcacggcttgtcaa

SEQ ID NO: 963940 - DNA, 25 bp, Mus musculus
tactgtgagaggcagggcttgtcaa

SEQ ID NO: 963941 - DNA, 25 bp, Mus musculus
tactgtgagctgccccagtcctcct

SEQ ID NO: 963942 - DNA, 25 bp, Mus musculus
tactgtgagctgcttcacccaccca

SEQ ID NO: 963943 - DNA, 25 bp, Mus musculus
tactgtgagctggcccagtcctcct

SEQ ID NO: 963944 - DNA, 25 bp, Mus musculus
tactgtgagctggttcacccaccca

SEQ ID NO: 963945 - DNA, 25 bp, Mus musculus
tactgtgcagtgagtgcaagatgac

SEQ ID NO: 963946 - DNA, 25 bp, Mus musculus
tactgtgcagtgtgtgcaagatgac

SEQ ID NO: 963947 - DNA, 25 bp, Mus musculus
tactgtggcactaacgctggtgttc

SEQ ID NO: 963948 - DNA, 25 bp, Mus musculus
tactgtggcactaaggctggtgttc

SEQ ID NO: 963949 - DNA, 25 bp, Mus musculus
tactgtggccagcatcgacgtgtct

SEQ ID NO: 963950 - DNA, 25 bp, Mus musculus
tactgtggccaggatcgacgtgtct

SEQ ID NO: 963951 - DNA, 25 bp, Mus musculus
tactgtggccgtactgccccttcct

SEQ ID NO: 963952 - DNA, 25 bp, Mus musculus
tactgtggccgttctgccccttcct

SEQ ID NO: 963953 - DNA, 25 bp, Mus musculus
tactgtgttgatgtgaacgagtgcg

SEQ ID NO: 963954 - DNA, 25 bp, Mus musculus
tactgtgttgttgtgaacgagtgcg

SEQ ID NO: 963955 - DNA, 25 bp, Mus musculus
tactgttcaaaaacgaacaccaaac

SEQ ID NO: 963956 - DNA, 25 bp, Mus musculus
tactgttcaaaatcgaacaccaaac

SEQ ID NO: 963957 - DNA, 25 bp, Mus musculus
tactgttcttgaaatacatgataat

SEQ ID NO: 963958 - DNA, 25 bp, Mus musculus
tactgttcttgaaccataacaaact

SEQ ID NO: 963959 - DNA, 25 bp, Mus musculus
tactgttcttgatatacatgataat

SEQ ID NO: 963960 - DNA, 25 bp, Mus musculus
tactgttcttgatccataacaaact

SEQ ID NO: 963961 - DNA, 25 bp, Mus musculus
tactgtttcagaaacgaaaaccaca

SEQ ID NO: 963962 - DNA, 25 bp, Mus musculus
tactgtttcagaaaggaaaaccaca

SEQ ID NO: 963963 - DNA, 25 bp, Mus musculus
tactgtttgcagtcactcaagcttt

SEQ ID NO: 963964 - DNA, 25 bp, Mus musculus
tactgtttgcagtctctcaagcttt

SEQ ID NO: 963965 - DNA, 25 bp, Mus musculus
tactgtttgtgacctgtgttttgtg

SEQ ID NO: 963966 - DNA, 25 bp, Mus musculus
tactgtttgtgagctgtgttttgtg

SEQ ID NO: 963967 - DNA, 25 bp, Mus musculus
tacttacagtcgtgactccggggga

SEQ ID NO: 963968 - DNA, 25 bp, Mus musculus
tacttacagtggtgactccggggga

SEQ ID NO: 963969 - DNA, 25 bp, Mus musculus
tacttactcaaccacggtgaacact

SEQ ID NO: 963970 - DNA, 25 bp, Mus musculus
tacttactcaaccagggtgaacact

SEQ ID NO: 963971 - DNA, 25 bp, Mus musculus
tacttagaccagcacctgtatgcga

SEQ ID NO: 963972 - DNA, 25 bp, Mus musculus
tacttagaccaggacctgtatgcga

SEQ ID NO: 963973 - DNA, 25 bp, Mus musculus
tacttagacctgcagtggaccgact

SEQ ID NO: 963974 - DNA, 25 bp, Mus musculus
tacttagacctggagtggaccgact

SEQ ID NO: 963975 - DNA, 25 bp, Mus musculus
tacttatcaactgtatgtggaaacc

SEQ ID NO: 963976 - DNA, 25 bp, Mus musculus
tacttatcaagtgtatgtggaaacc

SEQ ID NO: 963977 - DNA, 25 bp, Mus musculus
tacttattaattcacgtgatgctag

SEQ ID NO: 963978 - DNA, 25 bp, Mus musculus
tacttattaattcaggtgatgctag

SEQ ID NO: 963979 - DNA, 25 bp, Mus musculus
tacttcaaaaacaacgaggagccga

SEQ ID NO: 963980 - DNA, 25 bp, Mus musculus
tacttcaaaaacaaggaggagccga

SEQ ID NO: 963981 - DNA, 25 bp, Mus musculus
tacttcactgaattttcacctcatt

SEQ ID NO: 963982 - DNA, 25 bp, Mus musculus
tacttcactgtattttcacctcatt

SEQ ID NO: 963983 - DNA, 25 bp, Mus musculus
tacttcagaaacagacctcgatgca

SEQ ID NO: 963984 - DNA, 25 bp, Mus musculus
tacttcagaaacatctcctttcagc

SEQ ID NO: 963985 - DNA, 25 bp, Mus musculus
tacttcagaaactgacctcgatgca

SEQ ID NO: 963986 - DNA, 25 bp, Mus musculus
tacttcagaaacttctcctttcagc

SEQ ID NO: 963987 - DNA, 25 bp, Mus musculus
tacttcagccgagtcagtgaattag

SEQ ID NO: 963988 - DNA, 25 bp, Mus musculus
tacttcagccgagtgagtgaattag

SEQ ID NO: 963989 - DNA, 25 bp, Mus musculus
tacttcatccccaacgggacaaatg

SEQ ID NO: 963990 - DNA, 25 bp, Mus musculus
tacttcatccccaaggggacaaatg

SEQ ID NO: 963991 - DNA, 25 bp, Mus musculus
tacttccaaaaggacactttctgca

SEQ ID NO: 963992 - DNA, 25 bp, Mus musculus
tacttccaaaaggagactttctgca

SEQ ID NO: 963993 - DNA, 25 bp, Mus musculus
tacttccctgctaaccaggagatcc

SEQ ID NO: 963994 - DNA, 25 bp, Mus musculus
tacttccctggtaaccaggagatcc

SEQ ID NO: 963995 - DNA, 25 bp, Mus musculus
tacttcccttcctccctctcgccgg

SEQ ID NO: 963996 - DNA, 25 bp, Mus musculus
tacttcccttcctcgctctcgccgg

SEQ ID NO: 963997 - DNA, 25 bp, Mus musculus
tacttcctcgagccctacaattcaa

SEQ ID NO: 963998 - DNA, 25 bp, Mus musculus
tacttcctcgaggcctacaattcaa

SEQ ID NO: 963999 - DNA, 25 bp, Mus musculus
tacttctcctggacgtgcgaccgca

SEQ ID NO: 964000 - DNA, 25 bp, Mus musculus
tacttctcctggcaacgatatccct

SEQ ID NO: 964001 - DNA, 25 bp, Mus musculus
tacttctcctgggaacgatatccct

SEQ ID NO: 964002 - DNA, 25 bp, Mus musculus
tacttctcctggtcgtgcgaccgca

SEQ ID NO: 964003 - DNA, 25 bp, Mus musculus
tacttctggcaacgccagatcctgt

SEQ ID NO: 964004 - DNA, 25 bp, Mus musculus
tacttctggcaaggccagatcctgt

SEQ ID NO: 964005 - DNA, 25 bp, Mus musculus
tacttctgggccatcggccgggagg

SEQ ID NO: 964006 - DNA, 25 bp, Mus musculus
tacttctgggccatgggccgggagg

SEQ ID NO: 964007 - DNA, 25 bp, Mus musculus
tacttcttcaagcggaagcagtact

SEQ ID NO: 964008 - DNA, 25 bp, Mus musculus
tacttcttcaaggggaagcagtact

SEQ ID NO: 964009 - DNA, 25 bp, Mus musculus
tacttcttcctgatcggaccgccgc

SEQ ID NO: 964010 - DNA, 25 bp, Mus musculus
tacttcttcctgttcggaccgccgc

SEQ ID NO: 964011 - DNA, 25 bp, Mus musculus
tacttctttcctggagtaggtgaca

SEQ ID NO: 964012 - DNA, 25 bp, Mus musculus
tacttctttcctggtgtaggtgaca

SEQ ID NO: 964013 - DNA, 25 bp, Mus musculus
tacttgaatacaccactcctgaaat

SEQ ID NO: 964014 - DNA, 25 bp, Mus musculus
tacttgaatacagcactcctgaaat

SEQ ID NO: 964015 - DNA, 25 bp, Mus musculus
tacttgacttacaacgagtgggaga

SEQ ID NO: 964016 - DNA, 25 bp, Mus musculus
tacttgacttacaaggagtgggaga

SEQ ID NO: 964017 - DNA, 25 bp, Mus musculus
tacttgcaagcgtgactcaggaggc

SEQ ID NO: 964018 - DNA, 25 bp, Mus musculus
tacttgcaagggtgactcaggaggc

SEQ ID NO: 964019 - DNA, 25 bp, Mus musculus
tacttgctcaaccacatccttgcat

SEQ ID NO: 964020 - DNA, 25 bp, Mus musculus
tacttgctcaaccacggcatcgttc

SEQ ID NO: 964021 - DNA, 25 bp, Mus musculus
tacttgctcaaccagatccttgcat

SEQ ID NO: 964022 - DNA, 25 bp, Mus musculus
tacttgctcaaccagggcatcgttc

SEQ ID NO: 964023 - DNA, 25 bp, Mus musculus
tacttgctcacgcgaattccaggaa

SEQ ID NO: 964024 - DNA, 25 bp, Mus musculus
tacttgctcacgggaattccaggaa

SEQ ID NO: 964025 - DNA, 25 bp, Mus musculus
tacttggtggccaccatgctgtata

SEQ ID NO: 964026 - DNA, 25 bp, Mus musculus
tacttggtggccacgatgctgtata

SEQ ID NO: 964027 - DNA, 25 bp, Mus musculus
tacttggttcggaacatgggctgtg

SEQ ID NO: 964028 - DNA, 25 bp, Mus musculus
tacttggttcggtacatgggctgtg

SEQ ID NO: 964029 - DNA, 25 bp, Mus musculus
tacttgttcaagcgtagtcagtact

SEQ ID NO: 964030 - DNA, 25 bp, Mus musculus
tacttgttcaagggtagtcagtact

SEQ ID NO: 964031 - DNA, 25 bp, Mus musculus
tactttaagtcccacgcagagtggc

SEQ ID NO: 964032 - DNA, 25 bp, Mus musculus
tactttaagtcccaggcagagtggc

SEQ ID NO: 964033 - DNA, 25 bp, Mus musculus
tactttatagcactcattctgatca

SEQ ID NO: 964034 - DNA, 25 bp, Mus musculus
tactttataggactcattctgatca

SEQ ID NO: 964035 - DNA, 25 bp, Mus musculus
tactttatatatgacggttaccaag

SEQ ID NO: 964036 - DNA, 25 bp, Mus musculus
tactttatatatgagggttaccaag

SEQ ID NO: 964037 - DNA, 25 bp, Mus musculus
tactttatccagtcccccctcccag

SEQ ID NO: 964038 - DNA, 25 bp, Mus musculus
tactttatccagtccccttctcctt

SEQ ID NO: 964039 - DNA, 25 bp, Mus musculus
tactttatccagtcgcccctcccag

SEQ ID NO: 964040 - DNA, 25 bp, Mus musculus
tactttatccagtcgccttctcctt

SEQ ID NO: 964041 - DNA, 25 bp, Mus musculus
tactttcaagctgccatactcggaa

SEQ ID NO: 964042 - DNA, 25 bp, Mus musculus
tactttcaaggtgccatactcggaa

SEQ ID NO: 964043 - DNA, 25 bp, Mus musculus
tactttcccatccacctggtgaaga

SEQ ID NO: 964044 - DNA, 25 bp, Mus musculus
tactttcccatccagctggtgaaga

SEQ ID NO: 964045 - DNA, 25 bp, Mus musculus
tactttctgctccaccaaggtgcag

SEQ ID NO: 964046 - DNA, 25 bp, Mus musculus
tactttctgctccagcaaggtgcag

SEQ ID NO: 964047 - DNA, 25 bp, Mus musculus
tactttggcttgcccactgtgtgca

SEQ ID NO: 964048 - DNA, 25 bp, Mus musculus
tactttggcttgcgctttattgcag

SEQ ID NO: 964049 - DNA, 25 bp, Mus musculus
tactttggcttgcggtttattgcag

SEQ ID NO: 964050 - DNA, 25 bp, Mus musculus
tactttggcttggccactgtgtgca

SEQ ID NO: 964051 - DNA, 25 bp, Mus musculus
tactttgtgaaaatcctgagtcgct

SEQ ID NO: 964052 - DNA, 25 bp, Mus musculus
tactttgtgaaattcctgagtcgct

SEQ ID NO: 964053 - DNA, 25 bp, Mus musculus
tactttgtgcagaggctcgtgggtt

SEQ ID NO: 964054 - DNA, 25 bp, Mus musculus
tactttgtgcagctcccagccagct

SEQ ID NO: 964055 - DNA, 25 bp, Mus musculus
tactttgtgcaggtcccagccagct

SEQ ID NO: 964056 - DNA, 25 bp, Mus musculus
tactttgtgcagtggctcgtgggtt

SEQ ID NO: 964057 - DNA, 25 bp, Mus musculus
tacttttatgagcacgctataacta

SEQ ID NO: 964058 - DNA, 25 bp, Mus musculus
tacttttatgagcaggctataacta

SEQ ID NO: 964059 - DNA, 25 bp, Mus musculus
tactttttattcagcccacgcaacg

SEQ ID NO: 964060 - DNA, 25 bp, Mus musculus
tactttttattcagcgatgtgaaat

SEQ ID NO: 964061 - DNA, 25 bp, Mus musculus
tactttttattcaggccacgcaacg

SEQ ID NO: 964062 - DNA, 25 bp, Mus musculus
tactttttattcagggatgtgaaat

SEQ ID NO: 964063 - DNA, 25 bp, Mus musculus
tagaaaaaacagacagtgatgtgac

SEQ ID NO: 964064 - DNA, 25 bp, Mus musculus
tagaaaaaacagtcagtgatgtgac

SEQ ID NO: 964065 - DNA, 25 bp, Mus musculus
tagaaaaaagatgacctcaatgcca

SEQ ID NO: 964066 - DNA, 25 bp, Mus musculus
tagaaaaaagttgacctcaatgcca

SEQ ID NO: 964067 - DNA, 25 bp, Mus musculus
tagaaaaagacgaacctttagaaga

SEQ ID NO: 964068 - DNA, 25 bp, Mus musculus
tagaaaaagacgaagctttagaaga

SEQ ID NO: 964069 - DNA, 25 bp, Mus musculus
tagaaaaatgataaactttgcaagg

SEQ ID NO: 964070 - DNA, 25 bp, Mus musculus
tagaaaaatgttaaactttgcaagg

SEQ ID NO: 964071 - DNA, 25 bp, Mus musculus
tagaaaagcacacacgagctaaact

SEQ ID NO: 964072 - DNA, 25 bp, Mus musculus
tagaaaagcacagacgagctaaact

SEQ ID NO: 964073 - DNA, 25 bp, Mus musculus
tagaaacaaatgcgatggaagactg

SEQ ID NO: 964074 - DNA, 25 bp, Mus musculus
tagaaacaaatgctgaagaagatgg

SEQ ID NO: 964075 - DNA, 25 bp, Mus musculus
tagaaacaaatgggatggaagactg

SEQ ID NO: 964076 - DNA, 25 bp, Mus musculus
tagaaacaaatggtgaagaagatgg

SEQ ID NO: 964077 - DNA, 25 bp, Mus musculus
tagaaacccacaactggagcaagcc

SEQ ID NO: 964078 - DNA, 25 bp, Mus musculus
tagaaacccagaactggagcaagcc

SEQ ID NO: 964079 - DNA, 25 bp, Mus musculus
tagaaagaacagagcatccagtggt

SEQ ID NO: 964080 - DNA, 25 bp, Mus musculus
tagaaagaacagtgcatccagtggt

SEQ ID NO: 964081 - DNA, 25 bp, Mus musculus
tagaaagaagcatgtctgctgtgac

SEQ ID NO: 964082 - DNA, 25 bp, Mus musculus
tagaaagaaggatgtctgctgtgac

SEQ ID NO: 964083 - DNA, 25 bp, Mus musculus
tagaaaggctctggaactgatcgtt

SEQ ID NO: 964084 - DNA, 25 bp, Mus musculus
tagaaaggctgtggaactgatcgtt

SEQ ID NO: 964085 - DNA, 25 bp, Mus musculus
tagaaataaccgatgacgaacagtt

SEQ ID NO: 964086 - DNA, 25 bp, Mus musculus
tagaaataaccgttgacgaacagtt

SEQ ID NO: 964087 - DNA, 25 bp, Mus musculus
tagaaatctatgaatggtaccacaa

SEQ ID NO: 964088 - DNA, 25 bp, Mus musculus
tagaaatctatgtatggtaccacaa

SEQ ID NO: 964089 - DNA, 25 bp, Mus musculus
tagaaatgaaaactcagggagatga

SEQ ID NO: 964090 - DNA, 25 bp, Mus musculus
tagaaatgaaaactgagggagatga

SEQ ID NO: 964091 - DNA, 25 bp, Mus musculus
tagaaattaccctaagttatacatt

SEQ ID NO: 964092 - DNA, 25 bp, Mus musculus
tagaaattaccctatgttatacatt

SEQ ID NO: 964093 - DNA, 25 bp, Mus musculus
tagaaccagaagagccaccaaccaa

SEQ ID NO: 964094 - DNA, 25 bp, Mus musculus
tagaaccagaagatgccatctcatc

SEQ ID NO: 964095 - DNA, 25 bp, Mus musculus
tagaaccagaagcagcaccgtactg

SEQ ID NO: 964096 - DNA, 25 bp, Mus musculus
tagaaccagaaggagcaccgtactg

SEQ ID NO: 964097 - DNA, 25 bp, Mus musculus
tagaaccagaagtgccaccaaccaa

SEQ ID NO: 964098 - DNA, 25 bp, Mus musculus
tagaaccagaagttgccatctcatc

SEQ ID NO: 964099 - DNA, 25 bp, Mus musculus
tagaaccataaacgtgtggaacaca

SEQ ID NO: 964100 - DNA, 25 bp, Mus musculus
tagaaccataaaggtgtggaacaca

SEQ ID NO: 964101 - DNA, 25 bp, Mus musculus
tagaactgatcacgacagcagaaca

SEQ ID NO: 964102 - DNA, 25 bp, Mus musculus
tagaactgatcaggacagcagaaca

SEQ ID NO: 964103 - DNA, 25 bp, Mus musculus
tagaactgtggactatcacggtgat

SEQ ID NO: 964104 - DNA, 25 bp, Mus musculus
tagaactgtggagtatcacggtgat

SEQ ID NO: 964105 - DNA, 25 bp, Mus musculus
tagaagaaacggaacgcatgaaaga

SEQ ID NO: 964106 - DNA, 25 bp, Mus musculus
tagaagaaacggaaggcatgaaaga

SEQ ID NO: 964107 - DNA, 25 bp, Mus musculus
tagaagacacagcttgctgggacac

SEQ ID NO: 964108 - DNA, 25 bp, Mus musculus
tagaagacacaggttgctgggacac

SEQ ID NO: 964109 - DNA, 25 bp, Mus musculus
tagaagacctacaacgtcggacatc

SEQ ID NO: 964110 - DNA, 25 bp, Mus musculus
tagaagacctacaaggtcggacatc

SEQ ID NO: 964111 - DNA, 25 bp, Mus musculus
tagaagatgatgcactctttccaga

SEQ ID NO: 964112 - DNA, 25 bp, Mus musculus
tagaagatgatgcagtctttccaga

SEQ ID NO: 964113 - DNA, 25 bp, Mus musculus
tagaagcaacaacgtgctccgccag

SEQ ID NO: 964114 - DNA, 25 bp, Mus musculus
tagaagcaacaaggtgctccgccag

SEQ ID NO: 964115 - DNA, 25 bp, Mus musculus
tagaagccatccgttctcgtgctgc

SEQ ID NO: 964116 - DNA, 25 bp, Mus musculus
tagaagccatgcgttctcgtgctgc

SEQ ID NO: 964117 - DNA, 25 bp, Mus musculus
tagaagtgcagtataaaccgcaagt

SEQ ID NO: 964118 - DNA, 25 bp, Mus musculus
tagaagtgcagtttaaaccgcaagt

SEQ ID NO: 964119 - DNA, 25 bp, Mus musculus
tagaagtgctcacgacaacatcaaa

SEQ ID NO: 964120 - DNA, 25 bp, Mus musculus
tagaagtgctcaggacaacatcaaa

SEQ ID NO: 964121 - DNA, 25 bp, Mus musculus
tagaagtggtagaaatggacctacc

SEQ ID NO: 964122 - DNA, 25 bp, Mus musculus
tagaagtggtagtaatggacctacc

SEQ ID NO: 964123 - DNA, 25 bp, Mus musculus
tagaagtttatgatttgattcgaac

SEQ ID NO: 964124 - DNA, 25 bp, Mus musculus
tagaagtttatgttttgattcgaac

SEQ ID NO: 964125 - DNA, 25 bp, Mus musculus
tagaatatatcacaccacgacggag

SEQ ID NO: 964126 - DNA, 25 bp, Mus musculus
tagaatatatcagaccacgacggag

SEQ ID NO: 964127 - DNA, 25 bp, Mus musculus
tagaatatttattcatagaaaacaa

SEQ ID NO: 964128 - DNA, 25 bp, Mus musculus
tagaatattttttcatagaaaacaa

SEQ ID NO: 964129 - DNA, 25 bp, Mus musculus
tagaatcagcaacactacagatgct

SEQ ID NO: 964130 - DNA, 25 bp, Mus musculus
tagaatcagcaagactacagatgct

SEQ ID NO: 964131 - DNA, 25 bp, Mus musculus
tagaattacgctcacccacaacagt

SEQ ID NO: 964132 - DNA, 25 bp, Mus musculus
tagaattacgctgacccacaacagt

SEQ ID NO: 964133 - DNA, 25 bp, Mus musculus
tagaattcttagccaccagagcccc

SEQ ID NO: 964134 - DNA, 25 bp, Mus musculus
tagaattcttaggcaccagagcccc

SEQ ID NO: 964135 - DNA, 25 bp, Mus musculus
tagaattgattgagcactctcaaag

SEQ ID NO: 964136 - DNA, 25 bp, Mus musculus
tagaattgattgaggactctcaaag

SEQ ID NO: 964137 - DNA, 25 bp, Mus musculus
tagacaaccaaacgtctgcgcagtt

SEQ ID NO: 964138 - DNA, 25 bp, Mus musculus
tagacaaccaaaggtctgcgcagtt

SEQ ID NO: 964139 - DNA, 25 bp, Mus musculus
tagacacagagactggtgctgcagc

SEQ ID NO: 964140 - DNA, 25 bp, Mus musculus
tagacacagagagtggtgctgcagc

SEQ ID NO: 964141 - DNA, 25 bp, Mus musculus
tagacacttgtgcaaggaatctgct

SEQ ID NO: 964142 - DNA, 25 bp, Mus musculus
tagacacttgtggaaggaatctgct

SEQ ID NO: 964143 - DNA, 25 bp, Mus musculus
tagacaggctaaccaactcaccagg

SEQ ID NO: 964144 - DNA, 25 bp, Mus musculus
tagacaggctaagcaactcaccagg

SEQ ID NO: 964145 - DNA, 25 bp, Mus musculus
tagacatacagtatgctcctgaagt

SEQ ID NO: 964146 - DNA, 25 bp, Mus musculus
tagacatacagtttgctcctgaagt

SEQ ID NO: 964147 - DNA, 25 bp, Mus musculus
tagacatgagggcatgaaggtcttt

SEQ ID NO: 964148 - DNA, 25 bp, Mus musculus
tagacatgaggggatgaaggtcttt

SEQ ID NO: 964149 - DNA, 25 bp, Mus musculus
tagacattggatgccgccttggacc

SEQ ID NO: 964150 - DNA, 25 bp, Mus musculus
tagacattggctgcggttctgggct

SEQ ID NO: 964151 - DNA, 25 bp, Mus musculus
tagacattgggtgcggttctgggct

SEQ ID NO: 964152 - DNA, 25 bp, Mus musculus
tagacattggttgccgccttggacc

SEQ ID NO: 964153 - DNA, 25 bp, Mus musculus
tagaccagaactttgtctatgtagc

SEQ ID NO: 964154 - DNA, 25 bp, Mus musculus
tagaccagaagtttgtctatgtagc

SEQ ID NO: 964155 - DNA, 25 bp, Mus musculus
tagaccagcgctcctccagacaacc

SEQ ID NO: 964156 - DNA, 25 bp, Mus musculus
tagaccagcggtcctccagacaacc

SEQ ID NO: 964157 - DNA, 25 bp, Mus musculus
tagacccggcaacaaagtccatggc

SEQ ID NO: 964158 - DNA, 25 bp, Mus musculus
tagacccggcaacaccttcaagagt

SEQ ID NO: 964159 - DNA, 25 bp, Mus musculus
tagacccggcaaccagaccttcaag

SEQ ID NO: 964160 - DNA, 25 bp, Mus musculus
tagacccggcaagaaagtccatggc

SEQ ID NO: 964161 - DNA, 25 bp, Mus musculus
tagacccggcaagaccttcaagagt

SEQ ID NO: 964162 - DNA, 25 bp, Mus musculus
tagacccggcaagcagaccttcaag

SEQ ID NO: 964163 - DNA, 25 bp, Mus musculus
tagacctcatgccacctatgaacct

SEQ ID NO: 964164 - DNA, 25 bp, Mus musculus
tagacctcatgccagctatgaacct

SEQ ID NO: 964165 - DNA, 25 bp, Mus musculus
tagacctgaacacacgggagccgat

SEQ ID NO: 964166 - DNA, 25 bp, Mus musculus
tagacctgaacacaggggagccgat

SEQ ID NO: 964167 - DNA, 25 bp, Mus musculus
tagactacaagacggttatgatcat

SEQ ID NO: 964168 - DNA, 25 bp, Mus musculus
tagactacaagagggttatgatcat

SEQ ID NO: 964169 - DNA, 25 bp, Mus musculus
tagactatgactccatcggccacaa

SEQ ID NO: 964170 - DNA, 25 bp, Mus musculus
tagactatgactgcatcggccacaa

SEQ ID NO: 964171 - DNA, 25 bp, Mus musculus
tagactcagacgagctgtgattggt

SEQ ID NO: 964172 - DNA, 25 bp, Mus musculus
tagactcagactcataaggtcacct

SEQ ID NO: 964173 - DNA, 25 bp, Mus musculus
tagactcagaggagctgtgattggt

SEQ ID NO: 964174 - DNA, 25 bp, Mus musculus
tagactcagagtcataaggtcacct

SEQ ID NO: 964175 - DNA, 25 bp, Mus musculus
tagactccgtagcggctgaggatgc

SEQ ID NO: 964176 - DNA, 25 bp, Mus musculus
tagactccgtaggggctgaggatgc

SEQ ID NO: 964177 - DNA, 25 bp, Mus musculus
tagactcgtcaaacccaatagaatc

SEQ ID NO: 964178 - DNA, 25 bp, Mus musculus
tagactcgtcaatcccaatagaatc

SEQ ID NO: 964179 - DNA, 25 bp, Mus musculus
tagactgaaaataacgagactggat

SEQ ID NO: 964180 - DNA, 25 bp, Mus musculus
tagactgaaaataaggagactggat

SEQ ID NO: 964181 - DNA, 25 bp, Mus musculus
tagacttgaacaccattgaggatcc

SEQ ID NO: 964182 - DNA, 25 bp, Mus musculus
tagacttgaacagcattgaggatcc

SEQ ID NO: 964183 - DNA, 25 bp, Mus musculus
tagacttggatccttgggatgctgt

SEQ ID NO: 964184 - DNA, 25 bp, Mus musculus
tagacttggatcgttgggatgctgt

SEQ ID NO: 964185 - DNA, 25 bp, Mus musculus
tagagaactcaaagaaccaccacga

SEQ ID NO: 964186 - DNA, 25 bp, Mus musculus
tagagaactcaatgaaccaccacga

SEQ ID NO: 964187 - DNA, 25 bp, Mus musculus
tagagaagaccgaatggttccattt

SEQ ID NO: 964188 - DNA, 25 bp, Mus musculus
tagagaagacggaatggttccattt

SEQ ID NO: 964189 - DNA, 25 bp, Mus musculus
tagagaagcccacatcgccggtcct

SEQ ID NO: 964190 - DNA, 25 bp, Mus musculus
tagagaagcccagatcgccggtcct

SEQ ID NO: 964191 - DNA, 25 bp, Mus musculus
tagagaagtatgagtcaactgtcag

SEQ ID NO: 964192 - DNA, 25 bp, Mus musculus
tagagaagtatgtgtcaactgtcag

SEQ ID NO: 964193 - DNA, 25 bp, Mus musculus
tagagacgccagatctacctccagt

SEQ ID NO: 964194 - DNA, 25 bp, Mus musculus
tagagacgccagttctacctccagt

SEQ ID NO: 964195 - DNA, 25 bp, Mus musculus
tagagaggcgagcgttgtgagcccc

SEQ ID NO: 964196 - DNA, 25 bp, Mus musculus
tagagaggcgagggttgtgagcccc

SEQ ID NO: 964197 - DNA, 25 bp, Mus musculus
tagagagttcaacgggctgagattt

SEQ ID NO: 964198 - DNA, 25 bp, Mus musculus
tagagagttcaaggggctgagattt

SEQ ID NO: 964199 - DNA, 25 bp, Mus musculus
tagagatctaaacgcagaaaacctg

SEQ ID NO: 964200 - DNA, 25 bp, Mus musculus
tagagatctaaaggcagaaaacctg

SEQ ID NO: 964201 - DNA, 25 bp, Mus musculus
tagagatgagcctggaggggtagca

SEQ ID NO: 964202 - DNA, 25 bp, Mus musculus
tagagatgaggctggaggggtagca

SEQ ID NO: 964203 - DNA, 25 bp, Mus musculus
tagagcaaagagcataaaggagaag

SEQ ID NO: 964204 - DNA, 25 bp, Mus musculus
tagagcaaagaggataaaggagaag

SEQ ID NO: 964205 - DNA, 25 bp, Mus musculus
tagagccaagcgccgggcgtggatc

SEQ ID NO: 964206 - DNA, 25 bp, Mus musculus
tagagccaagggccgggcgtggatc

SEQ ID NO: 964207 - DNA, 25 bp, Mus musculus
tagagccctgcaggcgcggatccag

SEQ ID NO: 964208 - DNA, 25 bp, Mus musculus
tagagccctggaggcgcggatccag

SEQ ID NO: 964209 - DNA, 25 bp, Mus musculus
tagagcctgctgccaatcatctggg

SEQ ID NO: 964210 - DNA, 25 bp, Mus musculus
tagagcctgctggcaatcatctggg

SEQ ID NO: 964211 - DNA, 25 bp, Mus musculus
tagagcgtgatctccgagtcctccg

SEQ ID NO: 964212 - DNA, 25 bp, Mus musculus
tagagcgtgatctccggcaatggca

SEQ ID NO: 964213 - DNA, 25 bp, Mus musculus
tagagcgtgatctcggagtcctccg

SEQ ID NO: 964214 - DNA, 25 bp, Mus musculus
tagagcgtgatctcgggcaatggca

SEQ ID NO: 964215 - DNA, 25 bp, Mus musculus
tagagctatcttataatctggaggc

SEQ ID NO: 964216 - DNA, 25 bp, Mus musculus
tagagctatcttttaatctggaggc

SEQ ID NO: 964217 - DNA, 25 bp, Mus musculus
tagagctgaacttgatgaagcatct

SEQ ID NO: 964218 - DNA, 25 bp, Mus musculus
tagagctgaacttgttgaagcatct

SEQ ID NO: 964219 - DNA, 25 bp, Mus musculus
tagaggaacagtacatccctaaagg

SEQ ID NO: 964220 - DNA, 25 bp, Mus musculus
tagaggaacagttcatccctaaagg

SEQ ID NO: 964221 - DNA, 25 bp, Mus musculus
tagaggaatgcaggcagcttcagac

SEQ ID NO: 964222 - DNA, 25 bp, Mus musculus
tagaggaatggaggcagcttcagac

SEQ ID NO: 964223 - DNA, 25 bp, Mus musculus
tagaggactgttatgaaagagaaga

SEQ ID NO: 964224 - DNA, 25 bp, Mus musculus
tagaggactgttttgaaagagaaga

SEQ ID NO: 964225 - DNA, 25 bp, Mus musculus
tagaggagagccaagttgaagttca

SEQ ID NO: 964226 - DNA, 25 bp, Mus musculus
tagaggagaggcaagttgaagttca

SEQ ID NO: 964227 - DNA, 25 bp, Mus musculus
tagaggagtggaaacaactgatata

SEQ ID NO: 964228 - DNA, 25 bp, Mus musculus
tagaggagtggaaagaactgatata

SEQ ID NO: 964229 - DNA, 25 bp, Mus musculus
tagaggctagcgcacctggactgga

SEQ ID NO: 964230 - DNA, 25 bp, Mus musculus
tagaggctagggcacctggactgga

SEQ ID NO: 964231 - DNA, 25 bp, Mus musculus
tagagggaagcattcgagcagttag

SEQ ID NO: 964232 - DNA, 25 bp, Mus musculus
tagagggaaggattcgagcagttag

SEQ ID NO: 964233 - DNA, 25 bp, Mus musculus
tagagtaattagccaacaggttcca

SEQ ID NO: 964234 - DNA, 25 bp, Mus musculus
tagagtaattaggcaacaggttcca

SEQ ID NO: 964235 - DNA, 25 bp, Mus musculus
tagagtgctggacaataaactgatg

SEQ ID NO: 964236 - DNA, 25 bp, Mus musculus
tagagtgctggagaataaactgatg

SEQ ID NO: 964237 - DNA, 25 bp, Mus musculus
tagagttacaccaactttctgggct

SEQ ID NO: 964238 - DNA, 25 bp, Mus musculus
tagagttacaccaagtttctgggct

SEQ ID NO: 964239 - DNA, 25 bp, Mus musculus
tagagttgttaggagaacactgaag

SEQ ID NO: 964240 - DNA, 25 bp, Mus musculus
tagagttgtttggagaacactgaag

SEQ ID NO: 964241 - DNA, 25 bp, Mus musculus
tagataaagaagatttaatcacttg

SEQ ID NO: 964242 - DNA, 25 bp, Mus musculus
tagataaagaagttttaatcacttg

SEQ ID NO: 964243 - DNA, 25 bp, Mus musculus
tagataacagagctgcacgaaacca

SEQ ID NO: 964244 - DNA, 25 bp, Mus musculus
tagataacagaggtgcacgaaacca

SEQ ID NO: 964245 - DNA, 25 bp, Mus musculus
tagataataaaacagagtctgttgg

SEQ ID NO: 964246 - DNA, 25 bp, Mus musculus
tagataataaaagagagtctgttgg

SEQ ID NO: 964247 - DNA, 25 bp, Mus musculus
tagatagaaaaatacatatcgattt

SEQ ID NO: 964248 - DNA, 25 bp, Mus musculus
tagatagaaaaatagatatcgattt

SEQ ID NO: 964249 - DNA, 25 bp, Mus musculus
tagatcaacgggacaaatgggcctg

SEQ ID NO: 964250 - DNA, 25 bp, Mus musculus
tagatcaacgggactaatgggcctg

SEQ ID NO: 964251 - DNA, 25 bp, Mus musculus
tagatcaatgttaacggatcgctta

SEQ ID NO: 964252 - DNA, 25 bp, Mus musculus
tagatcaatgttaagggatcgctta

SEQ ID NO: 964253 - DNA, 25 bp, Mus musculus
tagatcacttaacacgtgtgggcaa

SEQ ID NO: 964254 - DNA, 25 bp, Mus musculus
tagatcacttaacaggtgtgggcaa

SEQ ID NO: 964255 - DNA, 25 bp, Mus musculus
tagatcccgatcaacatcatactct

SEQ ID NO: 964256 - DNA, 25 bp, Mus musculus
tagatcccgatcaagatcatactct

SEQ ID NO: 964257 - DNA, 25 bp, Mus musculus
tagatctcagagcatctaactcaga

SEQ ID NO: 964258 - DNA, 25 bp, Mus musculus
tagatctcagtgcatctaactcaga

SEQ ID NO: 964259 - DNA, 25 bp, Mus musculus
tagatctcttcacgttcctagatag

SEQ ID NO: 964260 - DNA, 25 bp, Mus musculus
tagatctcttcaggttcctagatag

SEQ ID NO: 964261 - DNA, 25 bp, Mus musculus
tagatctgacacaacccaaggttga

SEQ ID NO: 964262 - DNA, 25 bp, Mus musculus
tagatctgacactacccaaggttga

SEQ ID NO: 964263 - DNA, 25 bp, Mus musculus
tagatgaaagcgctgccccactgct

SEQ ID NO: 964264 - DNA, 25 bp, Mus musculus
tagatgaaagggctgccccactgct

SEQ ID NO: 964265 - DNA, 25 bp, Mus musculus
tagatgacctccaacggcccaatgt

SEQ ID NO: 964266 - DNA, 25 bp, Mus musculus
tagatgacctccaagggcccaatgt

SEQ ID NO: 964267 - DNA, 25 bp, Mus musculus
tagatgagtggaagagcctgaccta

SEQ ID NO: 964268 - DNA, 25 bp, Mus musculus
tagatgagtggaagtgcctgaccta

SEQ ID NO: 964269 - DNA, 25 bp, Mus musculus
tagatgcaggaccactggatgcctg

SEQ ID NO: 964270 - DNA, 25 bp, Mus musculus
tagatgcaggaccagtggatgcctg

SEQ ID NO: 964271 - DNA, 25 bp, Mus musculus
tagatgctattgctggccgtcggtt

SEQ ID NO: 964272 - DNA, 25 bp, Mus musculus
tagatgctattggtggccgtcggtt

SEQ ID NO: 964273 - DNA, 25 bp, Mus musculus
tagatggagaatcgtaccgcgcccg

SEQ ID NO: 964274 - DNA, 25 bp, Mus musculus
tagatggagaatggtaccgcgcccg

SEQ ID NO: 964275 - DNA, 25 bp, Mus musculus
tagatggcgacccaatacgaaatgt

SEQ ID NO: 964276 - DNA, 25 bp, Mus musculus
tagatggcgaccgaatacgaaatgt

SEQ ID NO: 964277 - DNA, 25 bp, Mus musculus
tagatgttcacacaacaacagctgc

SEQ ID NO: 964278 - DNA, 25 bp, Mus musculus
tagatgttcacagaacaacagctgc

SEQ ID NO: 964279 - DNA, 25 bp, Mus musculus
tagattatagagataaacaagcaac

SEQ ID NO: 964280 - DNA, 25 bp, Mus musculus
tagattatagtgataaacaagcaac

SEQ ID NO: 964281 - DNA, 25 bp, Mus musculus
tagatttattaaccctctcagcaat

SEQ ID NO: 964282 - DNA, 25 bp, Mus musculus
tagatttattaagcctctcagcaat

SEQ ID NO: 964283 - DNA, 25 bp, Mus musculus
tagattttagcaggtcaatggccaa

SEQ ID NO: 964284 - DNA, 25 bp, Mus musculus
tagattttaggaggtcaatggccaa

SEQ ID NO: 964285 - DNA, 25 bp, Mus musculus
tagcaaacaccccacgtgatcatgg

SEQ ID NO: 964286 - DNA, 25 bp, Mus musculus
tagcaaacaccccaggtgatcatgg

SEQ ID NO: 964287 - DNA, 25 bp, Mus musculus
tagcaaaccaatgacaaaggaccag

SEQ ID NO: 964288 - DNA, 25 bp, Mus musculus
tagcaaaccattgacaaaggaccag

SEQ ID NO: 964289 - DNA, 25 bp, Mus musculus
tagcaacaaaacgctgccgtccagg

SEQ ID NO: 964290 - DNA, 25 bp, Mus musculus
tagcaacaaacagcagcggtcagca

SEQ ID NO: 964291 - DNA, 25 bp, Mus musculus
tagcaacaaagagcagcggtcagca

SEQ ID NO: 964292 - DNA, 25 bp, Mus musculus
tagcaacaaatcgctgccgtccagg

SEQ ID NO: 964293 - DNA, 25 bp, Mus musculus
tagcaacataacgacgctgagctcg

SEQ ID NO: 964294 - DNA, 25 bp, Mus musculus
tagcaacataacgaggctgagctcg

SEQ ID NO: 964295 - DNA, 25 bp, Mus musculus
tagcaacatgaacgtcatgtaggaa

SEQ ID NO: 964296 - DNA, 25 bp, Mus musculus
tagcaacatgaaggtcatgtaggaa

SEQ ID NO: 964297 - DNA, 25 bp, Mus musculus
tagcaagcccctcctggacaatact

SEQ ID NO: 964298 - DNA, 25 bp, Mus musculus
tagcaagcccgtcctggacaatact

SEQ ID NO: 964299 - DNA, 25 bp, Mus musculus
tagcaaggagaaagaaaagtcaaaa

SEQ ID NO: 964300 - DNA, 25 bp, Mus musculus
tagcaaggagcgattttgaacttta

SEQ ID NO: 964301 - DNA, 25 bp, Mus musculus
tagcaaggagggattttgaacttta

SEQ ID NO: 964302 - DNA, 25 bp, Mus musculus
tagcaaggagtaagaaaagtcaaaa

SEQ ID NO: 964303 - DNA, 25 bp, Mus musculus
tagcaaggccagagatctagagaac

SEQ ID NO: 964304 - DNA, 25 bp, Mus musculus
tagcaaggccagtgatctagagaac

SEQ ID NO: 964305 - DNA, 25 bp, Mus musculus
tagcaatcagaacccaagagatgaa

SEQ ID NO: 964306 - DNA, 25 bp, Mus musculus
tagcaatcagtacccaagagatgaa

SEQ ID NO: 964307 - DNA, 25 bp, Mus musculus
tagcacaaatatcggcgctagcgga

SEQ ID NO: 964308 - DNA, 25 bp, Mus musculus
tagcacaaatatgggcgctagcgga

SEQ ID NO: 964309 - DNA, 25 bp, Mus musculus
tagcacatattcctcaaagctgatg

SEQ ID NO: 964310 - DNA, 25 bp, Mus musculus
tagcacatattcctgaaagctgatg

SEQ ID NO: 964311 - DNA, 25 bp, Mus musculus
tagcaccacatacaaacacttcgat

SEQ ID NO: 964312 - DNA, 25 bp, Mus musculus
tagcaccacatacatacacttcgat

SEQ ID NO: 964313 - DNA, 25 bp, Mus musculus
tagcagcagtgacgaaatttttaaa

SEQ ID NO: 964314 - DNA, 25 bp, Mus musculus
tagcagcagtgaggaaatttttaaa

SEQ ID NO: 964315 - DNA, 25 bp, Mus musculus
tagcagccattaagctgcaggaccc

SEQ ID NO: 964316 - DNA, 25 bp, Mus musculus
tagcagccattatgctgcaggaccc

SEQ ID NO: 964317 - DNA, 25 bp, Mus musculus
tagcagtagtccaacatgcctttga

SEQ ID NO: 964318 - DNA, 25 bp, Mus musculus
tagcagtagtccaactgattagaat

SEQ ID NO: 964319 - DNA, 25 bp, Mus musculus
tagcagtagtccaagatgcctttga

SEQ ID NO: 964320 - DNA, 25 bp, Mus musculus
tagcagtagtccaagtgattagaat

SEQ ID NO: 964321 - DNA, 25 bp, Mus musculus
tagcagtcaaaatatggactaatgc

SEQ ID NO: 964322 - DNA, 25 bp, Mus musculus
tagcagtcaaactcagcaacagcat

SEQ ID NO: 964323 - DNA, 25 bp, Mus musculus
tagcagtcaatatatggactaatgc

SEQ ID NO: 964324 - DNA, 25 bp, Mus musculus
tagcagtcaatctcagcaacagcat

SEQ ID NO: 964325 - DNA, 25 bp, Mus musculus
tagcagtggagactcagcaaatcgg

SEQ ID NO: 964326 - DNA, 25 bp, Mus musculus
tagcagtggagactcgtcttgcttt

SEQ ID NO: 964327 - DNA, 25 bp, Mus musculus
tagcagtggagactgagcaaatcgg

SEQ ID NO: 964328 - DNA, 25 bp, Mus musculus
tagcagtggagactggtcttgcttt

SEQ ID NO: 964329 - DNA, 25 bp, Mus musculus
tagcataaagcacacaatagtatca

SEQ ID NO: 964330 - DNA, 25 bp, Mus musculus
tagcataaagcagacaatagtatca

SEQ ID NO: 964331 - DNA, 25 bp, Mus musculus
tagcataattcacaaaatcagaaaa

SEQ ID NO: 964332 - DNA, 25 bp, Mus musculus
tagcataattcagaaaatcagaaaa

SEQ ID NO: 964333 - DNA, 25 bp, Mus musculus
tagcatcaggcgctgaccatgcccc

SEQ ID NO: 964334 - DNA, 25 bp, Mus musculus
tagcatcaggcggtgaccatgcccc

SEQ ID NO: 964335 - DNA, 25 bp, Mus musculus
tagcatcggcagcacagcagcgctc

SEQ ID NO: 964336 - DNA, 25 bp, Mus musculus
tagcatcggcaggacagcagcgctc

SEQ ID NO: 964337 - DNA, 25 bp, Mus musculus
tagcatgtctgaccagtcaaactgg

SEQ ID NO: 964338 - DNA, 25 bp, Mus musculus
tagcatgtctgacctgtcaaactgg

SEQ ID NO: 964339 - DNA, 25 bp, Mus musculus
tagcattcatttatcggatccagaa

SEQ ID NO: 964340 - DNA, 25 bp, Mus musculus
tagcattcatttatctctgttacaa

SEQ ID NO: 964341 - DNA, 25 bp, Mus musculus
tagcattcatttatgggatccagaa

SEQ ID NO: 964342 - DNA, 25 bp, Mus musculus
tagcattcatttatgtctgttacaa

SEQ ID NO: 964343 - DNA, 25 bp, Mus musculus
tagcattccccaatcgtccatttac

SEQ ID NO: 964344 - DNA, 25 bp, Mus musculus
tagcattccccaatggtccatttac

SEQ ID NO: 964345 - DNA, 25 bp, Mus musculus
tagcatttcaagcatattaccttcc

SEQ ID NO: 964346 - DNA, 25 bp, Mus musculus
tagcatttcaaggatattaccttcc

SEQ ID NO: 964347 - DNA, 25 bp, Mus musculus
tagccaagacagatcggcgatagca

SEQ ID NO: 964348 - DNA, 25 bp, Mus musculus
tagccaagacagttcggcgatagca

SEQ ID NO: 964349 - DNA, 25 bp, Mus musculus
tagccaccagcacacagaatgttct

SEQ ID NO: 964350 - DNA, 25 bp, Mus musculus
tagccaccaggacacagaatgttct

SEQ ID NO: 964351 - DNA, 25 bp, Mus musculus
tagccagaagcacgcttggttcctg

SEQ ID NO: 964352 - DNA, 25 bp, Mus musculus
tagccagaagcaggcttggttcctg

SEQ ID NO: 964353 - DNA, 25 bp, Mus musculus
tagccagccactcacaacccctggc

SEQ ID NO: 964354 - DNA, 25 bp, Mus musculus
tagccagccactcagaacccctggc

SEQ ID NO: 964355 - DNA, 25 bp, Mus musculus
tagccagctccacagtgtggacctg

SEQ ID NO: 964356 - DNA, 25 bp, Mus musculus
tagccagctccagagtgtggacctg

SEQ ID NO: 964357 - DNA, 25 bp, Mus musculus
tagccagctgctcagaacccaatat

SEQ ID NO: 964358 - DNA, 25 bp, Mus musculus
tagccagctgctgagaacccaatat

SEQ ID NO: 964359 - DNA, 25 bp, Mus musculus
tagccaggagggaccattctgacgt

SEQ ID NO: 964360 - DNA, 25 bp, Mus musculus
tagccaggagggacgattctgacgt

SEQ ID NO: 964361 - DNA, 25 bp, Mus musculus
tagccagggttcagcctgccatgga

SEQ ID NO: 964362 - DNA, 25 bp, Mus musculus
tagccagggttcaggctgccatgga

SEQ ID NO: 964363 - DNA, 25 bp, Mus musculus
tagccatccccagacgattatcaca

SEQ ID NO: 964364 - DNA, 25 bp, Mus musculus
tagccatccccagaggattatcaca

SEQ ID NO: 964365 - DNA, 25 bp, Mus musculus
tagcccacagccctctagggccaat

SEQ ID NO: 964366 - DNA, 25 bp, Mus musculus
tagcccacaggcctctagggccaat

SEQ ID NO: 964367 - DNA, 25 bp, Mus musculus
tagcccaccgagattaggaagtggc

SEQ ID NO: 964368 - DNA, 25 bp, Mus musculus
tagcccaccgtgattaggaagtggc

SEQ ID NO: 964369 - DNA, 25 bp, Mus musculus
tagcccagcaggacagggccccctg

SEQ ID NO: 964370 - DNA, 25 bp, Mus musculus
tagcccagcaggtcagggccccctg

SEQ ID NO: 964371 - DNA, 25 bp, Mus musculus
tagccccaggagccacggactctgt

SEQ ID NO: 964372 - DNA, 25 bp, Mus musculus
tagccccaggagcctcggactctgt

SEQ ID NO: 964373 - DNA, 25 bp, Mus musculus
tagcccccagctcaattcacccatg

SEQ ID NO: 964374 - DNA, 25 bp, Mus musculus
tagcccccaggtcaattcacccatg

SEQ ID NO: 964375 - DNA, 25 bp, Mus musculus
tagcccctcctacacgatccgattg

SEQ ID NO: 964376 - DNA, 25 bp, Mus musculus
tagcccctcctacaggatccgattg

SEQ ID NO: 964377 - DNA, 25 bp, Mus musculus
tagccgagggagaggcactgatgga

SEQ ID NO: 964378 - DNA, 25 bp, Mus musculus
tagccgagggagtggcactgatgga

SEQ ID NO: 964379 - DNA, 25 bp, Mus musculus
tagccgcctcagctgtttgaaccat

SEQ ID NO: 964380 - DNA, 25 bp, Mus musculus
tagccgcctcaggtgtttgaaccat

SEQ ID NO: 964381 - DNA, 25 bp, Mus musculus
tagccgtgcattaccgtattattat

SEQ ID NO: 964382 - DNA, 25 bp, Mus musculus
tagccgtgcattacggtattattat

SEQ ID NO: 964383 - DNA, 25 bp, Mus musculus
tagcctacccagcaagaagctcact

SEQ ID NO: 964384 - DNA, 25 bp, Mus musculus
tagcctacccaggaagaagctcact

SEQ ID NO: 964385 - DNA, 25 bp, Mus musculus
tagcctattttacgcggctgcactg

SEQ ID NO: 964386 - DNA, 25 bp, Mus musculus
tagcctattttaggcggctgcactg

SEQ ID NO: 964387 - DNA, 25 bp, Mus musculus
tagcctctgaggaaagatataaaaa

SEQ ID NO: 964388 - DNA, 25 bp, Mus musculus
tagcctctgaggcaactacatgaat

SEQ ID NO: 964389 - DNA, 25 bp, Mus musculus
tagcctctgagggaactacatgaat

SEQ ID NO: 964390 - DNA, 25 bp, Mus musculus
tagcctctgaggtaagatataaaaa

SEQ ID NO: 964391 - DNA, 25 bp, Mus musculus
tagcctgctgaggaagagtgggcct

SEQ ID NO: 964392 - DNA, 25 bp, Mus musculus
tagcctgctgtggaagagtgggcct

SEQ ID NO: 964393 - DNA, 25 bp, Mus musculus
tagccttgctatttagtatcctgtt

SEQ ID NO: 964394 - DNA, 25 bp, Mus musculus
tagccttgctattttgtatcctgtt

SEQ ID NO: 964395 - DNA, 25 bp, Mus musculus
tagccttggataagtggttagatga

SEQ ID NO: 964396 - DNA, 25 bp, Mus musculus
tagccttggatatgtggttagatga

SEQ ID NO: 964397 - DNA, 25 bp, Mus musculus
tagcgaacaatacacgtggccaaga

SEQ ID NO: 964398 - DNA, 25 bp, Mus musculus
tagcgaacaatacactcaggatggc

SEQ ID NO: 964399 - DNA, 25 bp, Mus musculus
tagcgaacaatacaggtggccaaga

SEQ ID NO: 964400 - DNA, 25 bp, Mus musculus
tagcgaacaatacagtcaggatggc

SEQ ID NO: 964401 - DNA, 25 bp, Mus musculus
tagcgccaagactggagaggtgttg

SEQ ID NO: 964402 - DNA, 25 bp, Mus musculus
tagcgccaagtctggagaggtgttg

SEQ ID NO: 964403 - DNA, 25 bp, Mus musculus
tagcgccgagagatagtgctggagg

SEQ ID NO: 964404 - DNA, 25 bp, Mus musculus
tagcgccgagagattggagaatgat

SEQ ID NO: 964405 - DNA, 25 bp, Mus musculus
tagcgccgagtgatagtgctggagg

SEQ ID NO: 964406 - DNA, 25 bp, Mus musculus
tagcgccgagtgattggagaatgat

SEQ ID NO: 964407 - DNA, 25 bp, Mus musculus
tagcgcctcccgcggagcccgcacg

SEQ ID NO: 964408 - DNA, 25 bp, Mus musculus
tagcgcctcccggggagcccgcacg

SEQ ID NO: 964409 - DNA, 25 bp, Mus musculus
tagcgctgcccgcgatctccatctt

SEQ ID NO: 964410 - DNA, 25 bp, Mus musculus
tagcgctgcccgggatctccatctt

SEQ ID NO: 964411 - DNA, 25 bp, Mus musculus
tagcggccgccactctccacagagg

SEQ ID NO: 964412 - DNA, 25 bp, Mus musculus
tagcggccgccagtctccacagagg

SEQ ID NO: 964413 - DNA, 25 bp, Mus musculus
tagctacaacaaccgccgagacctg

SEQ ID NO: 964414 - DNA, 25 bp, Mus musculus
tagctacaacaagcgccgagacctg

SEQ ID NO: 964415 - DNA, 25 bp, Mus musculus
tagctactccagctacgtaggtgcc

SEQ ID NO: 964416 - DNA, 25 bp, Mus musculus
tagctactccaggtacgtaggtgcc

SEQ ID NO: 964417 - DNA, 25 bp, Mus musculus
tagctaggtctgcacgtgcagttcc

SEQ ID NO: 964418 - DNA, 25 bp, Mus musculus
tagctaggtctgcaggtgcagttcc

SEQ ID NO: 964419 - DNA, 25 bp, Mus musculus
tagctagttcagccactggctccag

SEQ ID NO: 964420 - DNA, 25 bp, Mus musculus
tagctagttcaggcactggctccag

SEQ ID NO: 964421 - DNA, 25 bp, Mus musculus
tagctccacatgaactcacagaaga

SEQ ID NO: 964422 - DNA, 25 bp, Mus musculus
tagctccacatgacattctctggct

SEQ ID NO: 964423 - DNA, 25 bp, Mus musculus
tagctccacatgccatttaccaatc

SEQ ID NO: 964424 - DNA, 25 bp, Mus musculus
tagctccacatggcatttaccaatc

SEQ ID NO: 964425 - DNA, 25 bp, Mus musculus
tagctccacatgtactcacagaaga

SEQ ID NO: 964426 - DNA, 25 bp, Mus musculus
tagctccacatgtcattctctggct

SEQ ID NO: 964427 - DNA, 25 bp, Mus musculus
tagctctggaagaggtgctgctgga

SEQ ID NO: 964428 - DNA, 25 bp, Mus musculus
tagctctggaagtggtgctgctgga

SEQ ID NO: 964429 - DNA, 25 bp, Mus musculus
tagctgagcaaacacctgcccggga

SEQ ID NO: 964430 - DNA, 25 bp, Mus musculus
tagctgagcaaacagctgcccggga

SEQ ID NO: 964431 - DNA, 25 bp, Mus musculus
tagctggaaatgaggcctatggttc

SEQ ID NO: 964432 - DNA, 25 bp, Mus musculus
tagctggaaatgtggcctatggttc

SEQ ID NO: 964433 - DNA, 25 bp, Mus musculus
tagctgtctgctttgtggacagtct

SEQ ID NO: 964434 - DNA, 25 bp, Mus musculus
tagctgtctggtttgtggacagtct

SEQ ID NO: 964435 - DNA, 25 bp, Mus musculus
tagcttcaaaagcgaccgagctcct

SEQ ID NO: 964436 - DNA, 25 bp, Mus musculus
tagcttcaaaagggaccgagctcct

SEQ ID NO: 964437 - DNA, 25 bp, Mus musculus
tagcttcaagcacccaaagatcagt

SEQ ID NO: 964438 - DNA, 25 bp, Mus musculus
tagcttcaaggacccaaagatcagt

SEQ ID NO: 964439 - DNA, 25 bp, Mus musculus
tagcttccagctggtggtcctcacc

SEQ ID NO: 964440 - DNA, 25 bp, Mus musculus
tagcttccaggtggtggtcctcacc

SEQ ID NO: 964441 - DNA, 25 bp, Mus musculus
tagcttgcttacaaatgcagactac

SEQ ID NO: 964442 - DNA, 25 bp, Mus musculus
tagcttgcttactaatgcagactac

SEQ ID NO: 964443 - DNA, 25 bp, Mus musculus
tagcttggaggacgttagctattat

SEQ ID NO: 964444 - DNA, 25 bp, Mus musculus
tagcttggaggaggttagctattat

SEQ ID NO: 964445 - DNA, 25 bp, Mus musculus
taggaaaagtcatcaccaacttgaa

SEQ ID NO: 964446 - DNA, 25 bp, Mus musculus
taggaaaagtgatcaccaacttgaa

SEQ ID NO: 964447 - DNA, 25 bp, Mus musculus
taggaaacaaaatgtatgtatttgg

SEQ ID NO: 964448 - DNA, 25 bp, Mus musculus
taggaaacaatatgtatgtatttgg

SEQ ID NO: 964449 - DNA, 25 bp, Mus musculus
taggaagaaaaacatgagtgtgttg

SEQ ID NO: 964450 - DNA, 25 bp, Mus musculus
taggaagaaaaagatgagtgtgttg

SEQ ID NO: 964451 - DNA, 25 bp, Mus musculus
taggaagaagccattgctcctgtgc

SEQ ID NO: 964452 - DNA, 25 bp, Mus musculus
taggaagaaggcattgctcctgtgc

SEQ ID NO: 964453 - DNA, 25 bp, Mus musculus
taggaagtgcagatatagatgagtg

SEQ ID NO: 964454 - DNA, 25 bp, Mus musculus
taggaagtgctgatatagatgagtg

SEQ ID NO: 964455 - DNA, 25 bp, Mus musculus
taggacaaagctatggctttgtgga

SEQ ID NO: 964456 - DNA, 25 bp, Mus musculus
taggacaaaggtatggctttgtgga

SEQ ID NO: 964457 - DNA, 25 bp, Mus musculus
taggacactacgaacagcacattag

SEQ ID NO: 964458 - DNA, 25 bp, Mus musculus
taggacactacgtacagcacattag

SEQ ID NO: 964459 - DNA, 25 bp, Mus musculus
taggacatttaccttcccgtcgaat

SEQ ID NO: 964460 - DNA, 25 bp, Mus musculus
taggacattttccttcccgtcgaat

SEQ ID NO: 964461 - DNA, 25 bp, Mus musculus
taggaccgcttataccccaaggaac

SEQ ID NO: 964462 - DNA, 25 bp, Mus musculus
taggaccgcttatacgcttggggca

SEQ ID NO: 964463 - DNA, 25 bp, Mus musculus
taggaccgcttatagcccaaggaac

SEQ ID NO: 964464 - DNA, 25 bp, Mus musculus
taggaccgcttataggcttggggca

SEQ ID NO: 964465 - DNA, 25 bp, Mus musculus
taggacttaggactacagagactca

SEQ ID NO: 964466 - DNA, 25 bp, Mus musculus
taggacttaggagtacagagactca

SEQ ID NO: 964467 - DNA, 25 bp, Mus musculus
taggactttgagctgaggctgcagc

SEQ ID NO: 964468 - DNA, 25 bp, Mus musculus
taggactttgtgctgaggctgcagc

SEQ ID NO: 964469 - DNA, 25 bp, Mus musculus
taggagaacagctccgggactttct

SEQ ID NO: 964470 - DNA, 25 bp, Mus musculus
taggagaacagctccggtttgagtt

SEQ ID NO: 964471 - DNA, 25 bp, Mus musculus
taggagaacagctcggggactttct

SEQ ID NO: 964472 - DNA, 25 bp, Mus musculus
taggagaacagctcgggtttgagtt

SEQ ID NO: 964473 - DNA, 25 bp, Mus musculus
taggagaagggaaatatgctggctt

SEQ ID NO: 964474 - DNA, 25 bp, Mus musculus
taggagaagggatatatgctggctt

SEQ ID NO: 964475 - DNA, 25 bp, Mus musculus
taggagactggacacaacgattccg

SEQ ID NO: 964476 - DNA, 25 bp, Mus musculus
taggagactggacagaacgattccg

SEQ ID NO: 964477 - DNA, 25 bp, Mus musculus
taggagagagcaggaaaagcagccc

SEQ ID NO: 964478 - DNA, 25 bp, Mus musculus
taggagagaggaggaaaagcagccc

SEQ ID NO: 964479 - DNA, 25 bp, Mus musculus
taggagagattgatgctgcacctcc

SEQ ID NO: 964480 - DNA, 25 bp, Mus musculus
taggagagattgttgctgcacctcc

SEQ ID NO: 964481 - DNA, 25 bp, Mus musculus
taggagccagaagctgactgctgcc

SEQ ID NO: 964482 - DNA, 25 bp, Mus musculus
taggagccagaaggaggctggcaag

SEQ ID NO: 964483 - DNA, 25 bp, Mus musculus
taggagccagaggaagtcacagaca

SEQ ID NO: 964484 - DNA, 25 bp, Mus musculus
taggagccagtagctgactgctgcc

SEQ ID NO: 964485 - DNA, 25 bp, Mus musculus
taggagccagtaggaggctggcaag

SEQ ID NO: 964486 - DNA, 25 bp, Mus musculus
taggagccagtggaagtcacagaca

SEQ ID NO: 964487 - DNA, 25 bp, Mus musculus
taggagggattgatgctgcacctcc

SEQ ID NO: 964488 - DNA, 25 bp, Mus musculus
taggagggattgttgctgcacctcc

SEQ ID NO: 964489 - DNA, 25 bp, Mus musculus
taggagggctgacgtacagtcatgt

SEQ ID NO: 964490 - DNA, 25 bp, Mus musculus
taggagggctgaggtacagtcatgt

SEQ ID NO: 964491 - DNA, 25 bp, Mus musculus
taggagtacaaaaacctgtgagtac

SEQ ID NO: 964492 - DNA, 25 bp, Mus musculus
taggagtacaaaaacgtgcatccaa

SEQ ID NO: 964493 - DNA, 25 bp, Mus musculus
taggagtacaaaaagctgtgagtac

SEQ ID NO: 964494 - DNA, 25 bp, Mus musculus
taggagtacaaaaaggtgcatccaa

SEQ ID NO: 964495 - DNA, 25 bp, Mus musculus
taggatattattccaggaggtgtcc

SEQ ID NO: 964496 - DNA, 25 bp, Mus musculus
taggatattattcctggaggtgtcc

SEQ ID NO: 964497 - DNA, 25 bp, Mus musculus
taggatcttctactgaacagcgtca

SEQ ID NO: 964498 - DNA, 25 bp, Mus musculus
taggatcttctagtgaacagcgtca

SEQ ID NO: 964499 - DNA, 25 bp, Mus musculus
taggatgaaggacaagaccctctgg

SEQ ID NO: 964500 - DNA, 25 bp, Mus musculus
taggatgaaggacatgaccctctgg

SEQ ID NO: 964501 - DNA, 25 bp, Mus musculus
taggatgctacggacgtgccttagc

SEQ ID NO: 964502 - DNA, 25 bp, Mus musculus
taggatgctacggaggtgccttagc

SEQ ID NO: 964503 - DNA, 25 bp, Mus musculus
taggatgtttaacactattgcagaa

SEQ ID NO: 964504 - DNA, 25 bp, Mus musculus
taggatgtttaacagtattgcagaa

SEQ ID NO: 964505 - DNA, 25 bp, Mus musculus
taggattccctgggcccggcaagtc

SEQ ID NO: 964506 - DNA, 25 bp, Mus musculus
taggattccctggggccggcaagtc

SEQ ID NO: 964507 - DNA, 25 bp, Mus musculus
taggcaaagttacatccaatgtctt

SEQ ID NO: 964508 - DNA, 25 bp, Mus musculus
taggcaaagttagatccaatgtctt

SEQ ID NO: 964509 - DNA, 25 bp, Mus musculus
taggcaaggcggccctggtgatgtc

SEQ ID NO: 964510 - DNA, 25 bp, Mus musculus
taggcaaggcgggcctggtgatgtc

SEQ ID NO: 964511 - DNA, 25 bp, Mus musculus
taggcacatacccacgatcaaaacc

SEQ ID NO: 964512 - DNA, 25 bp, Mus musculus
taggcacatacccacgttgctgcct

SEQ ID NO: 964513 - DNA, 25 bp, Mus musculus
taggcacatacccaggatcaaaacc

SEQ ID NO: 964514 - DNA, 25 bp, Mus musculus
taggcacatacccaggttgctgcct

SEQ ID NO: 964515 - DNA, 25 bp, Mus musculus
taggcactaaaacgtacatggcccc

SEQ ID NO: 964516 - DNA, 25 bp, Mus musculus
taggcactaaaaggtacatggcccc

SEQ ID NO: 964517 - DNA, 25 bp, Mus musculus
taggcactcgctcgtgtccttcgtg

SEQ ID NO: 964518 - DNA, 25 bp, Mus musculus
taggcactcgctggtgtccttcgtg

SEQ ID NO: 964519 - DNA, 25 bp, Mus musculus
taggcagctaaacgaattacaccta

SEQ ID NO: 964520 - DNA, 25 bp, Mus musculus
taggcagctaaaggaattacaccta

SEQ ID NO: 964521 - DNA, 25 bp, Mus musculus
taggcagctcagcctcagggaagac

SEQ ID NO: 964522 - DNA, 25 bp, Mus musculus
taggcagctcaggctcagggaagac

SEQ ID NO: 964523 - DNA, 25 bp, Mus musculus
taggcatgagattgctgttatgtta

SEQ ID NO: 964524 - DNA, 25 bp, Mus musculus
taggcatgagtttgctgttatgtta

SEQ ID NO: 964525 - DNA, 25 bp, Mus musculus
taggccccactgcggccatgtagga

SEQ ID NO: 964526 - DNA, 25 bp, Mus musculus
taggccccactggggccatgtagga

SEQ ID NO: 964527 - DNA, 25 bp, Mus musculus
taggccgcgcgcggcgtgctgtgag

SEQ ID NO: 964528 - DNA, 25 bp, Mus musculus
taggccgcgcgcggggtgctgtgag

SEQ ID NO: 964529 - DNA, 25 bp, Mus musculus
taggccgcggagctcacaggctctg

SEQ ID NO: 964530 - DNA, 25 bp, Mus musculus
taggccgcggaggtcacaggctctg

SEQ ID NO: 964531 - DNA, 25 bp, Mus musculus
taggcctcaactataagtcttgctt

SEQ ID NO: 964532 - DNA, 25 bp, Mus musculus
taggcctcaactttaagtcttgctt

SEQ ID NO: 964533 - DNA, 25 bp, Mus musculus
taggcctgttcacgccaaatttgaa

SEQ ID NO: 964534 - DNA, 25 bp, Mus musculus
taggcctgttcaggccaaatttgaa

SEQ ID NO: 964535 - DNA, 25 bp, Mus musculus
taggcgctccccgacgtgtgaatga

SEQ ID NO: 964536 - DNA, 25 bp, Mus musculus
taggcgctccccgaggtgtgaatga

SEQ ID NO: 964537 - DNA, 25 bp, Mus musculus
taggcggaggtgcacgtgaagttga

SEQ ID NO: 964538 - DNA, 25 bp, Mus musculus
taggcggaggtgcaggtgaagttga

SEQ ID NO: 964539 - DNA, 25 bp, Mus musculus
taggctaccgctgatggtgtggatc

SEQ ID NO: 964540 - DNA, 25 bp, Mus musculus
taggctaccggtgatggtgtggatc

SEQ ID NO: 964541 - DNA, 25 bp, Mus musculus
taggctggctggaagctgcctactg

SEQ ID NO: 964542 - DNA, 25 bp, Mus musculus
taggctggctggctgcctactggac

SEQ ID NO: 964543 - DNA, 25 bp, Mus musculus
taggctggctgggtgcctactggac

SEQ ID NO: 964544 - DNA, 25 bp, Mus musculus
taggctggctggtagctgcctactg

SEQ ID NO: 964545 - DNA, 25 bp, Mus musculus
tagggacaagacactgttctgggag

SEQ ID NO: 964546 - DNA, 25 bp, Mus musculus
tagggacaagtcactgttctgggag

SEQ ID NO: 964547 - DNA, 25 bp, Mus musculus
tagggatgtgatcctctttctcatc

SEQ ID NO: 964548 - DNA, 25 bp, Mus musculus
tagggatgtgatgctctttctcatc

SEQ ID NO: 964549 - DNA, 25 bp, Mus musculus
tagggctctgcacgaagcctgctga

SEQ ID NO: 964550 - DNA, 25 bp, Mus musculus
tagggctctgcaggaagcctgctga

SEQ ID NO: 964551 - DNA, 25 bp, Mus musculus
tagggctggggacacatgtggctgg

SEQ ID NO: 964552 - DNA, 25 bp, Mus musculus
tagggctggggacagatgtggctgg

SEQ ID NO: 964553 - DNA, 25 bp, Mus musculus
tagggggcctttcacacccctatgt

SEQ ID NO: 964554 - DNA, 25 bp, Mus musculus
tagggggcctttcagacccctatgt

SEQ ID NO: 964555 - DNA, 25 bp, Mus musculus
tagggtagaaaaaacatgacctcaa

SEQ ID NO: 964556 - DNA, 25 bp, Mus musculus
tagggtagaaaaaagatgacctcaa

SEQ ID NO: 964557 - DNA, 25 bp, Mus musculus
tagggtgcagcaagccggggagctg

SEQ ID NO: 964558 - DNA, 25 bp, Mus musculus
tagggtgcaggaagccggggagctg

SEQ ID NO: 964559 - DNA, 25 bp, Mus musculus
tagggtggcgggcccctccatgatg

SEQ ID NO: 964560 - DNA, 25 bp, Mus musculus
tagggtggcggggccctccatgatg

SEQ ID NO: 964561 - DNA, 25 bp, Mus musculus
taggtaaatgagatcatgattctgg

SEQ ID NO: 964562 - DNA, 25 bp, Mus musculus
taggtaaatgagttcatgattctgg

SEQ ID NO: 964563 - DNA, 25 bp, Mus musculus
taggtatcagcgtggactcagtact

SEQ ID NO: 964564 - DNA, 25 bp, Mus musculus
taggtatcagggtggactcagtact

SEQ ID NO: 964565 - DNA, 25 bp, Mus musculus
taggtcagcgagctattgaagcccc

SEQ ID NO: 964566 - DNA, 25 bp, Mus musculus
taggtcagcgaggtattgaagcccc

SEQ ID NO: 964567 - DNA, 25 bp, Mus musculus
taggtcccgagaaacattccagagt

SEQ ID NO: 964568 - DNA, 25 bp, Mus musculus
taggtcccgagaaagattccagagt

SEQ ID NO: 964569 - DNA, 25 bp, Mus musculus
taggtccggagttcctgcctccgga

SEQ ID NO: 964570 - DNA, 25 bp, Mus musculus
taggtccggagttcgtgcctccgga

SEQ ID NO: 964571 - DNA, 25 bp, Mus musculus
taggtctcccagctgacccaggccc

SEQ ID NO: 964572 - DNA, 25 bp, Mus musculus
taggtctcccaggtgacccaggccc

SEQ ID NO: 964573 - DNA, 25 bp, Mus musculus
taggtgatccagcttttgtggtctt

SEQ ID NO: 964574 - DNA, 25 bp, Mus musculus
taggtgatccaggttttgtggtctt

SEQ ID NO: 964575 - DNA, 25 bp, Mus musculus
taggtgccaagacggagctccgctt

SEQ ID NO: 964576 - DNA, 25 bp, Mus musculus
taggtgccaagagggagctccgctt

SEQ ID NO: 964577 - DNA, 25 bp, Mus musculus
taggtgccctgccggcttcgagggt

SEQ ID NO: 964578 - DNA, 25 bp, Mus musculus
taggtgccctgcgggcttcgagggt

SEQ ID NO: 964579 - DNA, 25 bp, Mus musculus
taggtttgcaagggacacagcaggc

SEQ ID NO: 964580 - DNA, 25 bp, Mus musculus
taggtttgcacatgatacgtatacg

SEQ ID NO: 964581 - DNA, 25 bp, Mus musculus
taggtttgcagatgatacgtatacg

SEQ ID NO: 964582 - DNA, 25 bp, Mus musculus
taggtttgcatgggacacagcaggc

SEQ ID NO: 964583 - DNA, 25 bp, Mus musculus
tagtagcttccacgtggtggtcctc

SEQ ID NO: 964584 - DNA, 25 bp, Mus musculus
tagtagcttccaggtggtggtcctc

SEQ ID NO: 964585 - DNA, 25 bp, Mus musculus
tagtaggagaagctgtgggcagaag

SEQ ID NO: 964586 - DNA, 25 bp, Mus musculus
tagtaggagaaggtgtgggcagaag

SEQ ID NO: 964587 - DNA, 25 bp, Mus musculus
tagtagtgacagcacactactggac

SEQ ID NO: 964588 - DNA, 25 bp, Mus musculus
tagtagtgacaggacactactggac

SEQ ID NO: 964589 - DNA, 25 bp, Mus musculus
tagtattgcataaagtcctgatggg

SEQ ID NO: 964590 - DNA, 25 bp, Mus musculus
tagtattgcatatagtcctgatggg

SEQ ID NO: 964591 - DNA, 25 bp, Mus musculus
tagtatttccaactttcactcagtg

SEQ ID NO: 964592 - DNA, 25 bp, Mus musculus
tagtatttccaagtttcactcagtg

SEQ ID NO: 964593 - DNA, 25 bp, Mus musculus
tagtcaagctcattgaaagcaaaca

SEQ ID NO: 964594 - DNA, 25 bp, Mus musculus
tagtcaagctgattgaaagcaaaca

SEQ ID NO: 964595 - DNA, 25 bp, Mus musculus
tagtcaatgacgcaatcagaggcaa

SEQ ID NO: 964596 - DNA, 25 bp, Mus musculus
tagtcaatgacggaatcagaggcaa

SEQ ID NO: 964597 - DNA, 25 bp, Mus musculus
tagtcacggagcactgcacagaaga

SEQ ID NO: 964598 - DNA, 25 bp, Mus musculus
tagtcacggagctctgcacagaaga

SEQ ID NO: 964599 - DNA, 25 bp, Mus musculus
tagtcatctgcgaacacgactcctt

SEQ ID NO: 964600 - DNA, 25 bp, Mus musculus
tagtcatctgcgtacacgactcctt

SEQ ID NO: 964601 - DNA, 25 bp, Mus musculus
tagtcatgtaccagcaccacgtcgg

SEQ ID NO: 964602 - DNA, 25 bp, Mus musculus
tagtcatgtacctgcaccacgtcgg

SEQ ID NO: 964603 - DNA, 25 bp, Mus musculus
tagtccgctgagcacgtatgtgtgt

SEQ ID NO: 964604 - DNA, 25 bp, Mus musculus
tagtccgctgagcaggtatgtgtgt

SEQ ID NO: 964605 - DNA, 25 bp, Mus musculus
tagtcctcagagcccagttgttgct

SEQ ID NO: 964606 - DNA, 25 bp, Mus musculus
tagtcctcagaggccagttgttgct

SEQ ID NO: 964607 - DNA, 25 bp, Mus musculus
tagtccttatgactggcaaatgcaa

SEQ ID NO: 964608 - DNA, 25 bp, Mus musculus
tagtccttatgagtggcaaatgcaa

SEQ ID NO: 964609 - DNA, 25 bp, Mus musculus
tagtctagaaaacataggagacagc

SEQ ID NO: 964610 - DNA, 25 bp, Mus musculus
tagtctagaaaacgctaatctttct

SEQ ID NO: 964611 - DNA, 25 bp, Mus musculus
tagtctagaaaagataggagacagc

SEQ ID NO: 964612 - DNA, 25 bp, Mus musculus
tagtctagaaaaggctaatctttct

SEQ ID NO: 964613 - DNA, 25 bp, Mus musculus
tagtctcagaggatagctctctaca

SEQ ID NO: 964614 - DNA, 25 bp, Mus musculus
tagtctcagaggttagctctctaca

SEQ ID NO: 964615 - DNA, 25 bp, Mus musculus
tagtctgccactgaaaggattccgc

SEQ ID NO: 964616 - DNA, 25 bp, Mus musculus
tagtctgccagtgaaaggattccgc

SEQ ID NO: 964617 - DNA, 25 bp, Mus musculus
tagtgaacaaagctgaactctctgt

SEQ ID NO: 964618 - DNA, 25 bp, Mus musculus
tagtgaacaaaggtgaactctctgt

SEQ ID NO: 964619 - DNA, 25 bp, Mus musculus
tagtgaagggagaggtacagaaagc

SEQ ID NO: 964620 - DNA, 25 bp, Mus musculus
tagtgaagggtgaggtacagaaagc

SEQ ID NO: 964621 - DNA, 25 bp, Mus musculus
tagtgaatttagccagtgtcttgag

SEQ ID NO: 964622 - DNA, 25 bp, Mus musculus
tagtgaatttagcctgtgtcttgag

SEQ ID NO: 964623 - DNA, 25 bp, Mus musculus
tagtgaccaagaccaggatggggat

SEQ ID NO: 964624 - DNA, 25 bp, Mus musculus
tagtgaccaagacctggatggggat

SEQ ID NO: 964625 - DNA, 25 bp, Mus musculus
tagtgacctcctcgattaccccaag

SEQ ID NO: 964626 - DNA, 25 bp, Mus musculus
tagtgacctcctggattaccccaag

SEQ ID NO: 964627 - DNA, 25 bp, Mus musculus
tagtgaccttcgcgaggatgcaacc

SEQ ID NO: 964628 - DNA, 25 bp, Mus musculus
tagtgaccttcgggaggatgcaacc

SEQ ID NO: 964629 - DNA, 25 bp, Mus musculus
tagtgactaccacgttatttctgac

SEQ ID NO: 964630 - DNA, 25 bp, Mus musculus
tagtgactaccaggttatttctgac

SEQ ID NO: 964631 - DNA, 25 bp, Mus musculus
tagtgactgaaaaacttccaccagg

SEQ ID NO: 964632 - DNA, 25 bp, Mus musculus
tagtgactgaaaaagttccaccagg

SEQ ID NO: 964633 - DNA, 25 bp, Mus musculus
tagtgactggagcattctgtaccca

SEQ ID NO: 964634 - DNA, 25 bp, Mus musculus
tagtgactggaggattctgtaccca

SEQ ID NO: 964635 - DNA, 25 bp, Mus musculus
tagtgacttgactccagaagaattc

SEQ ID NO: 964636 - DNA, 25 bp, Mus musculus
tagtgacttgtctccagaagaattc

SEQ ID NO: 964637 - DNA, 25 bp, Mus musculus
tagtgaggcgattggtcaaagaaag

SEQ ID NO: 964638 - DNA, 25 bp, Mus musculus
tagtgaggcgtttggtcaaagaaag

SEQ ID NO: 964639 - DNA, 25 bp, Mus musculus
tagtgatcagcagaataatgttttt

SEQ ID NO: 964640 - DNA, 25 bp, Mus musculus
tagtgatcaggagaataatgttttt

SEQ ID NO: 964641 - DNA, 25 bp, Mus musculus
tagtgattgtaaactacttttttac

SEQ ID NO: 964642 - DNA, 25 bp, Mus musculus
tagtgattgtaacaatgaagatatc

SEQ ID NO: 964643 - DNA, 25 bp, Mus musculus
tagtgattgtaagaatgaagatatc

SEQ ID NO: 964644 - DNA, 25 bp, Mus musculus
tagtgattgtaatctacttttttac

SEQ ID NO: 964645 - DNA, 25 bp, Mus musculus
tagtgcagctcttgctttacccatc

SEQ ID NO: 964646 - DNA, 25 bp, Mus musculus
tagtgcagctcttggtttacccatc

SEQ ID NO: 964647 - DNA, 25 bp, Mus musculus
tagtgctcttcacaatgtgaagaga

SEQ ID NO: 964648 - DNA, 25 bp, Mus musculus
tagtgctcttcagaatgtgaagaga

SEQ ID NO: 964649 - DNA, 25 bp, Mus musculus
tagtgctgaaccggcatctgaactg

SEQ ID NO: 964650 - DNA, 25 bp, Mus musculus
tagtgctgaagcggcatctgaactg

SEQ ID NO: 964651 - DNA, 25 bp, Mus musculus
tagtgctgaccgttcaatcttttga

SEQ ID NO: 964652 - DNA, 25 bp, Mus musculus
tagtgctgaccgttgaatcttttga

SEQ ID NO: 964653 - DNA, 25 bp, Mus musculus
tagtggaaattgctcttggtgacaa

SEQ ID NO: 964654 - DNA, 25 bp, Mus musculus
tagtggaaattgctgttggtgacaa

SEQ ID NO: 964655 - DNA, 25 bp, Mus musculus
tagtggaagaaaccacattgtagtc

SEQ ID NO: 964656 - DNA, 25 bp, Mus musculus
tagtggaagaaagcacattgtagtc

SEQ ID NO: 964657 - DNA, 25 bp, Mus musculus
tagtggaccttttgcgtattgcagt

SEQ ID NO: 964658 - DNA, 25 bp, Mus musculus
tagtggaccttttgggtattgcagt

SEQ ID NO: 964659 - DNA, 25 bp, Mus musculus
tagtggatcatgactatgctatccg

SEQ ID NO: 964660 - DNA, 25 bp, Mus musculus
tagtggatcatgtctatgctatccg

SEQ ID NO: 964661 - DNA, 25 bp, Mus musculus
tagtggctgcagagaatgatgtcac

SEQ ID NO: 964662 - DNA, 25 bp, Mus musculus
tagtggctgcagtgaatgatgtcac

SEQ ID NO: 964663 - DNA, 25 bp, Mus musculus
tagtgggctgcatcagtgaagagga

SEQ ID NO: 964664 - DNA, 25 bp, Mus musculus
tagtgggctgcatctgtgaagagga

SEQ ID NO: 964665 - DNA, 25 bp, Mus musculus
tagtggtcagagtccagctacacgt

SEQ ID NO: 964666 - DNA, 25 bp, Mus musculus
tagtggtcagtgtccagctacacgt

SEQ ID NO: 964667 - DNA, 25 bp, Mus musculus
tagtggtgactatacgtgtggattt

SEQ ID NO: 964668 - DNA, 25 bp, Mus musculus
tagtggtgactataggtgtggattt

SEQ ID NO: 964669 - DNA, 25 bp, Mus musculus
tagtggtgctcacgcaagatgggca

SEQ ID NO: 964670 - DNA, 25 bp, Mus musculus
tagtggtgctcactggcagcatgga

SEQ ID NO: 964671 - DNA, 25 bp, Mus musculus
tagtggtgctcaggcaagatgggca

SEQ ID NO: 964672 - DNA, 25 bp, Mus musculus
tagtggtgctcagtggcagcatgga

SEQ ID NO: 964673 - DNA, 25 bp, Mus musculus
tagtgtggaaaacgtcttagatcag

SEQ ID NO: 964674 - DNA, 25 bp, Mus musculus
tagtgtggaaaaggtcttagatcag

SEQ ID NO: 964675 - DNA, 25 bp, Mus musculus
tagtgtggataacgttttggaactg

SEQ ID NO: 964676 - DNA, 25 bp, Mus musculus
tagtgtggataaggttttggaactg

SEQ ID NO: 964677 - DNA, 25 bp, Mus musculus
tagtgttaaaggcgcgatgggcgcc

SEQ ID NO: 964678 - DNA, 25 bp, Mus musculus
tagtgttaaaggggcgatgggcgcc

SEQ ID NO: 964679 - DNA, 25 bp, Mus musculus
tagtgttctgttcttattttccttc

SEQ ID NO: 964680 - DNA, 25 bp, Mus musculus
tagtgttctgttgttattttccttc

SEQ ID NO: 964681 - DNA, 25 bp, Mus musculus
tagttaaaggaatccagacgggtgc

SEQ ID NO: 964682 - DNA, 25 bp, Mus musculus
tagttaaaggaatcgagacgggtgc

SEQ ID NO: 964683 - DNA, 25 bp, Mus musculus
tagttaaaggagaaccaggtgaacg

SEQ ID NO: 964684 - DNA, 25 bp, Mus musculus
tagttaaaggagaagcaggtgaacg

SEQ ID NO: 964685 - DNA, 25 bp, Mus musculus
tagttaatggagctgttccctggcc

SEQ ID NO: 964686 - DNA, 25 bp, Mus musculus
tagttaatggaggtgttccctggcc

SEQ ID NO: 964687 - DNA, 25 bp, Mus musculus
tagttactgcagcgagaagagtccc

SEQ ID NO: 964688 - DNA, 25 bp, Mus musculus
tagttactgcagggagaagagtccc

SEQ ID NO: 964689 - DNA, 25 bp, Mus musculus
tagttcataacacatctcagcgact

SEQ ID NO: 964690 - DNA, 25 bp, Mus musculus
tagttcataacagatctcagcgact

SEQ ID NO: 964691 - DNA, 25 bp, Mus musculus
tagttcattttgaaacacgagaagc

SEQ ID NO: 964692 - DNA, 25 bp, Mus musculus
tagttcattttgaatcacgagaagc

SEQ ID NO: 964693 - DNA, 25 bp, Mus musculus
tagttctttgaaaaatgatcaacct

SEQ ID NO: 964694 - DNA, 25 bp, Mus musculus
tagttctttgtaaaatgatcaacct

SEQ ID NO: 964695 - DNA, 25 bp, Mus musculus
tagttgacccagcccctgattttgt

SEQ ID NO: 964696 - DNA, 25 bp, Mus musculus
tagttgacccaggccctgattttgt

SEQ ID NO: 964697 - DNA, 25 bp, Mus musculus
tagttgcttttatcatttattttca

SEQ ID NO: 964698 - DNA, 25 bp, Mus musculus
tagttgcttttatcttttattttca

SEQ ID NO: 964699 - DNA, 25 bp, Mus musculus
tagttggaagcctctgggtggtatt

SEQ ID NO: 964700 - DNA, 25 bp, Mus musculus
tagttggaaggctctgggtggtatt

SEQ ID NO: 964701 - DNA, 25 bp, Mus musculus
tagttgttcaagagaaaccatttat

SEQ ID NO: 964702 - DNA, 25 bp, Mus musculus
tagttgttcaagatgggagaatgaa

SEQ ID NO: 964703 - DNA, 25 bp, Mus musculus
tagttgttcaagtgaaaccatttat

SEQ ID NO: 964704 - DNA, 25 bp, Mus musculus
tagttgttcaagttgggagaatgaa

SEQ ID NO: 964705 - DNA, 25 bp, Mus musculus
tagttgttggagcaactgctgaaga

SEQ ID NO: 964706 - DNA, 25 bp, Mus musculus
tagttgttggaggaactgctgaaga

SEQ ID NO: 964707 - DNA, 25 bp, Mus musculus
tagtttcacagacatccttggtgtt

SEQ ID NO: 964708 - DNA, 25 bp, Mus musculus
tagtttcacagagatccttggtgtt

SEQ ID NO: 964709 - DNA, 25 bp, Mus musculus
tagtttctttgtgacactcttcgta

SEQ ID NO: 964710 - DNA, 25 bp, Mus musculus
tagtttctttgtgagactcttcgta

SEQ ID NO: 964711 - DNA, 25 bp, Mus musculus
tataaaaatgtgaatcaagaagtgg

SEQ ID NO: 964712 - DNA, 25 bp, Mus musculus
tataaaaatgtgtatcaagaagtgg

SEQ ID NO: 964713 - DNA, 25 bp, Mus musculus
tataaaaattacagtaccaaagcag

SEQ ID NO: 964714 - DNA, 25 bp, Mus musculus
tataaaaattactgtaccaaagcag

SEQ ID NO: 964715 - DNA, 25 bp, Mus musculus
tataaaagagcatgggtacacaatg

SEQ ID NO: 964716 - DNA, 25 bp, Mus musculus
tataaaagagctatatattatgagc

SEQ ID NO: 964717 - DNA, 25 bp, Mus musculus
tataaaagaggatgggtacacaatg

SEQ ID NO: 964718 - DNA, 25 bp, Mus musculus
tataaaagaggtatatattatgagc

SEQ ID NO: 964719 - DNA, 25 bp, Mus musculus
tataaaatgggaccctttgaaatcc

SEQ ID NO: 964720 - DNA, 25 bp, Mus musculus
tataaaatgggagcctttgaaatcc

SEQ ID NO: 964721 - DNA, 25 bp, Mus musculus
tataaaatgttacacatgaaatgcc

SEQ ID NO: 964722 - DNA, 25 bp, Mus musculus
tataaaatgttacagatgaaatgcc

SEQ ID NO: 964723 - DNA, 25 bp, Mus musculus
tataaactcaagccaggaaccatga

SEQ ID NO: 964724 - DNA, 25 bp, Mus musculus
tataaactcaagcgctcgggccatc

SEQ ID NO: 964725 - DNA, 25 bp, Mus musculus
tataaactcaaggcaggaaccatga

SEQ ID NO: 964726 - DNA, 25 bp, Mus musculus
tataaactcaagggctcgggccatc

SEQ ID NO: 964727 - DNA, 25 bp, Mus musculus
tataaactggcgagatgtccctgct

SEQ ID NO: 964728 - DNA, 25 bp, Mus musculus
tataaactggggagatgtccctgct

SEQ ID NO: 964729 - DNA, 25 bp, Mus musculus
tataaagactaccgcggggacagtg

SEQ ID NO: 964730 - DNA, 25 bp, Mus musculus
tataaagacttccgcggggacagtg

SEQ ID NO: 964731 - DNA, 25 bp, Mus musculus
tataaagagtattcacaaatgcaac

SEQ ID NO: 964732 - DNA, 25 bp, Mus musculus
tataaagagtattctcaaatgcaac

SEQ ID NO: 964733 - DNA, 25 bp, Mus musculus
tataaaggcactcgttactacactt

SEQ ID NO: 964734 - DNA, 25 bp, Mus musculus
tataaaggcactggttactacactt

SEQ ID NO: 964735 - DNA, 25 bp, Mus musculus
tataaagtcgaaaaatatgaaagaa

SEQ ID NO: 964736 - DNA, 25 bp, Mus musculus
tataaagtcgtaaaatatgaaagaa

SEQ ID NO: 964737 - DNA, 25 bp, Mus musculus
tataaagtctccaaattctgaactt

SEQ ID NO: 964738 - DNA, 25 bp, Mus musculus
tataaagtctctcaaactcaagtca

SEQ ID NO: 964739 - DNA, 25 bp, Mus musculus
tataaagtctctgaaactcaagtca

SEQ ID NO: 964740 - DNA, 25 bp, Mus musculus
tataaagtctgcaaattctgaactt

SEQ ID NO: 964741 - DNA, 25 bp, Mus musculus
tataaagtggagcgtggctgtatca

SEQ ID NO: 964742 - DNA, 25 bp, Mus musculus
tataaagtggagggtggctgtatca

SEQ ID NO: 964743 - DNA, 25 bp, Mus musculus
tataaatccatgaacggcttaggca

SEQ ID NO: 964744 - DNA, 25 bp, Mus musculus
tataaatccatgaagggcttaggca

SEQ ID NO: 964745 - DNA, 25 bp, Mus musculus
tataaatttgcaagagccagaggga

SEQ ID NO: 964746 - DNA, 25 bp, Mus musculus
tataaatttggaagagccagaggga

SEQ ID NO: 964747 - DNA, 25 bp, Mus musculus
tataacaaactgcatgcagagaatg

SEQ ID NO: 964748 - DNA, 25 bp, Mus musculus
tataacaaactggatgcagagaatg

SEQ ID NO: 964749 - DNA, 25 bp, Mus musculus
tataacaagactacaatgcttctct

SEQ ID NO: 964750 - DNA, 25 bp, Mus musculus
tataacaagacttcaatgcttctct

SEQ ID NO: 964751 - DNA, 25 bp, Mus musculus
tataacacagcagtcatactactgc

SEQ ID NO: 964752 - DNA, 25 bp, Mus musculus
tataacacaggagtcatactactgc

SEQ ID NO: 964753 - DNA, 25 bp, Mus musculus
tataacatgcagatattcagtgaac

SEQ ID NO: 964754 - DNA, 25 bp, Mus musculus
tataacatgcagttattcagtgaac

SEQ ID NO: 964755 - DNA, 25 bp, Mus musculus
tataaccagacactggatatttggt

SEQ ID NO: 964756 - DNA, 25 bp, Mus musculus
tataaccagacagtggatatttggt

SEQ ID NO: 964757 - DNA, 25 bp, Mus musculus
tataacgccgatatttctaccttcc

SEQ ID NO: 964758 - DNA, 25 bp, Mus musculus
tataacgccgttatttctaccttcc

SEQ ID NO: 964759 - DNA, 25 bp, Mus musculus
tataacgtctgcatactatcgtgga

SEQ ID NO: 964760 - DNA, 25 bp, Mus musculus
tataacgtctgcttactatcgtgga

SEQ ID NO: 964761 - DNA, 25 bp, Mus musculus
tataactaccagatgccaccgcagt

SEQ ID NO: 964762 - DNA, 25 bp, Mus musculus
tataactaccagccttatacaactg

SEQ ID NO: 964763 - DNA, 25 bp, Mus musculus
tataactaccaggcttatacaactg

SEQ ID NO: 964764 - DNA, 25 bp, Mus musculus
tataactaccagttgccaccgcagt

SEQ ID NO: 964765 - DNA, 25 bp, Mus musculus
tataagaagatgatccccagtgttt

SEQ ID NO: 964766 - DNA, 25 bp, Mus musculus
tataagaagatgatcgtcttcaagc

SEQ ID NO: 964767 - DNA, 25 bp, Mus musculus
tataagaagatgatgcccagtgttt

SEQ ID NO: 964768 - DNA, 25 bp, Mus musculus
tataagaagatgatggtcttcaagc

SEQ ID NO: 964769 - DNA, 25 bp, Mus musculus
tataagaagccacatgtgaactggg

SEQ ID NO: 964770 - DNA, 25 bp, Mus musculus
tataagaagccagatgtgaactggg

SEQ ID NO: 964771 - DNA, 25 bp, Mus musculus
tataagagcgagaggaggggaaaga

SEQ ID NO: 964772 - DNA, 25 bp, Mus musculus
tataagagcgtgaggaggggaaaga

SEQ ID NO: 964773 - DNA, 25 bp, Mus musculus
tataagatagagcgcggaaaaatgg

SEQ ID NO: 964774 - DNA, 25 bp, Mus musculus
tataagatagagcggggaaaaatgg

SEQ ID NO: 964775 - DNA, 25 bp, Mus musculus
tataaggagccgagagcagttcctc

SEQ ID NO: 964776 - DNA, 25 bp, Mus musculus
tataaggagccgagtgcagttcctc

SEQ ID NO: 964777 - DNA, 25 bp, Mus musculus
tataaggatgaacatggagatctta

SEQ ID NO: 964778 - DNA, 25 bp, Mus musculus
tataaggatgaagatggagatctta

SEQ ID NO: 964779 - DNA, 25 bp, Mus musculus
tataaggtagcactggccagctgcc

SEQ ID NO: 964780 - DNA, 25 bp, Mus musculus
tataaggtagcagtggccagctgcc

SEQ ID NO: 964781 - DNA, 25 bp, Mus musculus
tataaggtcaagcctgtgggccgaa

SEQ ID NO: 964782 - DNA, 25 bp, Mus musculus
tataaggtcaaggctgtgggccgaa

SEQ ID NO: 964783 - DNA, 25 bp, Mus musculus
tataataagctactagaacacagct

SEQ ID NO: 964784 - DNA, 25 bp, Mus musculus
tataataagctacttgaacacagct

SEQ ID NO: 964785 - DNA, 25 bp, Mus musculus
tataatcattcccacgtttctgtcc

SEQ ID NO: 964786 - DNA, 25 bp, Mus musculus
tataatcattcccaggtttctgtcc

SEQ ID NO: 964787 - DNA, 25 bp, Mus musculus
tataatcccaagcgatttgctgcag

SEQ ID NO: 964788 - DNA, 25 bp, Mus musculus
tataatcccaagggatttgctgcag

SEQ ID NO: 964789 - DNA, 25 bp, Mus musculus
tataatgagacaaacactggaactt

SEQ ID NO: 964790 - DNA, 25 bp, Mus musculus
tataatgagacatacactggaactt

SEQ ID NO: 964791 - DNA, 25 bp, Mus musculus
tataatgattcccatggagggacgg

SEQ ID NO: 964792 - DNA, 25 bp, Mus musculus
tataatgattccgatggagggacgg

SEQ ID NO: 964793 - DNA, 25 bp, Mus musculus
tataatgattctccttggatgtggc

SEQ ID NO: 964794 - DNA, 25 bp, Mus musculus
tataatgattgtccttggatgtggc

SEQ ID NO: 964795 - DNA, 25 bp, Mus musculus
tataatggagcctcactttgttcac

SEQ ID NO: 964796 - DNA, 25 bp, Mus musculus
tataatggaggctcactttgttcac

SEQ ID NO: 964797 - DNA, 25 bp, Mus musculus
tataattcacagaactgggaagcac

SEQ ID NO: 964798 - DNA, 25 bp, Mus musculus
tataattcacagtactgggaagcac

SEQ ID NO: 964799 - DNA, 25 bp, Mus musculus
tataattcatattgaccagcctcga

SEQ ID NO: 964800 - DNA, 25 bp, Mus musculus
tataattcattttgaccagcctcga

SEQ ID NO: 964801 - DNA, 25 bp, Mus musculus
tatacaaatcggctagataaagtgg

SEQ ID NO: 964802 - DNA, 25 bp, Mus musculus
tatacaaatcgggtagataaagtgg

SEQ ID NO: 964803 - DNA, 25 bp, Mus musculus
tatacagacatgattcacaatcgca

SEQ ID NO: 964804 - DNA, 25 bp, Mus musculus
tatacagacatgcgcagattcacaa

SEQ ID NO: 964805 - DNA, 25 bp, Mus musculus
tatacagacatgggcagattcacaa

SEQ ID NO: 964806 - DNA, 25 bp, Mus musculus
tatacagacatgtttcacaatcgca

SEQ ID NO: 964807 - DNA, 25 bp, Mus musculus
tatacagccgagggcacccgaaggc

SEQ ID NO: 964808 - DNA, 25 bp, Mus musculus
tatacagccgaggggacccgaaggc

SEQ ID NO: 964809 - DNA, 25 bp, Mus musculus
tatacataggcccttcaagagggaa

SEQ ID NO: 964810 - DNA, 25 bp, Mus musculus
tatacatagggccttcaagagggaa

SEQ ID NO: 964811 - DNA, 25 bp, Mus musculus
tataccacaaacaacgttcatgcca

SEQ ID NO: 964812 - DNA, 25 bp, Mus musculus
tataccacaaacaaggttcatgcca

SEQ ID NO: 964813 - DNA, 25 bp, Mus musculus
tataccacgagatgcccattgagcc

SEQ ID NO: 964814 - DNA, 25 bp, Mus musculus
tataccacgagatggccattgagcc

SEQ ID NO: 964815 - DNA, 25 bp, Mus musculus
tatacctacccctcaagaaaagcta

SEQ ID NO: 964816 - DNA, 25 bp, Mus musculus
tatacctacccctcaagccttcctg

SEQ ID NO: 964817 - DNA, 25 bp, Mus musculus
tatacctacccctctagaaaagcta

SEQ ID NO: 964818 - DNA, 25 bp, Mus musculus
tatacctacccctctagccttcctg

SEQ ID NO: 964819 - DNA, 25 bp, Mus musculus
tatacctccgccttatacaactgtt

SEQ ID NO: 964820 - DNA, 25 bp, Mus musculus
tatacctccggcttatacaactgtt

SEQ ID NO: 964821 - DNA, 25 bp, Mus musculus
tatacctgcttacccgtatgaccca

SEQ ID NO: 964822 - DNA, 25 bp, Mus musculus
tatacctgcttaccggtatgaccca

SEQ ID NO: 964823 - DNA, 25 bp, Mus musculus
tatacgacaaataacatgcacgcca

SEQ ID NO: 964824 - DNA, 25 bp, Mus musculus
tatacgacaaataagatgcacgcca

SEQ ID NO: 964825 - DNA, 25 bp, Mus musculus
tatactcaagctatcgcagggtgga

SEQ ID NO: 964826 - DNA, 25 bp, Mus musculus
tatactcaaggtatcgcagggtgga

SEQ ID NO: 964827 - DNA, 25 bp, Mus musculus
tatactctacgacacgaacctgcca

SEQ ID NO: 964828 - DNA, 25 bp, Mus musculus
tatactctacgacaggaacctgcca

SEQ ID NO: 964829 - DNA, 25 bp, Mus musculus
tatactggttcctttgtatgtatcc

SEQ ID NO: 964830 - DNA, 25 bp, Mus musculus
tatactggttgctttgtatgtatcc

SEQ ID NO: 964831 - DNA, 25 bp, Mus musculus
tatactgtgacacgagggctggcgg

SEQ ID NO: 964832 - DNA, 25 bp, Mus musculus
tatactgtgacaggagggctggcgg

SEQ ID NO: 964833 - DNA, 25 bp, Mus musculus
tatacttagacacgtatccattatg

SEQ ID NO: 964834 - DNA, 25 bp, Mus musculus
tatacttagacaggtatccattatg

SEQ ID NO: 964835 - DNA, 25 bp, Mus musculus
tatagaaaggccgctttcgttgctg

SEQ ID NO: 964836 - DNA, 25 bp, Mus musculus
tatagaaaggctgaaggcactgggc

SEQ ID NO: 964837 - DNA, 25 bp, Mus musculus
tatagaaagggcgctttcgttgctg

SEQ ID NO: 964838 - DNA, 25 bp, Mus musculus
tatagaaagggtgaaggcactgggc

SEQ ID NO: 964839 - DNA, 25 bp, Mus musculus
tatagaagcaacaacgtgctccgcc

SEQ ID NO: 964840 - DNA, 25 bp, Mus musculus
tatagaagcaacaaggtgctccgcc

SEQ ID NO: 964841 - DNA, 25 bp, Mus musculus
tatagagcagaaccaaatatgcccc

SEQ ID NO: 964842 - DNA, 25 bp, Mus musculus
tatagagcagtaccaaatatgcccc

SEQ ID NO: 964843 - DNA, 25 bp, Mus musculus
tatagataaaaatgtcatggaaaac

SEQ ID NO: 964844 - DNA, 25 bp, Mus musculus
tatagataaatatgtcatggaaaac

SEQ ID NO: 964845 - DNA, 25 bp, Mus musculus
tatagcatagcaaaccttcaaaaga

SEQ ID NO: 964846 - DNA, 25 bp, Mus musculus
tatagcataggaaaccttcaaaaga

SEQ ID NO: 964847 - DNA, 25 bp, Mus musculus
tatagcccactgagaggagcttcca

SEQ ID NO: 964848 - DNA, 25 bp, Mus musculus
tatagcccactgtgaggagcttcca

SEQ ID NO: 964849 - DNA, 25 bp, Mus musculus
tatagcgccaagactggagaggtgt

SEQ ID NO: 964850 - DNA, 25 bp, Mus musculus
tatagcgccaagtctggagaggtgt

SEQ ID NO: 964851 - DNA, 25 bp, Mus musculus
tatagctcagctacagctgacagtg

SEQ ID NO: 964852 - DNA, 25 bp, Mus musculus
tatagctcaggtacagctgacagtg

SEQ ID NO: 964853 - DNA, 25 bp, Mus musculus
tatagctcgccacggcgaagattgt

SEQ ID NO: 964854 - DNA, 25 bp, Mus musculus
tatagctcgccagggcgaagattgt

SEQ ID NO: 964855 - DNA, 25 bp, Mus musculus
tatagctctcagctcagtacaagcc

SEQ ID NO: 964856 - DNA, 25 bp, Mus musculus
tatagctctccaggtcaatggccaa

SEQ ID NO: 964857 - DNA, 25 bp, Mus musculus
tatagctctcgaggtcaatggccaa

SEQ ID NO: 964858 - DNA, 25 bp, Mus musculus
tatagctctctgctcagtacaagcc

SEQ ID NO: 964859 - DNA, 25 bp, Mus musculus
tatagctgcgaacgctctgaggatg

SEQ ID NO: 964860 - DNA, 25 bp, Mus musculus
tatagctgcgaaggctctgaggatg

SEQ ID NO: 964861 - DNA, 25 bp, Mus musculus
tatagggatgtgatcctctttctca

SEQ ID NO: 964862 - DNA, 25 bp, Mus musculus
tatagggatgtgatgctctttctca

SEQ ID NO: 964863 - DNA, 25 bp, Mus musculus
tatagtcaaagactgtgttgatgga

SEQ ID NO: 964864 - DNA, 25 bp, Mus musculus
tatagtcaaagagtgtgttgatgga

SEQ ID NO: 964865 - DNA, 25 bp, Mus musculus
tatagtcatgctggatgaaagccag

SEQ ID NO: 964866 - DNA, 25 bp, Mus musculus
tatagtcatggtggatgaaagccag

SEQ ID NO: 964867 - DNA, 25 bp, Mus musculus
tatagtgttatgatttgattccacg

SEQ ID NO: 964868 - DNA, 25 bp, Mus musculus
tatagtgttatgttttgattccacg

SEQ ID NO: 964869 - DNA, 25 bp, Mus musculus
tatagttcagccatctactatgaac

SEQ ID NO: 964870 - DNA, 25 bp, Mus musculus
tatagttcaggcatctactatgaac

SEQ ID NO: 964871 - DNA, 25 bp, Mus musculus
tatatactcaagctatcgcagggtg

SEQ ID NO: 964872 - DNA, 25 bp, Mus musculus
tatatactcaaggtatcgcagggtg

SEQ ID NO: 964873 - DNA, 25 bp, Mus musculus
tatatatgagcgttaccaaggcttg

SEQ ID NO: 964874 - DNA, 25 bp, Mus musculus
tatatatgagggttaccaaggcttg

SEQ ID NO: 964875 - DNA, 25 bp, Mus musculus
tatatcaagaagcaatttgacaaga

SEQ ID NO: 964876 - DNA, 25 bp, Mus musculus
tatatcaagaaggaatttgacaaga

SEQ ID NO: 964877 - DNA, 25 bp, Mus musculus
tatatcaatgagacacacaccggga

SEQ ID NO: 964878 - DNA, 25 bp, Mus musculus
tatatcaatgagtcacacaccggga

SEQ ID NO: 964879 - DNA, 25 bp, Mus musculus
tatatcacacaaaaattccagaggt

SEQ ID NO: 964880 - DNA, 25 bp, Mus musculus
tatatcacacaaagacccacagtta

SEQ ID NO: 964881 - DNA, 25 bp, Mus musculus
tatatcacacaataattccagaggt

SEQ ID NO: 964882 - DNA, 25 bp, Mus musculus
tatatcacacaatgacccacagtta

SEQ ID NO: 964883 - DNA, 25 bp, Mus musculus
tatatcaccaaacctgaaaggggtc

SEQ ID NO: 964884 - DNA, 25 bp, Mus musculus
tatatcaccaaactcctgaagggga

SEQ ID NO: 964885 - DNA, 25 bp, Mus musculus
tatatcaccaaagctgaaaggggtc

SEQ ID NO: 964886 - DNA, 25 bp, Mus musculus
tatatcaccaaagtcctgaagggga

SEQ ID NO: 964887 - DNA, 25 bp, Mus musculus
tatatcacggctgggactttaatcc

SEQ ID NO: 964888 - DNA, 25 bp, Mus musculus
tatatcacgggtgggactttaatcc

SEQ ID NO: 964889 - DNA, 25 bp, Mus musculus
tatatcatccaccacacgggaagta

SEQ ID NO: 964890 - DNA, 25 bp, Mus musculus
tatatcatccaccagacgggaagta

SEQ ID NO: 964891 - DNA, 25 bp, Mus musculus
tatatccaattcaacactacagtgt

SEQ ID NO: 964892 - DNA, 25 bp, Mus musculus
tatatccaattcaagactacagtgt

SEQ ID NO: 964893 - DNA, 25 bp, Mus musculus
tatatccttctactgttgggcaacc

SEQ ID NO: 964894 - DNA, 25 bp, Mus musculus
tatatccttctagtgttgggcaacc

SEQ ID NO: 964895 - DNA, 25 bp, Mus musculus
tatatcggagacacagcttcatgag

SEQ ID NO: 964896 - DNA, 25 bp, Mus musculus
tatatcggagtcacagcttcatgag

SEQ ID NO: 964897 - DNA, 25 bp, Mus musculus
tatatctcattggacgctccatccc

SEQ ID NO: 964898 - DNA, 25 bp, Mus musculus
tatatctcattggaggctccatccc

SEQ ID NO: 964899 - DNA, 25 bp, Mus musculus
tatatcttcaatcaaattacacttg

SEQ ID NO: 964900 - DNA, 25 bp, Mus musculus
tatatcttcaatcgtctgacagtct

SEQ ID NO: 964901 - DNA, 25 bp, Mus musculus
tatatcttcaatgaaattacacttg

SEQ ID NO: 964902 - DNA, 25 bp, Mus musculus
tatatcttcaatggtctgacagtct

SEQ ID NO: 964903 - DNA, 25 bp, Mus musculus
tatatctttccttttggcttggttc

SEQ ID NO: 964904 - DNA, 25 bp, Mus musculus
tatatctttcgttttggcttggttc

SEQ ID NO: 964905 - DNA, 25 bp, Mus musculus
tatatgaagataaaccaccaaacac

SEQ ID NO: 964906 - DNA, 25 bp, Mus musculus
tatatgaagataaagcaccaaacac

SEQ ID NO: 964907 - DNA, 25 bp, Mus musculus
tatatgctggtggacctcatcctct

SEQ ID NO: 964908 - DNA, 25 bp, Mus musculus
tatatgctggtggagctcatcctct

SEQ ID NO: 964909 - DNA, 25 bp, Mus musculus
tatatggatgctcatctttggtgtc

SEQ ID NO: 964910 - DNA, 25 bp, Mus musculus
tatatggatggtatcctcatctttg

SEQ ID NO: 964911 - DNA, 25 bp, Mus musculus
tatatggatggtatgctcatctttg

SEQ ID NO: 964912 - DNA, 25 bp, Mus musculus
tatatggatggtcatctttggtgtc

SEQ ID NO: 964913 - DNA, 25 bp, Mus musculus
tatatgtataacaacgattctcaaa

SEQ ID NO: 964914 - DNA, 25 bp, Mus musculus
tatatgtataacaaggattctcaaa

SEQ ID NO: 964915 - DNA, 25 bp, Mus musculus
tatatgtgctagccaccagccccca

SEQ ID NO: 964916 - DNA, 25 bp, Mus musculus
tatatgtgctaggcaccagccccca

SEQ ID NO: 964917 - DNA, 25 bp, Mus musculus
tatattcaaccacctgtgaccatag

SEQ ID NO: 964918 - DNA, 25 bp, Mus musculus
tatattcaaccagctgtgaccatag

SEQ ID NO: 964919 - DNA, 25 bp, Mus musculus
tatattcaagcttggatggagtact

SEQ ID NO: 964920 - DNA, 25 bp, Mus musculus
tatattcaaggttggatggagtact

SEQ ID NO: 964921 - DNA, 25 bp, Mus musculus
tatattcgggagcacatagaatgga

SEQ ID NO: 964922 - DNA, 25 bp, Mus musculus
tatattcgggaggacatagaatgga

SEQ ID NO: 964923 - DNA, 25 bp, Mus musculus
tatattgagaaacttgttgcaatat

SEQ ID NO: 964924 - DNA, 25 bp, Mus musculus
tatattgagaaagttgttgcaatat

SEQ ID NO: 964925 - DNA, 25 bp, Mus musculus
tatattttatttatttcagtaatgt

SEQ ID NO: 964926 - DNA, 25 bp, Mus musculus
tatattttatttttttcagtaatgt

SEQ ID NO: 964927 - DNA, 25 bp, Mus musculus
tatatttttacacggaggagcctcg

SEQ ID NO: 964928 - DNA, 25 bp, Mus musculus
tatatttttacagggaggagcctcg

SEQ ID NO: 964929 - DNA, 25 bp, Mus musculus
tatcaaaaagcgaatcttacttcag

SEQ ID NO: 964930 - DNA, 25 bp, Mus musculus
tatcaaaaagggaatcttacttcag

SEQ ID NO: 964931 - DNA, 25 bp, Mus musculus
tatcaaaaccaaacaatttgctcct

SEQ ID NO: 964932 - DNA, 25 bp, Mus musculus
tatcaaaaccaaactatttgctcct

SEQ ID NO: 964933 - DNA, 25 bp, Mus musculus
tatcaaaccaccatttggcaccaac

SEQ ID NO: 964934 - DNA, 25 bp, Mus musculus
tatcaaaccagcatttggcaccaac

SEQ ID NO: 964935 - DNA, 25 bp, Mus musculus
tatcaaactgctgaaagcgctgaga

SEQ ID NO: 964936 - DNA, 25 bp, Mus musculus
tatcaaactgctgatagcgctgaga

SEQ ID NO: 964937 - DNA, 25 bp, Mus musculus
tatcaaagagcatgtctcggaacta

SEQ ID NO: 964938 - DNA, 25 bp, Mus musculus
tatcaaagaggatgtctcggaacta

SEQ ID NO: 964939 - DNA, 25 bp, Mus musculus
tatcaaagaggcctatatgcgatct

SEQ ID NO: 964940 - DNA, 25 bp, Mus musculus
tatcaaagaggcgtatatgcgatct

SEQ ID NO: 964941 - DNA, 25 bp, Mus musculus
tatcaaagccagattaatcaaattc

SEQ ID NO: 964942 - DNA, 25 bp, Mus musculus
tatcaaagccagtttaatcaaattc

SEQ ID NO: 964943 - DNA, 25 bp, Mus musculus
tatcaaatgaaacgttctggagaag

SEQ ID NO: 964944 - DNA, 25 bp, Mus musculus
tatcaaatgaaaggttctggagaag

SEQ ID NO: 964945 - DNA, 25 bp, Mus musculus
tatcaacaagaacgaccccagcact

SEQ ID NO: 964946 - DNA, 25 bp, Mus musculus
tatcaacaagaaggaccccagcact

SEQ ID NO: 964947 - DNA, 25 bp, Mus musculus
tatcaacaagcctcttattgttgta

SEQ ID NO: 964948 - DNA, 25 bp, Mus musculus
tatcaacaagcttgtgctgtgtggt

SEQ ID NO: 964949 - DNA, 25 bp, Mus musculus
tatcaacaaggctcttattgttgta

SEQ ID NO: 964950 - DNA, 25 bp, Mus musculus
tatcaacaaggttgtgctgtgtggt

SEQ ID NO: 964951 - DNA, 25 bp, Mus musculus
tatcaacgagaactgtattggcaat

SEQ ID NO: 964952 - DNA, 25 bp, Mus musculus
tatcaacgagtactgtattggcaat

SEQ ID NO: 964953 - DNA, 25 bp, Mus musculus
tatcaactgcaactttcaggaaaag

SEQ ID NO: 964954 - DNA, 25 bp, Mus musculus
tatcaactgcaagtttcaggaaaag

SEQ ID NO: 964955 - DNA, 25 bp, Mus musculus
tatcaagaagcaatttgacaagaaa

SEQ ID NO: 964956 - DNA, 25 bp, Mus musculus
tatcaagaagcagtttgacaagaag

SEQ ID NO: 964957 - DNA, 25 bp, Mus musculus
tatcaagaagccctggctgtcctgg

SEQ ID NO: 964958 - DNA, 25 bp, Mus musculus
tatcaagaagcgtgtgactgagtgt

SEQ ID NO: 964959 - DNA, 25 bp, Mus musculus
tatcaagaaggaatttgacaagaaa

SEQ ID NO: 964960 - DNA, 25 bp, Mus musculus
tatcaagaaggagtttgacaagaag

SEQ ID NO: 964961 - DNA, 25 bp, Mus musculus
tatcaagaaggcctggctgtcctgg

SEQ ID NO: 964962 - DNA, 25 bp, Mus musculus
tatcaagaagggtgtgactgagtgt

SEQ ID NO: 964963 - DNA, 25 bp, Mus musculus
tatcaagaattccaatatgtgagct

SEQ ID NO: 964964 - DNA, 25 bp, Mus musculus
tatcaagaattccattatgtgagct

SEQ ID NO: 964965 - DNA, 25 bp, Mus musculus
tatcaagctgcagcccatcaagtcc

SEQ ID NO: 964966 - DNA, 25 bp, Mus musculus
tatcaagctggagcccatcaagtcc

SEQ ID NO: 964967 - DNA, 25 bp, Mus musculus
tatcaataatcccacttatcggcag

SEQ ID NO: 964968 - DNA, 25 bp, Mus musculus
tatcaataatcccagttatcggcag

SEQ ID NO: 964969 - DNA, 25 bp, Mus musculus
tatcaatgactacccaccagtgaag

SEQ ID NO: 964970 - DNA, 25 bp, Mus musculus
tatcaatgactaccgaccagtgaag

SEQ ID NO: 964971 - DNA, 25 bp, Mus musculus
tatcaatgagacacacaccgggact

SEQ ID NO: 964972 - DNA, 25 bp, Mus musculus
tatcaatgagtcacacaccgggact

SEQ ID NO: 964973 - DNA, 25 bp, Mus musculus
tatcacaacaagattgaggaagaca

SEQ ID NO: 964974 - DNA, 25 bp, Mus musculus
tatcacaacaagccccatctgctca

SEQ ID NO: 964975 - DNA, 25 bp, Mus musculus
tatcacaacaaggcccatctgctca

SEQ ID NO: 964976 - DNA, 25 bp, Mus musculus
tatcacaacaagtttgaggaagaca

SEQ ID NO: 964977 - DNA, 25 bp, Mus musculus
tatcacacagcaactgaagaggaag

SEQ ID NO: 964978 - DNA, 25 bp, Mus musculus
tatcacacaggaactgaagaggaag

SEQ ID NO: 964979 - DNA, 25 bp, Mus musculus
tatcacagacacgtgcgaccgcatt

SEQ ID NO: 964980 - DNA, 25 bp, Mus musculus
tatcacagaccatctagaagcaaga

SEQ ID NO: 964981 - DNA, 25 bp, Mus musculus
tatcacagacgatctagaagcaaga

SEQ ID NO: 964982 - DNA, 25 bp, Mus musculus
tatcacagactcgtgcgaccgcatt

SEQ ID NO: 964983 - DNA, 25 bp, Mus musculus
tatcaccatggtgacatgtcactga

SEQ ID NO: 964984 - DNA, 25 bp, Mus musculus
tatcaccatggtgagatgtcactga

SEQ ID NO: 964985 - DNA, 25 bp, Mus musculus
tatcaccttccacaactctgcagcc

SEQ ID NO: 964986 - DNA, 25 bp, Mus musculus
tatcaccttccacactcagaacttt

SEQ ID NO: 964987 - DNA, 25 bp, Mus musculus
tatcaccttccacgctcaaactacc

SEQ ID NO: 964988 - DNA, 25 bp, Mus musculus
tatcaccttccagaactctgcagcc

SEQ ID NO: 964989 - DNA, 25 bp, Mus musculus
tatcaccttccagactcagaacttt

SEQ ID NO: 964990 - DNA, 25 bp, Mus musculus
tatcaccttccaggctcaaactacc

SEQ ID NO: 964991 - DNA, 25 bp, Mus musculus
tatcacgactctgacgaagcaggct

SEQ ID NO: 964992 - DNA, 25 bp, Mus musculus
tatcacgactctgaggaagcaggct

SEQ ID NO: 964993 - DNA, 25 bp, Mus musculus
tatcactgagaaaaacattgcaaat

SEQ ID NO: 964994 - DNA, 25 bp, Mus musculus
tatcactgagcagaaaaacattgca

SEQ ID NO: 964995 - DNA, 25 bp, Mus musculus
tatcactgaggagaaaaacattgca

SEQ ID NO: 964996 - DNA, 25 bp, Mus musculus
tatcactgagtaaaacattgcaaat

SEQ ID NO: 964997 - DNA, 25 bp, Mus musculus
tatcagaaagctgttcctggtgctg

SEQ ID NO: 964998 - DNA, 25 bp, Mus musculus
tatcagaaaggtgttcctggtgctg

SEQ ID NO: 964999 - DNA, 25 bp, Mus musculus
tatcagacagctctagctgtttcca

SEQ ID NO: 965000 - DNA, 25 bp, Mus musculus
tatcagacagctcttgctgtttcca

SEQ ID NO: 965001 - DNA, 25 bp, Mus musculus
tatcagagaaagctggaagctccct

SEQ ID NO: 965002 - DNA, 25 bp, Mus musculus
tatcagagaaaggtggaagctccct

SEQ ID NO: 965003 - DNA, 25 bp, Mus musculus
tatcagatgcagcttgcgttacagt

SEQ ID NO: 965004 - DNA, 25 bp, Mus musculus
tatcagatgcaggttgcgttacagt

SEQ ID NO: 965005 - DNA, 25 bp, Mus musculus
tatcagcacgcacgattccggagct

SEQ ID NO: 965006 - DNA, 25 bp, Mus musculus
tatcagcacgcgtcacccagaagcg

SEQ ID NO: 965007 - DNA, 25 bp, Mus musculus
tatcagcacggacgattccggagct

SEQ ID NO: 965008 - DNA, 25 bp, Mus musculus
tatcagcacgggtcacccagaagcg

SEQ ID NO: 965009 - DNA, 25 bp, Mus musculus
tatcagctagcatcgggacagaaag

SEQ ID NO: 965010 - DNA, 25 bp, Mus musculus
tatcagctaggatcgggacagaaag

SEQ ID NO: 965011 - DNA, 25 bp, Mus musculus
tatcagctgcagctggccaagacga

SEQ ID NO: 965012 - DNA, 25 bp, Mus musculus
tatcagctgcaggtggccaagacga

SEQ ID NO: 965013 - DNA, 25 bp, Mus musculus
tatcagtctcagcatcctcatgtgt

SEQ ID NO: 965014 - DNA, 25 bp, Mus musculus
tatcagtctcaggatcctcatgtgt

SEQ ID NO: 965015 - DNA, 25 bp, Mus musculus
tatcagtgccatcacatcgacgagt

SEQ ID NO: 965016 - DNA, 25 bp, Mus musculus
tatcagtgccatgacatcgacgagt

SEQ ID NO: 965017 - DNA, 25 bp, Mus musculus
tatcagtggattctcaccacctcat

SEQ ID NO: 965018 - DNA, 25 bp, Mus musculus
tatcagtggattctgaccacctcat

SEQ ID NO: 965019 - DNA, 25 bp, Mus musculus
tatcagttctcacacttggattcag

SEQ ID NO: 965020 - DNA, 25 bp, Mus musculus
tatcagttctcagacttggattcag

SEQ ID NO: 965021 - DNA, 25 bp, Mus musculus
tatcataccgcgacagaagaggagg

SEQ ID NO: 965022 - DNA, 25 bp, Mus musculus
tatcataccgggacagaagaggagg

SEQ ID NO: 965023 - DNA, 25 bp, Mus musculus
tatcatcattgcaggtcccccagga

SEQ ID NO: 965024 - DNA, 25 bp, Mus musculus
tatcatcattgctggtcccccagga

SEQ ID NO: 965025 - DNA, 25 bp, Mus musculus
tatcatccaccacacgggaagtaaa

SEQ ID NO: 965026 - DNA, 25 bp, Mus musculus
tatcatccaccagacgggaagtaaa

SEQ ID NO: 965027 - DNA, 25 bp, Mus musculus
tatcatccagctcggtggcaccatt

SEQ ID NO: 965028 - DNA, 25 bp, Mus musculus
tatcatccagctgggtggcaccatt

SEQ ID NO: 965029 - DNA, 25 bp, Mus musculus
tatcatctcaagagtttcacatgtt

SEQ ID NO: 965030 - DNA, 25 bp, Mus musculus
tatcatctcaagtgtttcacatgtt

SEQ ID NO: 965031 - DNA, 25 bp, Mus musculus
tatcatctcacatggaggctgcagc

SEQ ID NO: 965032 - DNA, 25 bp, Mus musculus
tatcatctcagatggaggctgcagc

SEQ ID NO: 965033 - DNA, 25 bp, Mus musculus
tatcatgaactcagcctcagcatct

SEQ ID NO: 965034 - DNA, 25 bp, Mus musculus
tatcatgaactctgcctcagcatct

SEQ ID NO: 965035 - DNA, 25 bp, Mus musculus
tatcatgaagaaattagaagagttg

SEQ ID NO: 965036 - DNA, 25 bp, Mus musculus
tatcatgaagtaattagaagagttg

SEQ ID NO: 965037 - DNA, 25 bp, Mus musculus
tatcatggtgcactaccatgcacta

SEQ ID NO: 965038 - DNA, 25 bp, Mus musculus
tatcatggtgcagtaccatgcacta

SEQ ID NO: 965039 - DNA, 25 bp, Mus musculus
tatcatgtcaatcacctggtcacct

SEQ ID NO: 965040 - DNA, 25 bp, Mus musculus
tatcatgtcaatgacctggtcacct

SEQ ID NO: 965041 - DNA, 25 bp, Mus musculus
tatcatgtcttcaactaaaggatct

SEQ ID NO: 965042 - DNA, 25 bp, Mus musculus
tatcatgtcttcaagtaaaggatct

SEQ ID NO: 965043 - DNA, 25 bp, Mus musculus
tatcatgttatatcatgtctccgac

SEQ ID NO: 965044 - DNA, 25 bp, Mus musculus
tatcatgttatatcttgtctccgac

SEQ ID NO: 965045 - DNA, 25 bp, Mus musculus
tatcatgttggtgacactgaactca

SEQ ID NO: 965046 - DNA, 25 bp, Mus musculus
tatcatgttggtgagactgaactca

SEQ ID NO: 965047 - DNA, 25 bp, Mus musculus
tatcattagcaacgctgttcctggg

SEQ ID NO: 965048 - DNA, 25 bp, Mus musculus
tatcattagcaaggctgttcctggg

SEQ ID NO: 965049 - DNA, 25 bp, Mus musculus
tatcattgagggcaccctggacact

SEQ ID NO: 965050 - DNA, 25 bp, Mus musculus
tatcattgagggcagcctggacact

SEQ ID NO: 965051 - DNA, 25 bp, Mus musculus
tatcatttcacactggttatgactt

SEQ ID NO: 965052 - DNA, 25 bp, Mus musculus
tatcatttcacagtggttatgactt

SEQ ID NO: 965053 - DNA, 25 bp, Mus musculus
tatcatttttaatcagtctgttatc

SEQ ID NO: 965054 - DNA, 25 bp, Mus musculus
tatcatttttaatctgtctgttatc

SEQ ID NO: 965055 - DNA, 25 bp, Mus musculus
tatccaactcagcttctcggtaaat

SEQ ID NO: 965056 - DNA, 25 bp, Mus musculus
tatccaactcaggttctcggtaaat

SEQ ID NO: 965057 - DNA, 25 bp, Mus musculus
tatccaagccagagcccgccactaa

SEQ ID NO: 965058 - DNA, 25 bp, Mus musculus
tatccaagccagtgcccgccactaa

SEQ ID NO: 965059 - DNA, 25 bp, Mus musculus
tatccaagtaatcagaggaagacga

SEQ ID NO: 965060 - DNA, 25 bp, Mus musculus
tatccaagtaatgagaggaagacga

SEQ ID NO: 965061 - DNA, 25 bp, Mus musculus
tatccaattcaacactacagtgtgc

SEQ ID NO: 965062 - DNA, 25 bp, Mus musculus
tatccaattcaagactacagtgtgc

SEQ ID NO: 965063 - DNA, 25 bp, Mus musculus
tatccacatatgcaacagccttaca

SEQ ID NO: 965064 - DNA, 25 bp, Mus musculus
tatccacatatggaacagccttaca

SEQ ID NO: 965065 - DNA, 25 bp, Mus musculus
tatccagcaatgatgttcgtgtcac

SEQ ID NO: 965066 - DNA, 25 bp, Mus musculus
tatccagcaatgttgttcgtgtcac

SEQ ID NO: 965067 - DNA, 25 bp, Mus musculus
tatccagcagagatgttcagcctgt

SEQ ID NO: 965068 - DNA, 25 bp, Mus musculus
tatccagcagagccatggaactgtt

SEQ ID NO: 965069 - DNA, 25 bp, Mus musculus
tatccagcagagttgttcagcctgt

SEQ ID NO: 965070 - DNA, 25 bp, Mus musculus
tatccagcagtgagcgacttgaaag

SEQ ID NO: 965071 - DNA, 25 bp, Mus musculus
tatccagcagtgagggacttgaaag

SEQ ID NO: 965072 - DNA, 25 bp, Mus musculus
tatccagcagtgccatggaactgtt

SEQ ID NO: 965073 - DNA, 25 bp, Mus musculus
tatccaggaccccgctgacacttgg

SEQ ID NO: 965074 - DNA, 25 bp, Mus musculus
tatccaggacccggctgacacttgg

SEQ ID NO: 965075 - DNA, 25 bp, Mus musculus
tatccagggtgactatatgattcct

SEQ ID NO: 965076 - DNA, 25 bp, Mus musculus
tatccagggtgagtatatgattcct

SEQ ID NO: 965077 - DNA, 25 bp, Mus musculus
tatccagtcgcccctcccagagacc

SEQ ID NO: 965078 - DNA, 25 bp, Mus musculus
tatccagtcgccttctccttgcagc

SEQ ID NO: 965079 - DNA, 25 bp, Mus musculus
tatccagtcggccctcccagagacc

SEQ ID NO: 965080 - DNA, 25 bp, Mus musculus
tatccagtcggcttctccttgcagc

SEQ ID NO: 965081 - DNA, 25 bp, Mus musculus
tatccatagtcacacgcccgacctg

SEQ ID NO: 965082 - DNA, 25 bp, Mus musculus
tatccatagtcacaggcccgacctg

SEQ ID NO: 965083 - DNA, 25 bp, Mus musculus
tatccatgcgcctgtgtggagatgg

SEQ ID NO: 965084 - DNA, 25 bp, Mus musculus
tatccatgcggctgtgtggagatgg

SEQ ID NO: 965085 - DNA, 25 bp, Mus musculus
tatcccacagactcagaaccgtgct

SEQ ID NO: 965086 - DNA, 25 bp, Mus musculus
tatcccacagtctcagaaccgtgct

SEQ ID NO: 965087 - DNA, 25 bp, Mus musculus
tatcccacgggagactcctaccagg

SEQ ID NO: 965088 - DNA, 25 bp, Mus musculus
tatcccacgggagagtcctaccagg

SEQ ID NO: 965089 - DNA, 25 bp, Mus musculus
tatcccagttctcacagccccgtat

SEQ ID NO: 965090 - DNA, 25 bp, Mus musculus
tatcccagttctcagagccccgtat

SEQ ID NO: 965091 - DNA, 25 bp, Mus musculus
tatcccctatgcctcgtgtgcccca

SEQ ID NO: 965092 - DNA, 25 bp, Mus musculus
tatcccctatgcctggtgtgcccca

SEQ ID NO: 965093 - DNA, 25 bp, Mus musculus
tatccctctggacacttgctgatta

SEQ ID NO: 965094 - DNA, 25 bp, Mus musculus
tatccctctggacagttgctgatta

SEQ ID NO: 965095 - DNA, 25 bp, Mus musculus
tatccctgccctcacggaggagttt

SEQ ID NO: 965096 - DNA, 25 bp, Mus musculus
tatccctgccctgacggaggagttt

SEQ ID NO: 965097 - DNA, 25 bp, Mus musculus
tatccgaatgtggacgccagtgctc

SEQ ID NO: 965098 - DNA, 25 bp, Mus musculus
tatccgaatgtggaggccagtgctc

SEQ ID NO: 965099 - DNA, 25 bp, Mus musculus
tatccggtgtaacgatgatgaattc

SEQ ID NO: 965100 - DNA, 25 bp, Mus musculus
tatccggtgtaaggatgatgaattc

SEQ ID NO: 965101 - DNA, 25 bp, Mus musculus
tatccgtggactgggtcacgccatc

SEQ ID NO: 965102 - DNA, 25 bp, Mus musculus
tatccgtggagtgggtcacgccatc

SEQ ID NO: 965103 - DNA, 25 bp, Mus musculus
tatcctaaatttaactatgcagtac

SEQ ID NO: 965104 - DNA, 25 bp, Mus musculus
tatcctaaatttaagtatgcagtac

SEQ ID NO: 965105 - DNA, 25 bp, Mus musculus
tatcctatgcacactcatgaacaag

SEQ ID NO: 965106 - DNA, 25 bp, Mus musculus
tatcctatgcactctcatgaacaag

SEQ ID NO: 965107 - DNA, 25 bp, Mus musculus
tatcctgaagtgattttcctcgcat

SEQ ID NO: 965108 - DNA, 25 bp, Mus musculus
tatcctgaagtgtttttcctcgcat

SEQ ID NO: 965109 - DNA, 25 bp, Mus musculus
tatcctgagcaaaggctacaacaag

SEQ ID NO: 965110 - DNA, 25 bp, Mus musculus
tatcctgagcaatggctacaacaag

SEQ ID NO: 965111 - DNA, 25 bp, Mus musculus
tatcctgaggatgcaggtcagcaat

SEQ ID NO: 965112 - DNA, 25 bp, Mus musculus
tatcctgaggttgcaggtcagcaat

SEQ ID NO: 965113 - DNA, 25 bp, Mus musculus
tatccttaaaacaactaactccatc

SEQ ID NO: 965114 - DNA, 25 bp, Mus musculus
tatccttaaaacaagtaactccatc

SEQ ID NO: 965115 - DNA, 25 bp, Mus musculus
tatccttaagcatcggggcttctgt

SEQ ID NO: 965116 - DNA, 25 bp, Mus musculus
tatccttaaggatcggggcttctgt

SEQ ID NO: 965117 - DNA, 25 bp, Mus musculus
tatccttcacagcatttggaagctc

SEQ ID NO: 965118 - DNA, 25 bp, Mus musculus
tatccttcacaggatttggaagctc

SEQ ID NO: 965119 - DNA, 25 bp, Mus musculus
tatccttggagaatcgttataagta

SEQ ID NO: 965120 - DNA, 25 bp, Mus musculus
tatccttggagaatggttataagta

SEQ ID NO: 965121 - DNA, 25 bp, Mus musculus
tatcctttctctgacgtcctggcct

SEQ ID NO: 965122 - DNA, 25 bp, Mus musculus
tatcctttctctgaggtcctggcct

SEQ ID NO: 965123 - DNA, 25 bp, Mus musculus
tatcgaggagccagcgggccgtgaa

SEQ ID NO: 965124 - DNA, 25 bp, Mus musculus
tatcgaggaggcagcgggccgtgaa

SEQ ID NO: 965125 - DNA, 25 bp, Mus musculus
tatcgagtttgagtaagaggtgact

SEQ ID NO: 965126 - DNA, 25 bp, Mus musculus
tatcgagtttgagttagaggtgact

SEQ ID NO: 965127 - DNA, 25 bp, Mus musculus
tatcgcatttttcaataatgtatat

SEQ ID NO: 965128 - DNA, 25 bp, Mus musculus
tatcgcatttttcattaatgtatat

SEQ ID NO: 965129 - DNA, 25 bp, Mus musculus
tatcgccaggatcatcccagctacc

SEQ ID NO: 965130 - DNA, 25 bp, Mus musculus
tatcgccaggatgatcccagctacc

SEQ ID NO: 965131 - DNA, 25 bp, Mus musculus
tatcgccccctgccaggtgatgctt

SEQ ID NO: 965132 - DNA, 25 bp, Mus musculus
tatcgccccctggcaggtgatgctt

SEQ ID NO: 965133 - DNA, 25 bp, Mus musculus
tatcgcctccagcacggccctggtc

SEQ ID NO: 965134 - DNA, 25 bp, Mus musculus
tatcgcctccagcagggccctggtc

SEQ ID NO: 965135 - DNA, 25 bp, Mus musculus
tatcggattcacaaataaagtggtg

SEQ ID NO: 965136 - DNA, 25 bp, Mus musculus
tatcggattcactaataaagtggtg

SEQ ID NO: 965137 - DNA, 25 bp, Mus musculus
tatcggccccaacgatggaatgcag

SEQ ID NO: 965138 - DNA, 25 bp, Mus musculus
tatcggccccaaggatggaatgcag

SEQ ID NO: 965139 - DNA, 25 bp, Mus musculus
tatcgggcttcacggggctgaggcg

SEQ ID NO: 965140 - DNA, 25 bp, Mus musculus
tatcgggcttcagggggctgaggcg

SEQ ID NO: 965141 - DNA, 25 bp, Mus musculus
tatcgggggccaccgttatcaggca

SEQ ID NO: 965142 - DNA, 25 bp, Mus musculus
tatcgggggccagcgttatcaggca

SEQ ID NO: 965143 - DNA, 25 bp, Mus musculus
tatcgtcaagtactcgttgggtggt

SEQ ID NO: 965144 - DNA, 25 bp, Mus musculus
tatcgtcaagtactcgtttacagga

SEQ ID NO: 965145 - DNA, 25 bp, Mus musculus
tatcgtcaagtactggttgggtggt

SEQ ID NO: 965146 - DNA, 25 bp, Mus musculus
tatcgtcaagtactggtttacagga

SEQ ID NO: 965147 - DNA, 25 bp, Mus musculus
tatcgtgaagctgcacaggatctac

SEQ ID NO: 965148 - DNA, 25 bp, Mus musculus
tatcgtgaagcttatcaagaaaatt

SEQ ID NO: 965149 - DNA, 25 bp, Mus musculus
tatcgtgaaggtgcacaggatctac

SEQ ID NO: 965150 - DNA, 25 bp, Mus musculus
tatcgtgaaggttatcaagaaaatt

SEQ ID NO: 965151 - DNA, 25 bp, Mus musculus
tatcgttatgttcattcacaatgac

SEQ ID NO: 965152 - DNA, 25 bp, Mus musculus
tatcgttatgttgattcacaatgac

SEQ ID NO: 965153 - DNA, 25 bp, Mus musculus
tatctaaccagcagatagtctacat

SEQ ID NO: 965154 - DNA, 25 bp, Mus musculus
tatctaaccagctgatagtctacat

SEQ ID NO: 965155 - DNA, 25 bp, Mus musculus
tatctaccaacacaaattcagtgta

SEQ ID NO: 965156 - DNA, 25 bp, Mus musculus
tatctaccaacacatattcagtgta

SEQ ID NO: 965157 - DNA, 25 bp, Mus musculus
tatctaccagctaagattaaaagac

SEQ ID NO: 965158 - DNA, 25 bp, Mus musculus
tatctaccaggtaagattaaaagac

SEQ ID NO: 965159 - DNA, 25 bp, Mus musculus
tatctagagaaataagtgcatgagc

SEQ ID NO: 965160 - DNA, 25 bp, Mus musculus
tatctagagaaatatgtgcatgagc

SEQ ID NO: 965161 - DNA, 25 bp, Mus musculus
tatctatctatcatctatctaccta

SEQ ID NO: 965162 - DNA, 25 bp, Mus musculus
tatctatctatcttctatctaccta

SEQ ID NO: 965163 - DNA, 25 bp, Mus musculus
tatctcaacaagccacggcagctct

SEQ ID NO: 965164 - DNA, 25 bp, Mus musculus
tatctcaacaaggcacggcagctct

SEQ ID NO: 965165 - DNA, 25 bp, Mus musculus
tatctcactacggacgtgcatcctg

SEQ ID NO: 965166 - DNA, 25 bp, Mus musculus
tatctcactacggaggtgcatcctg

SEQ ID NO: 965167 - DNA, 25 bp, Mus musculus
tatctcatcctgaatgcagcctggc

SEQ ID NO: 965168 - DNA, 25 bp, Mus musculus
tatctcatcctgtatgcagcctggc

SEQ ID NO: 965169 - DNA, 25 bp, Mus musculus
tatctcattggacgctccatccctg

SEQ ID NO: 965170 - DNA, 25 bp, Mus musculus
tatctcattggaggctccatccctg

SEQ ID NO: 965171 - DNA, 25 bp, Mus musculus
tatctccactcgattaaaatatccg

SEQ ID NO: 965172 - DNA, 25 bp, Mus musculus
tatctccactggattaaaatatccg

SEQ ID NO: 965173 - DNA, 25 bp, Mus musculus
tatctctctctgaggaggtgaagcc

SEQ ID NO: 965174 - DNA, 25 bp, Mus musculus
tatctctctctgtggaggtgaagcc

SEQ ID NO: 965175 - DNA, 25 bp, Mus musculus
tatctctgttggcgcttcacaccta

SEQ ID NO: 965176 - DNA, 25 bp, Mus musculus
tatctctgttggggcttcacaccta

SEQ ID NO: 965177 - DNA, 25 bp, Mus musculus
tatctcttagcaaagatggtccaga

SEQ ID NO: 965178 - DNA, 25 bp, Mus musculus
tatctcttagcaggaaagatggtcc

SEQ ID NO: 965179 - DNA, 25 bp, Mus musculus
tatctcttaggaaagatggtccaga

SEQ ID NO: 965180 - DNA, 25 bp, Mus musculus
tatctcttaggaggaaagatggtcc

SEQ ID NO: 965181 - DNA, 25 bp, Mus musculus
tatctctttcagaatcctgtgcgtc

SEQ ID NO: 965182 - DNA, 25 bp, Mus musculus
tatctctttcagctagagcttgaga

SEQ ID NO: 965183 - DNA, 25 bp, Mus musculus
tatctctttcaggtagagcttgaga

SEQ ID NO: 965184 - DNA, 25 bp, Mus musculus
tatctctttcagtatcctgtgcgtc

SEQ ID NO: 965185 - DNA, 25 bp, Mus musculus
tatctgaatgacagagtagacgagc

SEQ ID NO: 965186 - DNA, 25 bp, Mus musculus
tatctgaatgacagtgtagacgagc

SEQ ID NO: 965187 - DNA, 25 bp, Mus musculus
tatctgcaagcacatgagcccactg

SEQ ID NO: 965188 - DNA, 25 bp, Mus musculus
tatctgcaagccaaccagtctctgg

SEQ ID NO: 965189 - DNA, 25 bp, Mus musculus
tatctgcaagccaagcagtctctgg

SEQ ID NO: 965190 - DNA, 25 bp, Mus musculus
tatctgcaaggacatgagcccactg

SEQ ID NO: 965191 - DNA, 25 bp, Mus musculus
tatctgcatccgaactcatattcct

SEQ ID NO: 965192 - DNA, 25 bp, Mus musculus
tatctgcatccgtactcatattcct

SEQ ID NO: 965193 - DNA, 25 bp, Mus musculus
tatctgccagcatttgtgaagtttt

SEQ ID NO: 965194 - DNA, 25 bp, Mus musculus
tatctgccaggatttgtgaagtttt

SEQ ID NO: 965195 - DNA, 25 bp, Mus musculus
tatctgcctcttcacgaagctgcac

SEQ ID NO: 965196 - DNA, 25 bp, Mus musculus
tatctgcctcttcaggaagctgcac

SEQ ID NO: 965197 - DNA, 25 bp, Mus musculus
tatctgcgctggcacgttgtagata

SEQ ID NO: 965198 - DNA, 25 bp, Mus musculus
tatctgcgctggcaggttgtagata

SEQ ID NO: 965199 - DNA, 25 bp, Mus musculus
tatctggaacaactacgtcaacatt

SEQ ID NO: 965200 - DNA, 25 bp, Mus musculus
tatctggaacaagtacgtcaacatt

SEQ ID NO: 965201 - DNA, 25 bp, Mus musculus
tatctggaacagcgtcgaacctcca

SEQ ID NO: 965202 - DNA, 25 bp, Mus musculus
tatctggaacagggtcgaacctcca

SEQ ID NO: 965203 - DNA, 25 bp, Mus musculus
tatctggaagacttttacacttttc

SEQ ID NO: 965204 - DNA, 25 bp, Mus musculus
tatctggaagtcttttacacttttc

SEQ ID NO: 965205 - DNA, 25 bp, Mus musculus
tatctgtaaactattacatcgtcaa

SEQ ID NO: 965206 - DNA, 25 bp, Mus musculus
tatctgtaaacttttacatcgtcaa

SEQ ID NO: 965207 - DNA, 25 bp, Mus musculus
tatctgtaagaactgctttaagtat

SEQ ID NO: 965208 - DNA, 25 bp, Mus musculus
tatctgtaagtactgctttaagtat

SEQ ID NO: 965209 - DNA, 25 bp, Mus musculus
tatctgtaccagcgtgtacattggt

SEQ ID NO: 965210 - DNA, 25 bp, Mus musculus
tatctgtaccagggtgtacattggt

SEQ ID NO: 965211 - DNA, 25 bp, Mus musculus
tatctgtatgctcgtggctctaagc

SEQ ID NO: 965212 - DNA, 25 bp, Mus musculus
tatctgtatggtcgtggctctaagc

SEQ ID NO: 965213 - DNA, 25 bp, Mus musculus
tatctgtcctgccatccatgatgta

SEQ ID NO: 965214 - DNA, 25 bp, Mus musculus
tatctgtcctgcgatccatgatgta

SEQ ID NO: 965215 - DNA, 25 bp, Mus musculus
tatctgtgatgacgtggacttatat

SEQ ID NO: 965216 - DNA, 25 bp, Mus musculus
tatctgtgatgaggtggacttatat

SEQ ID NO: 965217 - DNA, 25 bp, Mus musculus
tatctgttatcaaacaaatgtcctc

SEQ ID NO: 965218 - DNA, 25 bp, Mus musculus
tatctgttatgaaacaaatgtcctc

SEQ ID NO: 965219 - DNA, 25 bp, Mus musculus
tatcttcagcctcccatggctgtta

SEQ ID NO: 965220 - DNA, 25 bp, Mus musculus
tatcttcagcctgccatggctgtta

SEQ ID NO: 965221 - DNA, 25 bp, Mus musculus
tatcttcatatacggttcctttaga

SEQ ID NO: 965222 - DNA, 25 bp, Mus musculus
tatcttcatatagggttcctttaga

SEQ ID NO: 965223 - DNA, 25 bp, Mus musculus
tatcttctcccacattacctcccta

SEQ ID NO: 965224 - DNA, 25 bp, Mus musculus
tatcttctcccagattacctcccta

SEQ ID NO: 965225 - DNA, 25 bp, Mus musculus
tatcttgaaaagcatactcccacaa

SEQ ID NO: 965226 - DNA, 25 bp, Mus musculus
tatcttgaaaaggatactcccacaa

SEQ ID NO: 965227 - DNA, 25 bp, Mus musculus
tatcttgaagcacgtggactcccct

SEQ ID NO: 965228 - DNA, 25 bp, Mus musculus
tatcttgaagcaggtggactcccct

SEQ ID NO: 965229 - DNA, 25 bp, Mus musculus
tatcttgctgctcacaggcctgcct

SEQ ID NO: 965230 - DNA, 25 bp, Mus musculus
tatcttgctgctcaccagaggcctg

SEQ ID NO: 965231 - DNA, 25 bp, Mus musculus
tatcttgctgctcagaggcctgcct

SEQ ID NO: 965232 - DNA, 25 bp, Mus musculus
tatcttgctgctcagcagaggcctg

SEQ ID NO: 965233 - DNA, 25 bp, Mus musculus
tatcttggaaagcttcacagaggct

SEQ ID NO: 965234 - DNA, 25 bp, Mus musculus
tatcttggaaaggttcacagaggct

SEQ ID NO: 965235 - DNA, 25 bp, Mus musculus
tatcttgggcatatcgtgcccaacc

SEQ ID NO: 965236 - DNA, 25 bp, Mus musculus
tatcttgggcatatggtgcccaacc

SEQ ID NO: 965237 - DNA, 25 bp, Mus musculus
tatctttcagaggagcctatcacgg

SEQ ID NO: 965238 - DNA, 25 bp, Mus musculus
tatctttcagtggagcctatcacgg

SEQ ID NO: 965239 - DNA, 25 bp, Mus musculus
tatctttcttggagagaaagcagca

SEQ ID NO: 965240 - DNA, 25 bp, Mus musculus
tatctttcttggtgagaaagcagca

SEQ ID NO: 965241 - DNA, 25 bp, Mus musculus
tatctttgctgtcaaaaatgaaaaa

SEQ ID NO: 965242 - DNA, 25 bp, Mus musculus
tatctttgctgtgaaaaatgaaaaa

SEQ ID NO: 965243 - DNA, 25 bp, Mus musculus
tatgaaaaagctggagaactgtaat

SEQ ID NO: 965244 - DNA, 25 bp, Mus musculus
tatgaaaaaggtggagaactgtaat

SEQ ID NO: 965245 - DNA, 25 bp, Mus musculus
tatgaaattgatctgtgtgcaaatg

SEQ ID NO: 965246 - DNA, 25 bp, Mus musculus
tatgaaattgatgtgtgtgcaaatg

SEQ ID NO: 965247 - DNA, 25 bp, Mus musculus
tatgaaccagagggtgtctggccct

SEQ ID NO: 965248 - DNA, 25 bp, Mus musculus
tatgaaccagtgggtgtctggccct

SEQ ID NO: 965249 - DNA, 25 bp, Mus musculus
tatgaacggcatcacgcgcagatag

SEQ ID NO: 965250 - DNA, 25 bp, Mus musculus
tatgaacggcatcaggcgcagatag

SEQ ID NO: 965251 - DNA, 25 bp, Mus musculus
tatgaactccagccaagtcgttggg

SEQ ID NO: 965252 - DNA, 25 bp, Mus musculus
tatgaactccaggcaagtcgttggg

SEQ ID NO: 965253 - DNA, 25 bp, Mus musculus
tatgaactttatatggctatttctg

SEQ ID NO: 965254 - DNA, 25 bp, Mus musculus
tatgaactttttatggctatttctg

SEQ ID NO: 965255 - DNA, 25 bp, Mus musculus
tatgaagaaaagcatggatcatgca

SEQ ID NO: 965256 - DNA, 25 bp, Mus musculus
tatgaagaaaaggatggatcatgca

SEQ ID NO: 965257 - DNA, 25 bp, Mus musculus
tatgaagacaggagtcttttattca

SEQ ID NO: 965258 - DNA, 25 bp, Mus musculus
tatgaagacaggtgtcttttattca

SEQ ID NO: 965259 - DNA, 25 bp, Mus musculus
tatgaagataaaccaccaaacacca

SEQ ID NO: 965260 - DNA, 25 bp, Mus musculus
tatgaagataaagcaccaaacacca

SEQ ID NO: 965261 - DNA, 25 bp, Mus musculus
tatgaagcaaagctgaatcttctgt

SEQ ID NO: 965262 - DNA, 25 bp, Mus musculus
tatgaagcaaaggtgaatcttctgt

SEQ ID NO: 965263 - DNA, 25 bp, Mus musculus
tatgaagccaagattgtaagggcca

SEQ ID NO: 965264 - DNA, 25 bp, Mus musculus
tatgaagccaagtttgtaagggcca

SEQ ID NO: 965265 - DNA, 25 bp, Mus musculus
tatgaagcgaagcacggatcttgta

SEQ ID NO: 965266 - DNA, 25 bp, Mus musculus
tatgaagcgaaggacggatcttgta

SEQ ID NO: 965267 - DNA, 25 bp, Mus musculus
tatgaaggcgtgaatatgacatctg

SEQ ID NO: 965268 - DNA, 25 bp, Mus musculus
tatgaaggcgtgcgtatgcaatata

SEQ ID NO: 965269 - DNA, 25 bp, Mus musculus
tatgaaggcgtgggtatgcaatata

SEQ ID NO: 965270 - DNA, 25 bp, Mus musculus
tatgaaggcgtgtatatgacatctg

SEQ ID NO: 965271 - DNA, 25 bp, Mus musculus
tatgaagttcagcaaggatttggct

SEQ ID NO: 965272 - DNA, 25 bp, Mus musculus
tatgaagttcaggaaggatttggct

SEQ ID NO: 965273 - DNA, 25 bp, Mus musculus
tatgaatcagaaaacaggtcttgcc

SEQ ID NO: 965274 - DNA, 25 bp, Mus musculus
tatgaatcagaaaacgtcttgcccc

SEQ ID NO: 965275 - DNA, 25 bp, Mus musculus
tatgaatcagaaaagaggtcttgcc

SEQ ID NO: 965276 - DNA, 25 bp, Mus musculus
tatgaatcagaaaaggtcttgcccc

SEQ ID NO: 965277 - DNA, 25 bp, Mus musculus
tatgaatgcaagcatcagaccatga

SEQ ID NO: 965278 - DNA, 25 bp, Mus musculus
tatgaatgcaaggatcagaccatga

SEQ ID NO: 965279 - DNA, 25 bp, Mus musculus
tatgacacagaggtaggtgagactg

SEQ ID NO: 965280 - DNA, 25 bp, Mus musculus
tatgacacagtggtaggtgagactg

SEQ ID NO: 965281 - DNA, 25 bp, Mus musculus
tatgacaccatcaaccacccaggag

SEQ ID NO: 965282 - DNA, 25 bp, Mus musculus
tatgacaccatcaagcacccaggag

SEQ ID NO: 965283 - DNA, 25 bp, Mus musculus
tatgacagaactctgcgtggtggct

SEQ ID NO: 965284 - DNA, 25 bp, Mus musculus
tatgacagaagtctgcgtggtggct

SEQ ID NO: 965285 - DNA, 25 bp, Mus musculus
tatgacagatcacgaccaagatggt

SEQ ID NO: 965286 - DNA, 25 bp, Mus musculus
tatgacagatcaggaccaagatggt

SEQ ID NO: 965287 - DNA, 25 bp, Mus musculus
tatgaccattgtcaccaatgcatcc

SEQ ID NO: 965288 - DNA, 25 bp, Mus musculus
tatgaccattgtcagcaatgcatcc

SEQ ID NO: 965289 - DNA, 25 bp, Mus musculus
tatgacccagccagtgatccaggga

SEQ ID NO: 965290 - DNA, 25 bp, Mus musculus
tatgacccaggcagtgatccaggga

SEQ ID NO: 965291 - DNA, 25 bp, Mus musculus
tatgacctcaagcgctctctagtgt

SEQ ID NO: 965292 - DNA, 25 bp, Mus musculus
tatgacctcaagggctctctagtgt

SEQ ID NO: 965293 - DNA, 25 bp, Mus musculus
tatgaccttactctcccttttgctc

SEQ ID NO: 965294 - DNA, 25 bp, Mus musculus
tatgaccttactgtcccttttgctc

SEQ ID NO: 965295 - DNA, 25 bp, Mus musculus
tatgacgactggcggggacagtatg

SEQ ID NO: 965296 - DNA, 25 bp, Mus musculus
tatgacgactgggggggacagtatg

SEQ ID NO: 965297 - DNA, 25 bp, Mus musculus
tatgacgatgccaagcggtactgca

SEQ ID NO: 965298 - DNA, 25 bp, Mus musculus
tatgacgatggcaagcggtactgca

SEQ ID NO: 965299 - DNA, 25 bp, Mus musculus
tatgacgccataaacagcaacggga

SEQ ID NO: 965300 - DNA, 25 bp, Mus musculus
tatgacgccataaagagcaacggga

SEQ ID NO: 965301 - DNA, 25 bp, Mus musculus
tatgactccctcaacaacaaagtca

SEQ ID NO: 965302 - DNA, 25 bp, Mus musculus
tatgactccctcaacattcaaacag

SEQ ID NO: 965303 - DNA, 25 bp, Mus musculus
tatgactccctcaagaacaaagtca

SEQ ID NO: 965304 - DNA, 25 bp, Mus musculus
tatgactccctcaagattcaaacag

SEQ ID NO: 965305 - DNA, 25 bp, Mus musculus
tatgactgagcgaagtcaaatattt

SEQ ID NO: 965306 - DNA, 25 bp, Mus musculus
tatgactgagggaagtcaaatattt

SEQ ID NO: 965307 - DNA, 25 bp, Mus musculus
tatgacttcaagcctgacatctggt

SEQ ID NO: 965308 - DNA, 25 bp, Mus musculus
tatgacttcaaggctgacatctggt

SEQ ID NO: 965309 - DNA, 25 bp, Mus musculus
tatgacttccatataagtttctttg

SEQ ID NO: 965310 - DNA, 25 bp, Mus musculus
tatgacttccatttaagtttctttg

SEQ ID NO: 965311 - DNA, 25 bp, Mus musculus
tatgactttgtcaacttgagctcag

SEQ ID NO: 965312 - DNA, 25 bp, Mus musculus
tatgactttgtcaagttgagctcag

SEQ ID NO: 965313 - DNA, 25 bp, Mus musculus
tatgagaaagcgaagacctcggacg

SEQ ID NO: 965314 - DNA, 25 bp, Mus musculus
tatgagaaagggaagacctcggacg

SEQ ID NO: 965315 - DNA, 25 bp, Mus musculus
tatgagaagaagctgagcccacctt

SEQ ID NO: 965316 - DNA, 25 bp, Mus musculus
tatgagaagaaggtgagcccacctt

SEQ ID NO: 965317 - DNA, 25 bp, Mus musculus
tatgagaagattaagaaagaccccg

SEQ ID NO: 965318 - DNA, 25 bp, Mus musculus
tatgagaagatttagaaagaccccg

SEQ ID NO: 965319 - DNA, 25 bp, Mus musculus
tatgagaaggcatgtaatcggctgt

SEQ ID NO: 965320 - DNA, 25 bp, Mus musculus
tatgagaagggatgtaatcggctgt

SEQ ID NO: 965321 - DNA, 25 bp, Mus musculus
tatgagaagtataacacacagattg

SEQ ID NO: 965322 - DNA, 25 bp, Mus musculus
tatgagaagtataagacacagattg

SEQ ID NO: 965323 - DNA, 25 bp, Mus musculus
tatgagatcaaccgtgaccatttga

SEQ ID NO: 965324 - DNA, 25 bp, Mus musculus
tatgagatcaacggtgaccatttga

SEQ ID NO: 965325 - DNA, 25 bp, Mus musculus
tatgagattaggaattgttggccac

SEQ ID NO: 965326 - DNA, 25 bp, Mus musculus
tatgagattaggtattgttggccac

SEQ ID NO: 965327 - DNA, 25 bp, Mus musculus
tatgagcatccactgtatccagagt

SEQ ID NO: 965328 - DNA, 25 bp, Mus musculus
tatgagcatccagtgtatccagagt

SEQ ID NO: 965329 - DNA, 25 bp, Mus musculus
tatgagccaccacacgttggcactg

SEQ ID NO: 965330 - DNA, 25 bp, Mus musculus
tatgagccaccacaggttggcactg

SEQ ID NO: 965331 - DNA, 25 bp, Mus musculus
tatgaggaggagcaggtagagcgga

SEQ ID NO: 965332 - DNA, 25 bp, Mus musculus
tatgaggaggaggaggtagagcgga

SEQ ID NO: 965333 - DNA, 25 bp, Mus musculus
tatgagtagtggcatgagagtcatt

SEQ ID NO: 965334 - DNA, 25 bp, Mus musculus
tatgagtagtgggatgagagtcatt

SEQ ID NO: 965335 - DNA, 25 bp, Mus musculus
tatgagtcctttgacctgactgcat

SEQ ID NO: 965336 - DNA, 25 bp, Mus musculus
tatgagtcctttgagctgactgcat

SEQ ID NO: 965337 - DNA, 25 bp, Mus musculus
tatgatatcacaaatgttaactcat

SEQ ID NO: 965338 - DNA, 25 bp, Mus musculus
tatgatatcacatatgttaactcat

SEQ ID NO: 965339 - DNA, 25 bp, Mus musculus
tatgatatgcagattgacaacaagt

SEQ ID NO: 965340 - DNA, 25 bp, Mus musculus
tatgatatgcagtttgacaacaagt

SEQ ID NO: 965341 - DNA, 25 bp, Mus musculus
tatgatcaacgaagcaatggcacca

SEQ ID NO: 965342 - DNA, 25 bp, Mus musculus
tatgatcaacgatgcaatggcacca

SEQ ID NO: 965343 - DNA, 25 bp, Mus musculus
tatgatccagcacatgctgtccacg

SEQ ID NO: 965344 - DNA, 25 bp, Mus musculus
tatgatccagcagatgctgtccacg

SEQ ID NO: 965345 - DNA, 25 bp, Mus musculus
tatgatgatgccaccccagctacca

SEQ ID NO: 965346 - DNA, 25 bp, Mus musculus
tatgatgatggcaccccagctacca

SEQ ID NO: 965347 - DNA, 25 bp, Mus musculus
tatgatgcccagacttaccatgagc

SEQ ID NO: 965348 - DNA, 25 bp, Mus musculus
tatgatgcccagcacttagaagagt

SEQ ID NO: 965349 - DNA, 25 bp, Mus musculus
tatgatgcccaggacttagaagagt

SEQ ID NO: 965350 - DNA, 25 bp, Mus musculus
tatgatgcccagtcttaccatgagc

SEQ ID NO: 965351 - DNA, 25 bp, Mus musculus
tatgatgctctgaatgaagggggat

SEQ ID NO: 965352 - DNA, 25 bp, Mus musculus
tatgatgctctgtatgaagggggat

SEQ ID NO: 965353 - DNA, 25 bp, Mus musculus
tatgatgctgagagaatggtcaaga

SEQ ID NO: 965354 - DNA, 25 bp, Mus musculus
tatgatgctgagtgaatggtcaaga

SEQ ID NO: 965355 - DNA, 25 bp, Mus musculus
tatgatggtgaccccgacaaggtgc

SEQ ID NO: 965356 - DNA, 25 bp, Mus musculus
tatgatggtgacccggacaaggtgc

SEQ ID NO: 965357 - DNA, 25 bp, Mus musculus
tatgatgtcctaaatgaactgagaa

SEQ ID NO: 965358 - DNA, 25 bp, Mus musculus
tatgatgtcctatatgaactgagaa

SEQ ID NO: 965359 - DNA, 25 bp, Mus musculus
tatgattcagatgctgtattatgta

SEQ ID NO: 965360 - DNA, 25 bp, Mus musculus
tatgattcagttgctgtattatgta

SEQ ID NO: 965361 - DNA, 25 bp, Mus musculus
tatgcaaaacagcttcaccgataca

SEQ ID NO: 965362 - DNA, 25 bp, Mus musculus
tatgcaaaacctataaatcctcgag

SEQ ID NO: 965363 - DNA, 25 bp, Mus musculus
tatgcaaaacgtataaatcctcgag

SEQ ID NO: 965364 - DNA, 25 bp, Mus musculus
tatgcaaaactgcttcaccgataca

SEQ ID NO: 965365 - DNA, 25 bp, Mus musculus
tatgcaacaagcatcggatctcggg

SEQ ID NO: 965366 - DNA, 25 bp, Mus musculus
tatgcaacaagcatgggatctcggg

SEQ ID NO: 965367 - DNA, 25 bp, Mus musculus
tatgcaagtggacgtgaagtatttg

SEQ ID NO: 965368 - DNA, 25 bp, Mus musculus
tatgcaagtggaggtgaagtatttg

SEQ ID NO: 965369 - DNA, 25 bp, Mus musculus
tatgcacaaagacgctgccagctct

SEQ ID NO: 965370 - DNA, 25 bp, Mus musculus
tatgcacaaagaggctgccagctct

SEQ ID NO: 965371 - DNA, 25 bp, Mus musculus
tatgcacctcaagacggagagaaaa

SEQ ID NO: 965372 - DNA, 25 bp, Mus musculus
tatgcacctcaagacgtacctaaga

SEQ ID NO: 965373 - DNA, 25 bp, Mus musculus
tatgcacctcaagagggagagaaaa

SEQ ID NO: 965374 - DNA, 25 bp, Mus musculus
tatgcacctcaagaggtacctaaga

SEQ ID NO: 965375 - DNA, 25 bp, Mus musculus
tatgcacggagacatgcttttactg

SEQ ID NO: 965376 - DNA, 25 bp, Mus musculus
tatgcacggagagatgcttttactg

SEQ ID NO: 965377 - DNA, 25 bp, Mus musculus
tatgcagaagagaagaaaaattcaa

SEQ ID NO: 965378 - DNA, 25 bp, Mus musculus
tatgcagaagagatagcaaaacgtg

SEQ ID NO: 965379 - DNA, 25 bp, Mus musculus
tatgcagaagagtagaaaaattcaa

SEQ ID NO: 965380 - DNA, 25 bp, Mus musculus
tatgcagaagagttagcaaaacgtg

SEQ ID NO: 965381 - DNA, 25 bp, Mus musculus
tatgcagcagatttttatcattaaa

SEQ ID NO: 965382 - DNA, 25 bp, Mus musculus
tatgcagcagcggggagcaccgtct

SEQ ID NO: 965383 - DNA, 25 bp, Mus musculus
tatgcagcaggggggagcaccgtct

SEQ ID NO: 965384 - DNA, 25 bp, Mus musculus
tatgcagcagttttttatcattaaa

SEQ ID NO: 965385 - DNA, 25 bp, Mus musculus
tatgcagccaggccctgtgtcaaat

SEQ ID NO: 965386 - DNA, 25 bp, Mus musculus
tatgcagccagggcctgtgtcaaat

SEQ ID NO: 965387 - DNA, 25 bp, Mus musculus
tatgcagccccccacgacacaaagg

SEQ ID NO: 965388 - DNA, 25 bp, Mus musculus
tatgcagccccccaggacacaaagg

SEQ ID NO: 965389 - DNA, 25 bp, Mus musculus
tatgcagcggagcatgtggatgaat

SEQ ID NO: 965390 - DNA, 25 bp, Mus musculus
tatgcagcggaggatgtggatgaat

SEQ ID NO: 965391 - DNA, 25 bp, Mus musculus
tatgcagctgagaccacgtgaagtc

SEQ ID NO: 965392 - DNA, 25 bp, Mus musculus
tatgcagctgagccgtaagttggat

SEQ ID NO: 965393 - DNA, 25 bp, Mus musculus
tatgcagctgaggcgtaagttggat

SEQ ID NO: 965394 - DNA, 25 bp, Mus musculus
tatgcagctgagtccacgtgaagtc

SEQ ID NO: 965395 - DNA, 25 bp, Mus musculus
tatgcaggaacacaaactgaaagtc

SEQ ID NO: 965396 - DNA, 25 bp, Mus musculus
tatgcaggaacacatactgaaagtc

SEQ ID NO: 965397 - DNA, 25 bp, Mus musculus
tatgcaggagagctgcagtatgatg

SEQ ID NO: 965398 - DNA, 25 bp, Mus musculus
tatgcaggagaggtgcagtatgatg

SEQ ID NO: 965399 - DNA, 25 bp, Mus musculus
tatgcagtcatgcctcttgagaata

SEQ ID NO: 965400 - DNA, 25 bp, Mus musculus
tatgcagtcatggctcttgagaata

SEQ ID NO: 965401 - DNA, 25 bp, Mus musculus
tatgcatctgagagatcggtcggct

SEQ ID NO: 965402 - DNA, 25 bp, Mus musculus
tatgcatctgagcaagagatcggtc

SEQ ID NO: 965403 - DNA, 25 bp, Mus musculus
tatgcatctgaggaagagatcggtc

SEQ ID NO: 965404 - DNA, 25 bp, Mus musculus
tatgcatctgagtgatcggtcggct

SEQ ID NO: 965405 - DNA, 25 bp, Mus musculus
tatgccaaagagatgaaggagtcag

SEQ ID NO: 965406 - DNA, 25 bp, Mus musculus
tatgccaaagagttgaaggagtcag

SEQ ID NO: 965407 - DNA, 25 bp, Mus musculus
tatgccaagactttatacctgctct

SEQ ID NO: 965408 - DNA, 25 bp, Mus musculus
tatgccaagagtttatacctgctct

SEQ ID NO: 965409 - DNA, 25 bp, Mus musculus
tatgccaaggagaatggtaccaagt

SEQ ID NO: 965410 - DNA, 25 bp, Mus musculus
tatgccaaggagtatggtaccaagt

SEQ ID NO: 965411 - DNA, 25 bp, Mus musculus
tatgccaaggcacgctgtcaggttg

SEQ ID NO: 965412 - DNA, 25 bp, Mus musculus
tatgccaaggcaggctgtcaggttg

SEQ ID NO: 965413 - DNA, 25 bp, Mus musculus
tatgccagaacacatagtcgtacaa

SEQ ID NO: 965414 - DNA, 25 bp, Mus musculus
tatgccagaacagatagtcgtacaa

SEQ ID NO: 965415 - DNA, 25 bp, Mus musculus
tatgccagagaggtggaaccaagca

SEQ ID NO: 965416 - DNA, 25 bp, Mus musculus
tatgccagagtggtggaaccaagca

SEQ ID NO: 965417 - DNA, 25 bp, Mus musculus
tatgccagtggccgagaggtgtttg

SEQ ID NO: 965418 - DNA, 25 bp, Mus musculus
tatgccagtggcggagaggtgtttg

SEQ ID NO: 965419 - DNA, 25 bp, Mus musculus
tatgccatccagcccgaactgggag

SEQ ID NO: 965420 - DNA, 25 bp, Mus musculus
tatgccatccaggccgaactgggag

SEQ ID NO: 965421 - DNA, 25 bp, Mus musculus
tatgcccaagcttgtgatggtggat

SEQ ID NO: 965422 - DNA, 25 bp, Mus musculus
tatgcccaaggttgtgatggtggat

SEQ ID NO: 965423 - DNA, 25 bp, Mus musculus
tatgccgataatatcaaagcccaac

SEQ ID NO: 965424 - DNA, 25 bp, Mus musculus
tatgccgatattatcaaagcccaac

SEQ ID NO: 965425 - DNA, 25 bp, Mus musculus
tatgccgctgaagaccgtattgaag

SEQ ID NO: 965426 - DNA, 25 bp, Mus musculus
tatgccgctgaagagcgtattgaag

SEQ ID NO: 965427 - DNA, 25 bp, Mus musculus
tatgccgtggacaacaattacgatg

SEQ ID NO: 965428 - DNA, 25 bp, Mus musculus
tatgccgtggatgaacggggtaagg

SEQ ID NO: 965429 - DNA, 25 bp, Mus musculus
tatgccgtggtcaacaattacgatg

SEQ ID NO: 965430 - DNA, 25 bp, Mus musculus
tatgccgtggttgaacggggtaagg

SEQ ID NO: 965431 - DNA, 25 bp, Mus musculus
tatgcctgccatgacacgaaagtag

SEQ ID NO: 965432 - DNA, 25 bp, Mus musculus
tatgcctgccatgacgaattcttct

SEQ ID NO: 965433 - DNA, 25 bp, Mus musculus
tatgcctgccatgagacgaaagtag

SEQ ID NO: 965434 - DNA, 25 bp, Mus musculus
tatgcctgccatgaggaattcttct

SEQ ID NO: 965435 - DNA, 25 bp, Mus musculus
tatgcctgtcatgacgaactcagcc

SEQ ID NO: 965436 - DNA, 25 bp, Mus musculus
tatgcctgtcatgaggaactcagcc

SEQ ID NO: 965437 - DNA, 25 bp, Mus musculus
tatgccttcttgctttgatatcgtt

SEQ ID NO: 965438 - DNA, 25 bp, Mus musculus
tatgccttcttggtttgatatcgtt

SEQ ID NO: 965439 - DNA, 25 bp, Mus musculus
tatgcgaagcagatttatggtctgc

SEQ ID NO: 965440 - DNA, 25 bp, Mus musculus
tatgcgaagcagcgtgtgcagatta

SEQ ID NO: 965441 - DNA, 25 bp, Mus musculus
tatgcgaagcagggtgtgcagatta

SEQ ID NO: 965442 - DNA, 25 bp, Mus musculus
tatgcgaagcagttttatggtctgc

SEQ ID NO: 965443 - DNA, 25 bp, Mus musculus
tatgcgggagctcccatcagtagtg

SEQ ID NO: 965444 - DNA, 25 bp, Mus musculus
tatgcgggaggtcccatcagtagtg

SEQ ID NO: 965445 - DNA, 25 bp, Mus musculus
tatgctccagccaaggaggactgtc

SEQ ID NO: 965446 - DNA, 25 bp, Mus musculus
tatgctccaggcaaggaggactgtc

SEQ ID NO: 965447 - DNA, 25 bp, Mus musculus
tatgctcccacccacaaggctgcct

SEQ ID NO: 965448 - DNA, 25 bp, Mus musculus
tatgctcccacccagaaggctgcct

SEQ ID NO: 965449 - DNA, 25 bp, Mus musculus
tatgctctggagactcttctcactc

SEQ ID NO: 965450 - DNA, 25 bp, Mus musculus
tatgctctggagctgatggagtctg

SEQ ID NO: 965451 - DNA, 25 bp, Mus musculus
tatgctctggaggtgatggagtctg

SEQ ID NO: 965452 - DNA, 25 bp, Mus musculus
tatgctctggagtctcttctcactc

SEQ ID NO: 965453 - DNA, 25 bp, Mus musculus
tatgctgcagagcttcacttggttc

SEQ ID NO: 965454 - DNA, 25 bp, Mus musculus
tatgctgcagaggttcacttggttc

SEQ ID NO: 965455 - DNA, 25 bp, Mus musculus
tatgctgccattgacaaaatgaaac

SEQ ID NO: 965456 - DNA, 25 bp, Mus musculus
tatgctgccattgacacgtaccacc

SEQ ID NO: 965457 - DNA, 25 bp, Mus musculus
tatgctgccattgagaaaatgaaac

SEQ ID NO: 965458 - DNA, 25 bp, Mus musculus
tatgctgccattgagacgtaccacc

SEQ ID NO: 965459 - DNA, 25 bp, Mus musculus
tatgctggagagcgccttgaaggtt

SEQ ID NO: 965460 - DNA, 25 bp, Mus musculus
tatgctggagagggccttgaaggtt

SEQ ID NO: 965461 - DNA, 25 bp, Mus musculus
tatgctggagataattatgtccatc

SEQ ID NO: 965462 - DNA, 25 bp, Mus musculus
tatgctggagttaattatgtccatc

SEQ ID NO: 965463 - DNA, 25 bp, Mus musculus
tatgctggcaagctgctctaccagg

SEQ ID NO: 965464 - DNA, 25 bp, Mus musculus
tatgctggcaaggtgctctaccagg

SEQ ID NO: 965465 - DNA, 25 bp, Mus musculus
tatgctggcctgccgttccacgcct

SEQ ID NO: 965466 - DNA, 25 bp, Mus musculus
tatgctggcctggcgttccacgcct

SEQ ID NO: 965467 - DNA, 25 bp, Mus musculus
tatgctggcgtccacgcaatcctga

SEQ ID NO: 965468 - DNA, 25 bp, Mus musculus
tatgctggcgtccaggcaatcctga

SEQ ID NO: 965469 - DNA, 25 bp, Mus musculus
tatgctggtggacctcatcctctcc

SEQ ID NO: 965470 - DNA, 25 bp, Mus musculus
tatgctggtggagctcatcctctcc

SEQ ID NO: 965471 - DNA, 25 bp, Mus musculus
tatgctgtcaagatcattgagaagc

SEQ ID NO: 965472 - DNA, 25 bp, Mus musculus
tatgctgtcaagttcattgagaagc

SEQ ID NO: 965473 - DNA, 25 bp, Mus musculus
tatgctgtggaccactacctgatac

SEQ ID NO: 965474 - DNA, 25 bp, Mus musculus
tatgctgtggaccagtacctgatac

SEQ ID NO: 965475 - DNA, 25 bp, Mus musculus
tatgctgtttgcaacaatgcatctt

SEQ ID NO: 965476 - DNA, 25 bp, Mus musculus
tatgctgtttgcaacgtatccatta

SEQ ID NO: 965477 - DNA, 25 bp, Mus musculus
tatgctgtttgcaagaatgcatctt

SEQ ID NO: 965478 - DNA, 25 bp, Mus musculus
tatgctgtttgcaaggtatccatta

SEQ ID NO: 965479 - DNA, 25 bp, Mus musculus
tatgcttcagatcgccttgaagtgt

SEQ ID NO: 965480 - DNA, 25 bp, Mus musculus
tatgcttcagccaacagctgaggct

SEQ ID NO: 965481 - DNA, 25 bp, Mus musculus
tatgcttcaggcaacagctgaggct

SEQ ID NO: 965482 - DNA, 25 bp, Mus musculus
tatgcttcagttcgccttgaagtgt

SEQ ID NO: 965483 - DNA, 25 bp, Mus musculus
tatgcttggaacctcattgccaacg

SEQ ID NO: 965484 - DNA, 25 bp, Mus musculus
tatgcttggaacctgattgccaacg

SEQ ID NO: 965485 - DNA, 25 bp, Mus musculus
tatgctttagctgaaggcgataaag

SEQ ID NO: 965486 - DNA, 25 bp, Mus musculus
tatgctttaggtgaaggcgataaag

SEQ ID NO: 965487 - DNA, 25 bp, Mus musculus
tatggaaatacacgaaccaaagtca

SEQ ID NO: 965488 - DNA, 25 bp, Mus musculus
tatggaaatacaggaaccaaagtca

SEQ ID NO: 965489 - DNA, 25 bp, Mus musculus
tatggaacagactgtcccagaaact

SEQ ID NO: 965490 - DNA, 25 bp, Mus musculus
tatggaacagtctgtcccagaaact

SEQ ID NO: 965491 - DNA, 25 bp, Mus musculus
tatggaagctgtctggaaagaagca

SEQ ID NO: 965492 - DNA, 25 bp, Mus musculus
tatggaagctgtgtggaaagaagca

SEQ ID NO: 965493 - DNA, 25 bp, Mus musculus
tatggaatcttaagtaaaacatcaa

SEQ ID NO: 965494 - DNA, 25 bp, Mus musculus
tatggaatcttatgtaaaacatcaa

SEQ ID NO: 965495 - DNA, 25 bp, Mus musculus
tatggacaggcgatagcccacctca

SEQ ID NO: 965496 - DNA, 25 bp, Mus musculus
tatggacaggggatagcccacctca

SEQ ID NO: 965497 - DNA, 25 bp, Mus musculus
tatggaccccgacgcagagtctttg

SEQ ID NO: 965498 - DNA, 25 bp, Mus musculus
tatggaccccgaggcagagtctttg

SEQ ID NO: 965499 - DNA, 25 bp, Mus musculus
tatggaccgccacgcactgggaaaa

SEQ ID NO: 965500 - DNA, 25 bp, Mus musculus
tatggaccgccaggcactgggaaaa

SEQ ID NO: 965501 - DNA, 25 bp, Mus musculus
tatggagcaaaaaatgggctacaca

SEQ ID NO: 965502 - DNA, 25 bp, Mus musculus
tatggagcaaaactatgaattaggg

SEQ ID NO: 965503 - DNA, 25 bp, Mus musculus
tatggagcaaaagtatgaattaggg

SEQ ID NO: 965504 - DNA, 25 bp, Mus musculus
tatggagcaaaatatgggctacaca

SEQ ID NO: 965505 - DNA, 25 bp, Mus musculus
tatggagcagctatgcggtggtgat

SEQ ID NO: 965506 - DNA, 25 bp, Mus musculus
tatggagcaggtatgcggtggtgat

SEQ ID NO: 965507 - DNA, 25 bp, Mus musculus
tatggagccccacggtacccagcca

SEQ ID NO: 965508 - DNA, 25 bp, Mus musculus
tatggagccccagggtacccagcca

SEQ ID NO: 965509 - DNA, 25 bp, Mus musculus
tatggatcgctccacagacattgtg

SEQ ID NO: 965510 - DNA, 25 bp, Mus musculus
tatggatcgctcgacagacattgtg

SEQ ID NO: 965511 - DNA, 25 bp, Mus musculus
tatggatggtatcctcatctttggt

SEQ ID NO: 965512 - DNA, 25 bp, Mus musculus
tatggatggtatgctcatctttggt

SEQ ID NO: 965513 - DNA, 25 bp, Mus musculus
tatggcaacgaccctgatattgaaa

SEQ ID NO: 965514 - DNA, 25 bp, Mus musculus
tatggcaacgacgctgatattgaaa

SEQ ID NO: 965515 - DNA, 25 bp, Mus musculus
tatggcaatgacgcctttccccacc

SEQ ID NO: 965516 - DNA, 25 bp, Mus musculus
tatggcaatgtcgcctttccccacc

SEQ ID NO: 965517 - DNA, 25 bp, Mus musculus
tatggcacagacatcatggtgggca

SEQ ID NO: 965518 - DNA, 25 bp, Mus musculus
tatggcacagacatgatggtgggca

SEQ ID NO: 965519 - DNA, 25 bp, Mus musculus
tatggcacagcaccgctctgcagtg

SEQ ID NO: 965520 - DNA, 25 bp, Mus musculus
tatggcacaggaccgctctgcagtg

SEQ ID NO: 965521 - DNA, 25 bp, Mus musculus
tatggcacatttcatgtccatctgg

SEQ ID NO: 965522 - DNA, 25 bp, Mus musculus
tatggcacatttgatgtccatctgg

SEQ ID NO: 965523 - DNA, 25 bp, Mus musculus
tatggcatcacgcgagacaatgtcc

SEQ ID NO: 965524 - DNA, 25 bp, Mus musculus
tatggcatcacgggagacaatgtcc

SEQ ID NO: 965525 - DNA, 25 bp, Mus musculus
tatggcatgaggcacagccgctcag

SEQ ID NO: 965526 - DNA, 25 bp, Mus musculus
tatggcatgagggacagccgctcag

SEQ ID NO: 965527 - DNA, 25 bp, Mus musculus
tatggccaggagctatatgacacgc

SEQ ID NO: 965528 - DNA, 25 bp, Mus musculus
tatggccaggaggtatatgacacgc

SEQ ID NO: 965529 - DNA, 25 bp, Mus musculus
tatggccctaaacgggttggtgcta

SEQ ID NO: 965530 - DNA, 25 bp, Mus musculus
tatggccctaaaggggttggtgcta

SEQ ID NO: 965531 - DNA, 25 bp, Mus musculus
tatggcctttaactcatttggagaa

SEQ ID NO: 965532 - DNA, 25 bp, Mus musculus
tatggcctttaagtcatttggagaa

SEQ ID NO: 965533 - DNA, 25 bp, Mus musculus
tatggcgaggagcaggtgtagccca

SEQ ID NO: 965534 - DNA, 25 bp, Mus musculus
tatggcgaggagccatcaagcaaat

SEQ ID NO: 965535 - DNA, 25 bp, Mus musculus
tatggcgaggaggaggtgtagccca

SEQ ID NO: 965536 - DNA, 25 bp, Mus musculus
tatggcgaggaggcatcaagcaaat

SEQ ID NO: 965537 - DNA, 25 bp, Mus musculus
tatggctacaatactctgctttcta

SEQ ID NO: 965538 - DNA, 25 bp, Mus musculus
tatggctacaattctctgctttcta

SEQ ID NO: 965539 - DNA, 25 bp, Mus musculus
tatggctctggtcgtggacgcagac

SEQ ID NO: 965540 - DNA, 25 bp, Mus musculus
tatggctctggtggtggacgcagac

SEQ ID NO: 965541 - DNA, 25 bp, Mus musculus
tatgggaaagagattctgaaaagct

SEQ ID NO: 965542 - DNA, 25 bp, Mus musculus
tatgggaaagtgattctgaaaagct

SEQ ID NO: 965543 - DNA, 25 bp, Mus musculus
tatgggaagctgcccttcaacctgg

SEQ ID NO: 965544 - DNA, 25 bp, Mus musculus
tatgggaagctggccttcaacctgg

SEQ ID NO: 965545 - DNA, 25 bp, Mus musculus
tatgggaatgagagcgtcttcgtgc

SEQ ID NO: 965546 - DNA, 25 bp, Mus musculus
tatgggaatgagtgcgtcttcgtgc

SEQ ID NO: 965547 - DNA, 25 bp, Mus musculus
tatgggacccagttcgttcatctgg

SEQ ID NO: 965548 - DNA, 25 bp, Mus musculus
tatgggacccagttggttcatctgg

SEQ ID NO: 965549 - DNA, 25 bp, Mus musculus
tatgggatcagtattgatgatattg

SEQ ID NO: 965550 - DNA, 25 bp, Mus musculus
tatgggatcagttttgatgatattg

SEQ ID NO: 965551 - DNA, 25 bp, Mus musculus
tatgggatgtatctctcagtgaaag

SEQ ID NO: 965552 - DNA, 25 bp, Mus musculus
tatgggatgtatgtctcagtgaaag

SEQ ID NO: 965553 - DNA, 25 bp, Mus musculus
tatgggcaggtaatcacctacaagc

SEQ ID NO: 965554 - DNA, 25 bp, Mus musculus
tatgggcaggtattcacctacaagc

SEQ ID NO: 965555 - DNA, 25 bp, Mus musculus
tatgggcgagcagctcttgccaggt

SEQ ID NO: 965556 - DNA, 25 bp, Mus musculus
tatgggcgaggagctcttgccaggt

SEQ ID NO: 965557 - DNA, 25 bp, Mus musculus
tatggggaggaaccatgtaggatcc

SEQ ID NO: 965558 - DNA, 25 bp, Mus musculus
tatggggaggaagcatgtaggatcc

SEQ ID NO: 965559 - DNA, 25 bp, Mus musculus
tatggggcagtttacaaatgcactt

SEQ ID NO: 965560 - DNA, 25 bp, Mus musculus
tatggggcagtttagaaatgcactt

SEQ ID NO: 965561 - DNA, 25 bp, Mus musculus
tatgggtatttgctgctatacattt

SEQ ID NO: 965562 - DNA, 25 bp, Mus musculus
tatgggtatttggtgctatacattt

SEQ ID NO: 965563 - DNA, 25 bp, Mus musculus
tatgggtcagctagtgggcagcagt

SEQ ID NO: 965564 - DNA, 25 bp, Mus musculus
tatgggtcaggtagtgggcagcagt

SEQ ID NO: 965565 - DNA, 25 bp, Mus musculus
tatggtaaagatccctcaagaacag

SEQ ID NO: 965566 - DNA, 25 bp, Mus musculus
tatggtaaagttccctcaagaacag

SEQ ID NO: 965567 - DNA, 25 bp, Mus musculus
tatggtcaaggccgagccagatgtt

SEQ ID NO: 965568 - DNA, 25 bp, Mus musculus
tatggtcaaggcggagccagatgtt

SEQ ID NO: 965569 - DNA, 25 bp, Mus musculus
tatggtggaaagcatccagtttgtg

SEQ ID NO: 965570 - DNA, 25 bp, Mus musculus
tatggtggaaaggatccagtttgtg

SEQ ID NO: 965571 - DNA, 25 bp, Mus musculus
tatggttttatccaatatgagaagg

SEQ ID NO: 965572 - DNA, 25 bp, Mus musculus
tatggttttatcgaatatgagaagg

SEQ ID NO: 965573 - DNA, 25 bp, Mus musculus
tatggttttgctgtacagagaggca

SEQ ID NO: 965574 - DNA, 25 bp, Mus musculus
tatggttttggtgtacagagaggca

SEQ ID NO: 965575 - DNA, 25 bp, Mus musculus
tatgtaccaactctttttgacaact

SEQ ID NO: 965576 - DNA, 25 bp, Mus musculus
tatgtaccaactgtttttgacaact

SEQ ID NO: 965577 - DNA, 25 bp, Mus musculus
tatgtagaaaaccgtggcaagtggg

SEQ ID NO: 965578 - DNA, 25 bp, Mus musculus
tatgtagaaaacctaggtggcaagt

SEQ ID NO: 965579 - DNA, 25 bp, Mus musculus
tatgtagaaaacggtggcaagtggg

SEQ ID NO: 965580 - DNA, 25 bp, Mus musculus
tatgtagaaaacgtaggtggcaagt

SEQ ID NO: 965581 - DNA, 25 bp, Mus musculus
tatgtataacaacgattctcaaagc

SEQ ID NO: 965582 - DNA, 25 bp, Mus musculus
tatgtataacaaggattctcaaagc

SEQ ID NO: 965583 - DNA, 25 bp, Mus musculus
tatgtatacgacaccacggcgacga

SEQ ID NO: 965584 - DNA, 25 bp, Mus musculus
tatgtatacgatccccccacaacta

SEQ ID NO: 965585 - DNA, 25 bp, Mus musculus
tatgtatacgtcaccacggcgacga

SEQ ID NO: 965586 - DNA, 25 bp, Mus musculus
tatgtatacgttccccccacaacta

SEQ ID NO: 965587 - DNA, 25 bp, Mus musculus
tatgtatgccagcttatgaaggtgt

SEQ ID NO: 965588 - DNA, 25 bp, Mus musculus
tatgtatgccaggttatgaaggtgt

SEQ ID NO: 965589 - DNA, 25 bp, Mus musculus
tatgtcaacgatgcccccaaggaaa

SEQ ID NO: 965590 - DNA, 25 bp, Mus musculus
tatgtcaacgttgcccccaaggaaa

SEQ ID NO: 965591 - DNA, 25 bp, Mus musculus
tatgtcaatgagctaatcgtcgagc

SEQ ID NO: 965592 - DNA, 25 bp, Mus musculus
tatgtcaatgaggtaatcgtcgagc

SEQ ID NO: 965593 - DNA, 25 bp, Mus musculus
tatgtcacagatgtggttccaggcc

SEQ ID NO: 965594 - DNA, 25 bp, Mus musculus
tatgtcacagttgtggttccaggcc

SEQ ID NO: 965595 - DNA, 25 bp, Mus musculus
tatgtcagacacaacgttcatcacg

SEQ ID NO: 965596 - DNA, 25 bp, Mus musculus
tatgtcagacacaaggttcatcacg

SEQ ID NO: 965597 - DNA, 25 bp, Mus musculus
tatgtcagaggacgtggagcctact

SEQ ID NO: 965598 - DNA, 25 bp, Mus musculus
tatgtcagaggaggtggagcctact

SEQ ID NO: 965599 - DNA, 25 bp, Mus musculus
tatgtcagtgagcttcctgctgctg

SEQ ID NO: 965600 - DNA, 25 bp, Mus musculus
tatgtcagtgaggttcctgctgctg

SEQ ID NO: 965601 - DNA, 25 bp, Mus musculus
tatgtcatcaaccaccatggcgagg

SEQ ID NO: 965602 - DNA, 25 bp, Mus musculus
tatgtcatcaaccagcatggcgagg

SEQ ID NO: 965603 - DNA, 25 bp, Mus musculus
tatgtcatccaccacgctggaaatg

SEQ ID NO: 965604 - DNA, 25 bp, Mus musculus
tatgtcatccaccaggctggaaatg

SEQ ID NO: 965605 - DNA, 25 bp, Mus musculus
tatgtcatgatgctgtttggccttg

SEQ ID NO: 965606 - DNA, 25 bp, Mus musculus
tatgtcatgatggtgtttggccttg

SEQ ID NO: 965607 - DNA, 25 bp, Mus musculus
tatgtccaccacgacgatctccaag

SEQ ID NO: 965608 - DNA, 25 bp, Mus musculus
tatgtccaccacgaggatctccaag

SEQ ID NO: 965609 - DNA, 25 bp, Mus musculus
tatgtcccagccattttctctatat

SEQ ID NO: 965610 - DNA, 25 bp, Mus musculus
tatgtcccaggcattttctctatat

SEQ ID NO: 965611 - DNA, 25 bp, Mus musculus
tatgtcccatctccccctgaaagga

SEQ ID NO: 965612 - DNA, 25 bp, Mus musculus
tatgtcccatctgcccctgaaagga

SEQ ID NO: 965613 - DNA, 25 bp, Mus musculus
tatgtcctgcatctctttggagagt

SEQ ID NO: 965614 - DNA, 25 bp, Mus musculus
tatgtcctgcatctgtttggagagt

SEQ ID NO: 965615 - DNA, 25 bp, Mus musculus
tatgtctatgacttccccggttttc

SEQ ID NO: 965616 - DNA, 25 bp, Mus musculus
tatgtctatgacttgcccggttttc

SEQ ID NO: 965617 - DNA, 25 bp, Mus musculus
tatgtctctggcattctccttcctg

SEQ ID NO: 965618 - DNA, 25 bp, Mus musculus
tatgtctctggctttctccttcctg

SEQ ID NO: 965619 - DNA, 25 bp, Mus musculus
tatgtctgccagagtgccccaggct

SEQ ID NO: 965620 - DNA, 25 bp, Mus musculus
tatgtctgccagtgtgccccaggct

SEQ ID NO: 965621 - DNA, 25 bp, Mus musculus
tatgtctgtggcaacggcgattcca

SEQ ID NO: 965622 - DNA, 25 bp, Mus musculus
tatgtctgtggcaagggcgattcca

SEQ ID NO: 965623 - DNA, 25 bp, Mus musculus
tatgtcttcagtcacgattttacag

SEQ ID NO: 965624 - DNA, 25 bp, Mus musculus
tatgtcttcagtcaggattttacag

SEQ ID NO: 965625 - DNA, 25 bp, Mus musculus
tatgtgaggaaacacatgcaatacc

SEQ ID NO: 965626 - DNA, 25 bp, Mus musculus
tatgtgaggaaacagatgcaatacc

SEQ ID NO: 965627 - DNA, 25 bp, Mus musculus
tatgtgcaagacggcccccttgaga

SEQ ID NO: 965628 - DNA, 25 bp, Mus musculus
tatgtgcaagtcggcccccttgaga

SEQ ID NO: 965629 - DNA, 25 bp, Mus musculus
tatgtgcagagacacttgcactgtt

SEQ ID NO: 965630 - DNA, 25 bp, Mus musculus
tatgtgcagagacagttgcactgtt

SEQ ID NO: 965631 - DNA, 25 bp, Mus musculus
tatgtgctagccaccagcccccatg

SEQ ID NO: 965632 - DNA, 25 bp, Mus musculus
tatgtgctaggcaccagcccccatg

SEQ ID NO: 965633 - DNA, 25 bp, Mus musculus
tatgtgcttccagacgtttctaagg

SEQ ID NO: 965634 - DNA, 25 bp, Mus musculus
tatgtgcttccagaggtttctaagg

SEQ ID NO: 965635 - DNA, 25 bp, Mus musculus
tatgtggaaaatcgtaaaattgtac

SEQ ID NO: 965636 - DNA, 25 bp, Mus musculus
tatgtggaaaatggtaaaattgtac

SEQ ID NO: 965637 - DNA, 25 bp, Mus musculus
tatgtggaagaccgcaaggggatca

SEQ ID NO: 965638 - DNA, 25 bp, Mus musculus
tatgtggaagacggcaaggggatca

SEQ ID NO: 965639 - DNA, 25 bp, Mus musculus
tatgtggaagcctggattctttaaa

SEQ ID NO: 965640 - DNA, 25 bp, Mus musculus
tatgtggaaggctggattctttaaa

SEQ ID NO: 965641 - DNA, 25 bp, Mus musculus
tatgtgggagcatgatgcaaataaa

SEQ ID NO: 965642 - DNA, 25 bp, Mus musculus
tatgtgggaggatgatgcaaataaa

SEQ ID NO: 965643 - DNA, 25 bp, Mus musculus
tatgtgtagcctcacgatgcctggt

SEQ ID NO: 965644 - DNA, 25 bp, Mus musculus
tatgtgtagcctcaggatgcctggt

SEQ ID NO: 965645 - DNA, 25 bp, Mus musculus
tatgtgtcagcaaggccaaggacat

SEQ ID NO: 965646 - DNA, 25 bp, Mus musculus
tatgtgtcagctaggaaggccaagg

SEQ ID NO: 965647 - DNA, 25 bp, Mus musculus
tatgtgtcaggaaggccaaggacat

SEQ ID NO: 965648 - DNA, 25 bp, Mus musculus
tatgtgtcaggtaggaaggccaagg

SEQ ID NO: 965649 - DNA, 25 bp, Mus musculus
tatgtgtgggaacacctggaaggta

SEQ ID NO: 965650 - DNA, 25 bp, Mus musculus
tatgtgtgggaacagctggaaggta

SEQ ID NO: 965651 - DNA, 25 bp, Mus musculus
tatgttactgagaacgtcctggcgg

SEQ ID NO: 965652 - DNA, 25 bp, Mus musculus
tatgttactgagaaggtcctggcgg

SEQ ID NO: 965653 - DNA, 25 bp, Mus musculus
tatgttatacctcccgcttatacaa

SEQ ID NO: 965654 - DNA, 25 bp, Mus musculus
tatgttatacctccggcttatacaa

SEQ ID NO: 965655 - DNA, 25 bp, Mus musculus
tatgttctacacatcatagaagatg

SEQ ID NO: 965656 - DNA, 25 bp, Mus musculus
tatgttctacacatgatagaagatg

SEQ ID NO: 965657 - DNA, 25 bp, Mus musculus
tatgttctgaaagtctgccccgatt

SEQ ID NO: 965658 - DNA, 25 bp, Mus musculus
tatgttctgaaagtgtgccccgatt

SEQ ID NO: 965659 - DNA, 25 bp, Mus musculus
tatgttgctatgcacaccgagtttc

SEQ ID NO: 965660 - DNA, 25 bp, Mus musculus
tatgttgctatggacaccgagtttc

SEQ ID NO: 965661 - DNA, 25 bp, Mus musculus
tatgttggagagctgatcacaagtg

SEQ ID NO: 965662 - DNA, 25 bp, Mus musculus
tatgttggagaggtgatcacaagtg

SEQ ID NO: 965663 - DNA, 25 bp, Mus musculus
tatgtttgaacacgcccacgaagcc

SEQ ID NO: 965664 - DNA, 25 bp, Mus musculus
tatgtttgaacaggcccacgaagcc

SEQ ID NO: 965665 - DNA, 25 bp, Mus musculus
tattaaccagccagctctaaaacaa

SEQ ID NO: 965666 - DNA, 25 bp, Mus musculus
tattaaccagcctgctctaaaacaa

SEQ ID NO: 965667 - DNA, 25 bp, Mus musculus
tattaagaatgacgtggcgagtggg

SEQ ID NO: 965668 - DNA, 25 bp, Mus musculus
tattaagaatgaggtggcgagtggg

SEQ ID NO: 965669 - DNA, 25 bp, Mus musculus
tattaattagagcaggttcgccttc

SEQ ID NO: 965670 - DNA, 25 bp, Mus musculus
tattaattagaggaggttcgccttc

SEQ ID NO: 965671 - DNA, 25 bp, Mus musculus
tattacaggatagacactaatgctc

SEQ ID NO: 965672 - DNA, 25 bp, Mus musculus
tattacaggatagagactaatgctc

SEQ ID NO: 965673 - DNA, 25 bp, Mus musculus
tattaccaaatgcaacaccgagcgt

SEQ ID NO: 965674 - DNA, 25 bp, Mus musculus
tattaccaaatggaacaccgagcgt

SEQ ID NO: 965675 - DNA, 25 bp, Mus musculus
tattaccacaccgtttatgtttgaa

SEQ ID NO: 965676 - DNA, 25 bp, Mus musculus
tattaccacacgaactgcatgagtg

SEQ ID NO: 965677 - DNA, 25 bp, Mus musculus
tattaccacagcgtttatgtttgaa

SEQ ID NO: 965678 - DNA, 25 bp, Mus musculus
tattaccacaggaactgcatgagtg

SEQ ID NO: 965679 - DNA, 25 bp, Mus musculus
tattacctctccaactgcttgtatg

SEQ ID NO: 965680 - DNA, 25 bp, Mus musculus
tattacctctccaagtgcttgtatg

SEQ ID NO: 965681 - DNA, 25 bp, Mus musculus
tattagaaaaatcataaactttgca

SEQ ID NO: 965682 - DNA, 25 bp, Mus musculus
tattagaaaaatgataaactttgca

SEQ ID NO: 965683 - DNA, 25 bp, Mus musculus
tattagatgtatatgcaggtccctg

SEQ ID NO: 965684 - DNA, 25 bp, Mus musculus
tattagatgtttatgcaggtccctg

SEQ ID NO: 965685 - DNA, 25 bp, Mus musculus
tattatacagcacacagtgatgatg

SEQ ID NO: 965686 - DNA, 25 bp, Mus musculus
tattatacaggacacagtgatgatg

SEQ ID NO: 965687 - DNA, 25 bp, Mus musculus
tattatcagcagctgaacacagagc

SEQ ID NO: 965688 - DNA, 25 bp, Mus musculus
tattatcagcaggtgaacacagagc

SEQ ID NO: 965689 - DNA, 25 bp, Mus musculus
tattatcgttatgagtattggagaa

SEQ ID NO: 965690 - DNA, 25 bp, Mus musculus
tattatcgttttgagtattggagaa

SEQ ID NO: 965691 - DNA, 25 bp, Mus musculus
tattatctgcaaatcagattgtgta

SEQ ID NO: 965692 - DNA, 25 bp, Mus musculus
tattatctgcaattcagattgtgta

SEQ ID NO: 965693 - DNA, 25 bp, Mus musculus
tattattcagctgtggaaagaaata

SEQ ID NO: 965694 - DNA, 25 bp, Mus musculus
tattattcaggtgtggaaagaaata

SEQ ID NO: 965695 - DNA, 25 bp, Mus musculus
tattattccccgtgtggaatattat

SEQ ID NO: 965696 - DNA, 25 bp, Mus musculus
tattattcccggtgtggaatattat

SEQ ID NO: 965697 - DNA, 25 bp, Mus musculus
tattattcctcgaggtgtcccaagc

SEQ ID NO: 965698 - DNA, 25 bp, Mus musculus
tattattcctggaggtgtcccaagc

SEQ ID NO: 965699 - DNA, 25 bp, Mus musculus
tattattgaaaaagagtccaaggga

SEQ ID NO: 965700 - DNA, 25 bp, Mus musculus
tattattgaaaacgcagtgaggagc

SEQ ID NO: 965701 - DNA, 25 bp, Mus musculus
tattattgaaaaggcagtgaggagc

SEQ ID NO: 965702 - DNA, 25 bp, Mus musculus
tattattgaaaatgagtccaaggga

SEQ ID NO: 965703 - DNA, 25 bp, Mus musculus
tattcaaagagacacgctactggaa

SEQ ID NO: 965704 - DNA, 25 bp, Mus musculus
tattcaaagagacaggctactggaa

SEQ ID NO: 965705 - DNA, 25 bp, Mus musculus
tattcaaccacctgtgaccatagcc

SEQ ID NO: 965706 - DNA, 25 bp, Mus musculus
tattcaaccagctgtgaccatagcc

SEQ ID NO: 965707 - DNA, 25 bp, Mus musculus
tattcaagcaaccatttaagaagac

SEQ ID NO: 965708 - DNA, 25 bp, Mus musculus
tattcaagcaacgatttaagaagac

SEQ ID NO: 965709 - DNA, 25 bp, Mus musculus
tattcacaagttgacatgaagcccg

SEQ ID NO: 965710 - DNA, 25 bp, Mus musculus
tattcacaagttgagatgaagcccg

SEQ ID NO: 965711 - DNA, 25 bp, Mus musculus
tattcacagaagcgttgactacagt

SEQ ID NO: 965712 - DNA, 25 bp, Mus musculus
tattcacagaagggttgactacagt

SEQ ID NO: 965713 - DNA, 25 bp, Mus musculus
tattcacattcacgtatcacgtatg

SEQ ID NO: 965714 - DNA, 25 bp, Mus musculus
tattcacattcaggtatcacgtatg

SEQ ID NO: 965715 - DNA, 25 bp, Mus musculus
tattcactggacatcggtgaagaag

SEQ ID NO: 965716 - DNA, 25 bp, Mus musculus
tattcactggacatgggtgaagaag

SEQ ID NO: 965717 - DNA, 25 bp, Mus musculus
tattcatattgtcacgtctgtgttc

SEQ ID NO: 965718 - DNA, 25 bp, Mus musculus
tattcatattgtcaggtctgtgttc

SEQ ID NO: 965719 - DNA, 25 bp, Mus musculus
tattcatcggcacttaaagcctagt

SEQ ID NO: 965720 - DNA, 25 bp, Mus musculus
tattcatcgggacttaaagcctagt

SEQ ID NO: 965721 - DNA, 25 bp, Mus musculus
tattcattacgtaaagaagtactta

SEQ ID NO: 965722 - DNA, 25 bp, Mus musculus
tattcattacgtaatgaagtactta

SEQ ID NO: 965723 - DNA, 25 bp, Mus musculus
tattccaaagatactggcattgccc

SEQ ID NO: 965724 - DNA, 25 bp, Mus musculus
tattccaaagattctggcattgccc

SEQ ID NO: 965725 - DNA, 25 bp, Mus musculus
tattccaaggctatatctcttgatc

SEQ ID NO: 965726 - DNA, 25 bp, Mus musculus
tattccaaggctttatctcttgatc

SEQ ID NO: 965727 - DNA, 25 bp, Mus musculus
tattcctatggtgtcgttctctggg

SEQ ID NO: 965728 - DNA, 25 bp, Mus musculus
tattcctatggtgtggttctctggg

SEQ ID NO: 965729 - DNA, 25 bp, Mus musculus
tattcctcagcttatggctattata

SEQ ID NO: 965730 - DNA, 25 bp, Mus musculus
tattcctcaggttatggctattata

SEQ ID NO: 965731 - DNA, 25 bp, Mus musculus
tattcctcgcctgtcaactcatcag

SEQ ID NO: 965732 - DNA, 25 bp, Mus musculus
tattcctcgcctgtgaactcatcag

SEQ ID NO: 965733 - DNA, 25 bp, Mus musculus
tattccttggagagactctcccttg

SEQ ID NO: 965734 - DNA, 25 bp, Mus musculus
tattccttggagtgactctcccttg

SEQ ID NO: 965735 - DNA, 25 bp, Mus musculus
tattcgaaacatgcactgctgtcta

SEQ ID NO: 965736 - DNA, 25 bp, Mus musculus
tattcgaaacttgcactgctgtcta

SEQ ID NO: 965737 - DNA, 25 bp, Mus musculus
tattcgaagcaccaaatcaagagaa

SEQ ID NO: 965738 - DNA, 25 bp, Mus musculus
tattcgaagcaccatatcaagagaa

SEQ ID NO: 965739 - DNA, 25 bp, Mus musculus
tattcgggagcacatagaatggact

SEQ ID NO: 965740 - DNA, 25 bp, Mus musculus
tattcgggaggacatagaatggact

SEQ ID NO: 965741 - DNA, 25 bp, Mus musculus
tattcggtgcctaatgggaagatcc

SEQ ID NO: 965742 - DNA, 25 bp, Mus musculus
tattcggtgccttatgggaagatcc

SEQ ID NO: 965743 - DNA, 25 bp, Mus musculus
tattcgtgagcgccaattcaaatga

SEQ ID NO: 965744 - DNA, 25 bp, Mus musculus
tattcgtgagcgctctctgctctct

SEQ ID NO: 965745 - DNA, 25 bp, Mus musculus
tattcgtgagcggcaattcaaatga

SEQ ID NO: 965746 - DNA, 25 bp, Mus musculus
tattcgtgagcggtctctgctctct

SEQ ID NO: 965747 - DNA, 25 bp, Mus musculus
tattcgtgatggccttttggccaga

SEQ ID NO: 965748 - DNA, 25 bp, Mus musculus
tattcgtgatgggcttttggccaga

SEQ ID NO: 965749 - DNA, 25 bp, Mus musculus
tattctaagcagatgctaccaagta

SEQ ID NO: 965750 - DNA, 25 bp, Mus musculus
tattctaagcagcaagatgctacca

SEQ ID NO: 965751 - DNA, 25 bp, Mus musculus
tattctaagcaggaagatgctacca

SEQ ID NO: 965752 - DNA, 25 bp, Mus musculus
tattctaagcagttgctaccaagta

SEQ ID NO: 965753 - DNA, 25 bp, Mus musculus
tattctacagcccaggagtgttcgc

SEQ ID NO: 965754 - DNA, 25 bp, Mus musculus
tattctacagctcaagactgcagtg

SEQ ID NO: 965755 - DNA, 25 bp, Mus musculus
tattctacagctgaggaatgtgctg

SEQ ID NO: 965756 - DNA, 25 bp, Mus musculus
tattctacaggccaggagtgttcgc

SEQ ID NO: 965757 - DNA, 25 bp, Mus musculus
tattctacaggtcaagactgcagtg

SEQ ID NO: 965758 - DNA, 25 bp, Mus musculus
tattctacaggtgaggaatgtgctg

SEQ ID NO: 965759 - DNA, 25 bp, Mus musculus
tattctagagcgtggatacaatttg

SEQ ID NO: 965760 - DNA, 25 bp, Mus musculus
tattctagagggtggatacaatttg

SEQ ID NO: 965761 - DNA, 25 bp, Mus musculus
tattctcagcagcatgcccaggaat

SEQ ID NO: 965762 - DNA, 25 bp, Mus musculus
tattctcagcaggatgcccaggaat

SEQ ID NO: 965763 - DNA, 25 bp, Mus musculus
tattctgcctggctgctgtaaaagg

SEQ ID NO: 965764 - DNA, 25 bp, Mus musculus
tattctgcctgggtgctgtaaaagg

SEQ ID NO: 965765 - DNA, 25 bp, Mus musculus
tattctgcctttgaaacagacataa

SEQ ID NO: 965766 - DNA, 25 bp, Mus musculus
tattctgcctttgaacatgattctg

SEQ ID NO: 965767 - DNA, 25 bp, Mus musculus
tattctgcctttgatacagacataa

SEQ ID NO: 965768 - DNA, 25 bp, Mus musculus
tattctgcctttgatcatgattctg

SEQ ID NO: 965769 - DNA, 25 bp, Mus musculus
tattctggagaccccacccaaagga

SEQ ID NO: 965770 - DNA, 25 bp, Mus musculus
tattctggagtccccacccaaagga

SEQ ID NO: 965771 - DNA, 25 bp, Mus musculus
tattctgtgaagaaaatgatgaagg

SEQ ID NO: 965772 - DNA, 25 bp, Mus musculus
tattctgtgaagtaaatgatgaagg

SEQ ID NO: 965773 - DNA, 25 bp, Mus musculus
tattcttcggatcatatcaacaagt

SEQ ID NO: 965774 - DNA, 25 bp, Mus musculus
tattcttcggatgatatcaacaagt

SEQ ID NO: 965775 - DNA, 25 bp, Mus musculus
tattgaaaagccagtgaggagcagt

SEQ ID NO: 965776 - DNA, 25 bp, Mus musculus
tattgaaaaggcagtgaggagcagt

SEQ ID NO: 965777 - DNA, 25 bp, Mus musculus
tattgaaaatcagtccaagggacag

SEQ ID NO: 965778 - DNA, 25 bp, Mus musculus
tattgaaaatgagtccaagggacag

SEQ ID NO: 965779 - DNA, 25 bp, Mus musculus
tattgaaaggctatgaatctccaga

SEQ ID NO: 965780 - DNA, 25 bp, Mus musculus
tattgaaagggtatgaatctccaga

SEQ ID NO: 965781 - DNA, 25 bp, Mus musculus
tattgaacagctcggaaggagactg

SEQ ID NO: 965782 - DNA, 25 bp, Mus musculus
tattgaacagctgggaaggagactg

SEQ ID NO: 965783 - DNA, 25 bp, Mus musculus
tattgaagaaaactttcaggccgca

SEQ ID NO: 965784 - DNA, 25 bp, Mus musculus
tattgaagaaaagtttcaggccgca

SEQ ID NO: 965785 - DNA, 25 bp, Mus musculus
tattgaaggaaacttgccgccaatg

SEQ ID NO: 965786 - DNA, 25 bp, Mus musculus
tattgaaggaaagttgccgccaatg

SEQ ID NO: 965787 - DNA, 25 bp, Mus musculus
tattgagataaaagccagagttact

SEQ ID NO: 965788 - DNA, 25 bp, Mus musculus
tattgagataaatgccagagttact

SEQ ID NO: 965789 - DNA, 25 bp, Mus musculus
tattgagcagattctcgactatctc

SEQ ID NO: 965790 - DNA, 25 bp, Mus musculus
tattgagcagtttctcgactatctc

SEQ ID NO: 965791 - DNA, 25 bp, Mus musculus
tattgatgaaacaacgcgactgctg

SEQ ID NO: 965792 - DNA, 25 bp, Mus musculus
tattgatgaaacaaggcgactgctg

SEQ ID NO: 965793 - DNA, 25 bp, Mus musculus
tattgatttgcccccatcaagaaat

SEQ ID NO: 965794 - DNA, 25 bp, Mus musculus
tattgatttggccccatcaagaaat

SEQ ID NO: 965795 - DNA, 25 bp, Mus musculus
tattgcactccgactacatccggag

SEQ ID NO: 965796 - DNA, 25 bp, Mus musculus
tattgcactccgtctacatccggag

SEQ ID NO: 965797 - DNA, 25 bp, Mus musculus
tattgcatatagtcctgatgggaaa

SEQ ID NO: 965798 - DNA, 25 bp, Mus musculus
tattgcatattgtcctgatgggaaa

SEQ ID NO: 965799 - DNA, 25 bp, Mus musculus
tattgccacaggcacgagagatggc

SEQ ID NO: 965800 - DNA, 25 bp, Mus musculus
tattgccacagggacgagagatggc

SEQ ID NO: 965801 - DNA, 25 bp, Mus musculus
tattgctaagctgacaagcaagaag

SEQ ID NO: 965802 - DNA, 25 bp, Mus musculus
tattgctaaggtgacaagcaagaag

SEQ ID NO: 965803 - DNA, 25 bp, Mus musculus
tattggaatgctgccaacacgccct

SEQ ID NO: 965804 - DNA, 25 bp, Mus musculus
tattggaatggtgccaacacgccct

SEQ ID NO: 965805 - DNA, 25 bp, Mus musculus
tattggacgtaacatcgaacaacag

SEQ ID NO: 965806 - DNA, 25 bp, Mus musculus
tattggacgtaagatcgaacaacag

SEQ ID NO: 965807 - DNA, 25 bp, Mus musculus
tattggacttgcaactctctttaca

SEQ ID NO: 965808 - DNA, 25 bp, Mus musculus
tattggacttgcaagtctctttaca

SEQ ID NO: 965809 - DNA, 25 bp, Mus musculus
tattggagacaacttagtaggagga

SEQ ID NO: 965810 - DNA, 25 bp, Mus musculus
tattggagacaagttagtaggagga

SEQ ID NO: 965811 - DNA, 25 bp, Mus musculus
tattggcacaagctgcaaatataaa

SEQ ID NO: 965812 - DNA, 25 bp, Mus musculus
tattggcacaaggtgcaaatataaa

SEQ ID NO: 965813 - DNA, 25 bp, Mus musculus
tattggctcctccacggtccggtac

SEQ ID NO: 965814 - DNA, 25 bp, Mus musculus
tattggctcctccacgtgtttgtgg

SEQ ID NO: 965815 - DNA, 25 bp, Mus musculus
tattggctcctccagggtccggtac

SEQ ID NO: 965816 - DNA, 25 bp, Mus musculus
tattggctcctccaggtgtttgtgg

SEQ ID NO: 965817 - DNA, 25 bp, Mus musculus
tattggctggaccacatgcggtgag

SEQ ID NO: 965818 - DNA, 25 bp, Mus musculus
tattggctggaccagatgcggtgag

SEQ ID NO: 965819 - DNA, 25 bp, Mus musculus
tattggctggccaatgaatgcagcc

SEQ ID NO: 965820 - DNA, 25 bp, Mus musculus
tattggctgggcaatgaatgcagcc

SEQ ID NO: 965821 - DNA, 25 bp, Mus musculus
tattggtgagcttccaatttcattt

SEQ ID NO: 965822 - DNA, 25 bp, Mus musculus
tattggtgaggttccaatttcattt

SEQ ID NO: 965823 - DNA, 25 bp, Mus musculus
tattgtagacagctactggcatagc

SEQ ID NO: 965824 - DNA, 25 bp, Mus musculus
tattgtagacaggtactggcatagc

SEQ ID NO: 965825 - DNA, 25 bp, Mus musculus
tattgtagtaagccaattaccttga

SEQ ID NO: 965826 - DNA, 25 bp, Mus musculus
tattgtagtaaggcaattaccttga

SEQ ID NO: 965827 - DNA, 25 bp, Mus musculus
tattgtattccactttgactgtacc

SEQ ID NO: 965828 - DNA, 25 bp, Mus musculus
tattgtattccagtttgactgtacc

SEQ ID NO: 965829 - DNA, 25 bp, Mus musculus
tattgttgaacacgtctcggtgctg

SEQ ID NO: 965830 - DNA, 25 bp, Mus musculus
tattgttgaacaggtctcggtgctg

SEQ ID NO: 965831 - DNA, 25 bp, Mus musculus
tatttcagttgacacgagccgtcta

SEQ ID NO: 965832 - DNA, 25 bp, Mus musculus
tatttcagttgacacggaacagtcc

SEQ ID NO: 965833 - DNA, 25 bp, Mus musculus
tatttcagttgacaggagccgtcta

SEQ ID NO: 965834 - DNA, 25 bp, Mus musculus
tatttcagttgacagggaacagtcc

SEQ ID NO: 965835 - DNA, 25 bp, Mus musculus
tatttcatgctgcatgacctcaatg

SEQ ID NO: 965836 - DNA, 25 bp, Mus musculus
tatttcatgctggatgacctcaatg

SEQ ID NO: 965837 - DNA, 25 bp, Mus musculus
tatttccaagattcactcagtgtct

SEQ ID NO: 965838 - DNA, 25 bp, Mus musculus
tatttccaagtttcactcagtgtct

SEQ ID NO: 965839 - DNA, 25 bp, Mus musculus
tatttcccacagccctatatgaact

SEQ ID NO: 965840 - DNA, 25 bp, Mus musculus
tatttcccacaggcctatatgaact

SEQ ID NO: 965841 - DNA, 25 bp, Mus musculus
tatttccctggacacgtattacgcc

SEQ ID NO: 965842 - DNA, 25 bp, Mus musculus
tatttccctggacaggtattacgcc

SEQ ID NO: 965843 - DNA, 25 bp, Mus musculus
tatttccctgttaacaatgtgattg

SEQ ID NO: 965844 - DNA, 25 bp, Mus musculus
tatttccctgttaagaatgtgattg

SEQ ID NO: 965845 - DNA, 25 bp, Mus musculus
tatttctctgcacgattacattgct

SEQ ID NO: 965846 - DNA, 25 bp, Mus musculus
tatttctctgcaggattacattgct

SEQ ID NO: 965847 - DNA, 25 bp, Mus musculus
tatttctgagcctgttatccagaag

SEQ ID NO: 965848 - DNA, 25 bp, Mus musculus
tatttctgaggctgttatccagaag

SEQ ID NO: 965849 - DNA, 25 bp, Mus musculus
tatttcttggctggaatataaataa

SEQ ID NO: 965850 - DNA, 25 bp, Mus musculus
tatttcttgggtggaatataaataa

SEQ ID NO: 965851 - DNA, 25 bp, Mus musculus
tatttctttcagcgcttcacatttg

SEQ ID NO: 965852 - DNA, 25 bp, Mus musculus
tatttctttcagggcttcacatttg

SEQ ID NO: 965853 - DNA, 25 bp, Mus musculus
tatttgctggaagacaaagaacggg

SEQ ID NO: 965854 - DNA, 25 bp, Mus musculus
tatttgctggaagagaaagaacggg

SEQ ID NO: 965855 - DNA, 25 bp, Mus musculus
tatttggagacacaaaagccaccac

SEQ ID NO: 965856 - DNA, 25 bp, Mus musculus
tatttggagacagaaaagccaccac

SEQ ID NO: 965857 - DNA, 25 bp, Mus musculus
tatttggctttgctcaatgaagtaa

SEQ ID NO: 965858 - DNA, 25 bp, Mus musculus
tatttggctttgctgaatgaagtaa

SEQ ID NO: 965859 - DNA, 25 bp, Mus musculus
tatttgggaaagaacgttacccatg

SEQ ID NO: 965860 - DNA, 25 bp, Mus musculus
tatttgggaaagaaggttacccatg

SEQ ID NO: 965861 - DNA, 25 bp, Mus musculus
tatttgtcacaggaccatcagcagc

SEQ ID NO: 965862 - DNA, 25 bp, Mus musculus
tatttgtcacaggagcatcagcagc

SEQ ID NO: 965863 - DNA, 25 bp, Mus musculus
tatttgtggaaacaatgtacagacg

SEQ ID NO: 965864 - DNA, 25 bp, Mus musculus
tatttgtggaaagaatgtacagacg

SEQ ID NO: 965865 - DNA, 25 bp, Mus musculus
tattttaagactcagagtgaagggc

SEQ ID NO: 965866 - DNA, 25 bp, Mus musculus
tattttaagactgagagtgaagggc

SEQ ID NO: 965867 - DNA, 25 bp, Mus musculus
tattttacagagaaaatgtgctatt

SEQ ID NO: 965868 - DNA, 25 bp, Mus musculus
tattttacagtgaaaatgtgctatt

SEQ ID NO: 965869 - DNA, 25 bp, Mus musculus
tattttagccaccacgacacagaat

SEQ ID NO: 965870 - DNA, 25 bp, Mus musculus
tattttagccaccaggacacagaat

SEQ ID NO: 965871 - DNA, 25 bp, Mus musculus
tattttagttaacggagtggatgag

SEQ ID NO: 965872 - DNA, 25 bp, Mus musculus
tattttagttaagggagtggatgag

SEQ ID NO: 965873 - DNA, 25 bp, Mus musculus
tattttatttatttcagtaatgtga

SEQ ID NO: 965874 - DNA, 25 bp, Mus musculus
tattttatttttttcagtaatgtga

SEQ ID NO: 965875 - DNA, 25 bp, Mus musculus
tattttcacaaactggctacaggat

SEQ ID NO: 965876 - DNA, 25 bp, Mus musculus
tattttcacaaagtggctacaggat

SEQ ID NO: 965877 - DNA, 25 bp, Mus musculus
tattttccaatctgacttgtcaaaa

SEQ ID NO: 965878 - DNA, 25 bp, Mus musculus
tattttccaatctgtcttgtcaaaa

SEQ ID NO: 965879 - DNA, 25 bp, Mus musculus
tattttctgaatcacggagtcaaag

SEQ ID NO: 965880 - DNA, 25 bp, Mus musculus
tattttctgaatcacgtgtcgagtg

SEQ ID NO: 965881 - DNA, 25 bp, Mus musculus
tattttctgaatcagggagtcaaag

SEQ ID NO: 965882 - DNA, 25 bp, Mus musculus
tattttctgaatcaggtgtcgagtg

SEQ ID NO: 965883 - DNA, 25 bp, Mus musculus
tattttctttactacgctgattgag

SEQ ID NO: 965884 - DNA, 25 bp, Mus musculus
tattttctttactaggctgattgag

SEQ ID NO: 965885 - DNA, 25 bp, Mus musculus
tattttggagcttgtccagacaaag

SEQ ID NO: 965886 - DNA, 25 bp, Mus musculus
tattttggaggttgtccagacaaag

SEQ ID NO: 965887 - DNA, 25 bp, Mus musculus
tattttgggttgagcttttgggcag

SEQ ID NO: 965888 - DNA, 25 bp, Mus musculus
tattttgggttgaggttttgggcag

SEQ ID NO: 965889 - DNA, 25 bp, Mus musculus
tatttttttgaacattggacctgcc

SEQ ID NO: 965890 - DNA, 25 bp, Mus musculus
tatttttttgaagattggacctgcc

SEQ ID NO: 965891 - DNA, 25 bp, Mus musculus
tcaaaaaacccaaggtgatgctgac

SEQ ID NO: 965892 - DNA, 25 bp, Mus musculus
tcaaaaaacccatggtgatgctgac

SEQ ID NO: 965893 - DNA, 25 bp, Mus musculus
tcaaaaaagccacgcctctgatcct

SEQ ID NO: 965894 - DNA, 25 bp, Mus musculus
tcaaaaaagccaggcctctgatcct

SEQ ID NO: 965895 - DNA, 25 bp, Mus musculus
tcaaaaagcacacaacaagcctgcc

SEQ ID NO: 965896 - DNA, 25 bp, Mus musculus
tcaaaaagcacagaacaagcctgcc

SEQ ID NO: 965897 - DNA, 25 bp, Mus musculus
tcaaaaagcttgcacaatctttatc

SEQ ID NO: 965898 - DNA, 25 bp, Mus musculus
tcaaaaagcttgcagaatctttatc

SEQ ID NO: 965899 - DNA, 25 bp, Mus musculus
tcaaaaccaaacaatttgctcctat

SEQ ID NO: 965900 - DNA, 25 bp, Mus musculus
tcaaaaccaaactatttgctcctat

SEQ ID NO: 965901 - DNA, 25 bp, Mus musculus
tcaaaaccagcagagaaaaataatg

SEQ ID NO: 965902 - DNA, 25 bp, Mus musculus
tcaaaaccaggagagaaaaataatg

SEQ ID NO: 965903 - DNA, 25 bp, Mus musculus
tcaaaacccagacggccagtaagag

SEQ ID NO: 965904 - DNA, 25 bp, Mus musculus
tcaaaacccagagggccagtaagag

SEQ ID NO: 965905 - DNA, 25 bp, Mus musculus
tcaaaacctgaacgaactgagagag

SEQ ID NO: 965906 - DNA, 25 bp, Mus musculus
tcaaaacctgaaggaactgagagag

SEQ ID NO: 965907 - DNA, 25 bp, Mus musculus
tcaaaactgcaacttgcacccagct

SEQ ID NO: 965908 - DNA, 25 bp, Mus musculus
tcaaaactgcaagttgcacccagct

SEQ ID NO: 965909 - DNA, 25 bp, Mus musculus
tcaaaagctgcctggtatgattggc

SEQ ID NO: 965910 - DNA, 25 bp, Mus musculus
tcaaaagctggctggtatgattggc

SEQ ID NO: 965911 - DNA, 25 bp, Mus musculus
tcaaaaggagagagaaaattcatcg

SEQ ID NO: 965912 - DNA, 25 bp, Mus musculus
tcaaaaggagctctgtggggcttac

SEQ ID NO: 965913 - DNA, 25 bp, Mus musculus
tcaaaaggaggtctgtggggcttac

SEQ ID NO: 965914 - DNA, 25 bp, Mus musculus
tcaaaaggagtgagaaaattcatcg

SEQ ID NO: 965915 - DNA, 25 bp, Mus musculus
tcaaaatgtgcctctcccagtgtct

SEQ ID NO: 965916 - DNA, 25 bp, Mus musculus
tcaaaatgtggctctcccagtgtct

SEQ ID NO: 965917 - DNA, 25 bp, Mus musculus
tcaaaattagctgtgaacattttcg

SEQ ID NO: 965918 - DNA, 25 bp, Mus musculus
tcaaaattaggtgtgaacattttcg

SEQ ID NO: 965919 - DNA, 25 bp, Mus musculus
tcaaacacagctcaaagattagaac

SEQ ID NO: 965920 - DNA, 25 bp, Mus musculus
tcaaacacaggtcaaagattagaac

SEQ ID NO: 965921 - DNA, 25 bp, Mus musculus
tcaaacacatccacttcagcacctc

SEQ ID NO: 965922 - DNA, 25 bp, Mus musculus
tcaaacacatctgactctcctattc

SEQ ID NO: 965923 - DNA, 25 bp, Mus musculus
tcaaacacatgcacttcagcacctc

SEQ ID NO: 965924 - DNA, 25 bp, Mus musculus
tcaaacacatgtgactctcctattc

SEQ ID NO: 965925 - DNA, 25 bp, Mus musculus
tcaaacagatgaagatcattcacca

SEQ ID NO: 965926 - DNA, 25 bp, Mus musculus
tcaaacagatgaagattatccacca

SEQ ID NO: 965927 - DNA, 25 bp, Mus musculus
tcaaacagatgatgatcattcacca

SEQ ID NO: 965928 - DNA, 25 bp, Mus musculus
tcaaacagatgatgattatccacca

SEQ ID NO: 965929 - DNA, 25 bp, Mus musculus
tcaaacatccagctggctctggtcc

SEQ ID NO: 965930 - DNA, 25 bp, Mus musculus
tcaaacatccaggtggctctggtcc

SEQ ID NO: 965931 - DNA, 25 bp, Mus musculus
tcaaaccaaacatagcagagattct

SEQ ID NO: 965932 - DNA, 25 bp, Mus musculus
tcaaaccaaagatagcagagattct

SEQ ID NO: 965933 - DNA, 25 bp, Mus musculus
tcaaaccaagaccctccaccagctg

SEQ ID NO: 965934 - DNA, 25 bp, Mus musculus
tcaaaccaagagtggcctccctcac

SEQ ID NO: 965935 - DNA, 25 bp, Mus musculus
tcaaaccaagtccctccaccagctg

SEQ ID NO: 965936 - DNA, 25 bp, Mus musculus
tcaaaccaagtgtggcctccctcac

SEQ ID NO: 965937 - DNA, 25 bp, Mus musculus
tcaaactatcagctactctatctac

SEQ ID NO: 965938 - DNA, 25 bp, Mus musculus
tcaaactatcaggtactctatctac

SEQ ID NO: 965939 - DNA, 25 bp, Mus musculus
tcaaactgaaaaccagcaccgagct

SEQ ID NO: 965940 - DNA, 25 bp, Mus musculus
tcaaactgaataccagcaccgagct

SEQ ID NO: 965941 - DNA, 25 bp, Mus musculus
tcaaactgctgaaagcgctgagagt

SEQ ID NO: 965942 - DNA, 25 bp, Mus musculus
tcaaactgctgatagcgctgagagt

SEQ ID NO: 965943 - DNA, 25 bp, Mus musculus
tcaaagaaagaacacttgtttatgg

SEQ ID NO: 965944 - DNA, 25 bp, Mus musculus
tcaaagaaagaacagttgtttatgg

SEQ ID NO: 965945 - DNA, 25 bp, Mus musculus
tcaaagaattctgcaaaaatacttg

SEQ ID NO: 965946 - DNA, 25 bp, Mus musculus
tcaaagaattgtgcaaaaatacttg

SEQ ID NO: 965947 - DNA, 25 bp, Mus musculus
tcaaagacaacaacacctacaccgt

SEQ ID NO: 965948 - DNA, 25 bp, Mus musculus
tcaaagacaagaacacctacaccgt

SEQ ID NO: 965949 - DNA, 25 bp, Mus musculus
tcaaagacaagacgtggacacgcat

SEQ ID NO: 965950 - DNA, 25 bp, Mus musculus
tcaaagacaagaggtggacacgcat

SEQ ID NO: 965951 - DNA, 25 bp, Mus musculus
tcaaagaccccaagaggaggatgac

SEQ ID NO: 965952 - DNA, 25 bp, Mus musculus
tcaaagaccccatgaggaggatgac

SEQ ID NO: 965953 - DNA, 25 bp, Mus musculus
tcaaagactgccttactaaagatca

SEQ ID NO: 965954 - DNA, 25 bp, Mus musculus
tcaaagactggcttactaaagatca

SEQ ID NO: 965955 - DNA, 25 bp, Mus musculus
tcaaagagaaaacacgcatgtaatg

SEQ ID NO: 965956 - DNA, 25 bp, Mus musculus
tcaaagagaaaacacgtctcagcat

SEQ ID NO: 965957 - DNA, 25 bp, Mus musculus
tcaaagagaaaacaggcatgtaatg

SEQ ID NO: 965958 - DNA, 25 bp, Mus musculus
tcaaagagaaaacaggtctcagcat

SEQ ID NO: 965959 - DNA, 25 bp, Mus musculus
tcaaagagacagcctactggaatgt

SEQ ID NO: 965960 - DNA, 25 bp, Mus musculus
tcaaagagacaggctactggaatgt

SEQ ID NO: 965961 - DNA, 25 bp, Mus musculus
tcaaagagcaagagaaagcagcagc

SEQ ID NO: 965962 - DNA, 25 bp, Mus musculus
tcaaagagcaagtgaaagcagcagc

SEQ ID NO: 965963 - DNA, 25 bp, Mus musculus
tcaaagcaacaggaactttgcatca

SEQ ID NO: 965964 - DNA, 25 bp, Mus musculus
tcaaagcaacaggatctttgcatca

SEQ ID NO: 965965 - DNA, 25 bp, Mus musculus
tcaaagcaacccaaagccacggatt

SEQ ID NO: 965966 - DNA, 25 bp, Mus musculus
tcaaagcaacgcaaagccacggatt

SEQ ID NO: 965967 - DNA, 25 bp, Mus musculus
tcaaagcagaagcctcctgccaaag

SEQ ID NO: 965968 - DNA, 25 bp, Mus musculus
tcaaagcagatgcctcctgccaaag

SEQ ID NO: 965969 - DNA, 25 bp, Mus musculus
tcaaagcagctcataaagcaatggt

SEQ ID NO: 965970 - DNA, 25 bp, Mus musculus
tcaaagcagctcttaaagcaatggt

SEQ ID NO: 965971 - DNA, 25 bp, Mus musculus
tcaaagcagtcccgcatgaggatcg

SEQ ID NO: 965972 - DNA, 25 bp, Mus musculus
tcaaagcagtccggcatgaggatcg

SEQ ID NO: 965973 - DNA, 25 bp, Mus musculus
tcaaagccagcgtctcttgtggtac

SEQ ID NO: 965974 - DNA, 25 bp, Mus musculus
tcaaagccagctgccagctgggacc

SEQ ID NO: 965975 - DNA, 25 bp, Mus musculus
tcaaagccagggtctcttgtggtac

SEQ ID NO: 965976 - DNA, 25 bp, Mus musculus
tcaaagccaggtgccagctgggacc

SEQ ID NO: 965977 - DNA, 25 bp, Mus musculus
tcaaagcctgcgacgtatgtgatga

SEQ ID NO: 965978 - DNA, 25 bp, Mus musculus
tcaaagcctgggacgtatgtgatga

SEQ ID NO: 965979 - DNA, 25 bp, Mus musculus
tcaaaggagaagagcagtttggctc

SEQ ID NO: 965980 - DNA, 25 bp, Mus musculus
tcaaaggagaagtgcagtttggctc

SEQ ID NO: 965981 - DNA, 25 bp, Mus musculus
tcaaaggcaatgaccacctggacca

SEQ ID NO: 965982 - DNA, 25 bp, Mus musculus
tcaaaggcaatgacgacctggacca

SEQ ID NO: 965983 - DNA, 25 bp, Mus musculus
tcaaaggcagcttcggggctggcca

SEQ ID NO: 965984 - DNA, 25 bp, Mus musculus
tcaaaggcaggttcggggctggcca

SEQ ID NO: 965985 - DNA, 25 bp, Mus musculus
tcaaaggctcagcttgccaaagaaa

SEQ ID NO: 965986 - DNA, 25 bp, Mus musculus
tcaaaggctcaggttgccaaagaaa

SEQ ID NO: 965987 - DNA, 25 bp, Mus musculus
tcaaaggtcaagacaatctgatcaa

SEQ ID NO: 965988 - DNA, 25 bp, Mus musculus
tcaaaggtcaagtcaatctgatcaa

SEQ ID NO: 965989 - DNA, 25 bp, Mus musculus
tcaaagtagaagcttacatccaggc

SEQ ID NO: 965990 - DNA, 25 bp, Mus musculus
tcaaagtagaaggttacatccaggc

SEQ ID NO: 965991 - DNA, 25 bp, Mus musculus
tcaaagtcagaagtaaagccatcat

SEQ ID NO: 965992 - DNA, 25 bp, Mus musculus
tcaaagtcagtagtaaagccatcat

SEQ ID NO: 965993 - DNA, 25 bp, Mus musculus
tcaaagtcattcccacacccccggc

SEQ ID NO: 965994 - DNA, 25 bp, Mus musculus
tcaaagtcattcgcacacccccggc

SEQ ID NO: 965995 - DNA, 25 bp, Mus musculus
tcaaatacaaagcttaccaagaaga

SEQ ID NO: 965996 - DNA, 25 bp, Mus musculus
tcaaatacaaaggttaccaagaaga

SEQ ID NO: 965997 - DNA, 25 bp, Mus musculus
tcaaatactgaactgtccctgatgg

SEQ ID NO: 965998 - DNA, 25 bp, Mus musculus
tcaaatactgtactgtccctgatgg

SEQ ID NO: 965999 - DNA, 25 bp, Mus musculus
tcaaatcagagtagggaatacacct

SEQ ID NO: 966000 - DNA, 25 bp, Mus musculus
tcaaatcagagttgggaatacacct

SEQ ID NO: 966001 - DNA, 25 bp, Mus musculus
tcaaatccagcgacaaatttagtct

SEQ ID NO: 966002 - DNA, 25 bp, Mus musculus
tcaaatccagggacaaatttagtct

SEQ ID NO: 966003 - DNA, 25 bp, Mus musculus
tcaaatgcagagtgttctctgccta

SEQ ID NO: 966004 - DNA, 25 bp, Mus musculus
tcaaatgcagtgtgttctctgccta

SEQ ID NO: 966005 - DNA, 25 bp, Mus musculus
tcaaatgcatcaaggctgccatcag

SEQ ID NO: 966006 - DNA, 25 bp, Mus musculus
tcaaatgcatcatggctgccatcag

SEQ ID NO: 966007 - DNA, 25 bp, Mus musculus
tcaaatgtgaaaaactattcaaaca

SEQ ID NO: 966008 - DNA, 25 bp, Mus musculus
tcaaatgtgaaaaagtattcaaaca

SEQ ID NO: 966009 - DNA, 25 bp, Mus musculus
tcaaatgttgtgacctctgttgtgc

SEQ ID NO: 966010 - DNA, 25 bp, Mus musculus
tcaaatgttgtgccagaataccaga

SEQ ID NO: 966011 - DNA, 25 bp, Mus musculus
tcaaatgttgtggcagaataccaga

SEQ ID NO: 966012 - DNA, 25 bp, Mus musculus
tcaaatgttgtgtcctctgttgtgc

SEQ ID NO: 966013 - DNA, 25 bp, Mus musculus
tcaaattctcagcacagcagccctc

SEQ ID NO: 966014 - DNA, 25 bp, Mus musculus
tcaaattctcaggacagcagccctc

SEQ ID NO: 966015 - DNA, 25 bp, Mus musculus
tcaaattctcataagacgtctgtga

SEQ ID NO: 966016 - DNA, 25 bp, Mus musculus
tcaaattctcattagacgtctgtga

SEQ ID NO: 966017 - DNA, 25 bp, Mus musculus
tcaaattgaagcagcaggcaatttg

SEQ ID NO: 966018 - DNA, 25 bp, Mus musculus
tcaaattgaagcaggaggcaatttg

SEQ ID NO: 966019 - DNA, 25 bp, Mus musculus
tcaaattgagaattattttggagac

SEQ ID NO: 966020 - DNA, 25 bp, Mus musculus
tcaaattgagtattattttggagac

SEQ ID NO: 966021 - DNA, 25 bp, Mus musculus
tcaaatttgatgatcccaaatttga

SEQ ID NO: 966022 - DNA, 25 bp, Mus musculus
tcaaatttgatgttcccaaatttga

SEQ ID NO: 966023 - DNA, 25 bp, Mus musculus
tcaacaaacctgcttggcatggaca

SEQ ID NO: 966024 - DNA, 25 bp, Mus musculus
tcaacaaacctggttggcatggaca

SEQ ID NO: 966025 - DNA, 25 bp, Mus musculus
tcaacaacagctattccaaagaccc

SEQ ID NO: 966026 - DNA, 25 bp, Mus musculus
tcaacaacaggtattccaaagaccc

SEQ ID NO: 966027 - DNA, 25 bp, Mus musculus
tcaacaagacagaaggtgaagatga

SEQ ID NO: 966028 - DNA, 25 bp, Mus musculus
tcaacaagacagcttgtcctccaaa

SEQ ID NO: 966029 - DNA, 25 bp, Mus musculus
tcaacaagacaggttgtcctccaaa

SEQ ID NO: 966030 - DNA, 25 bp, Mus musculus
tcaacaagacagtaggtgaagatga

SEQ ID NO: 966031 - DNA, 25 bp, Mus musculus
tcaacaatccctccagaactggtga

SEQ ID NO: 966032 - DNA, 25 bp, Mus musculus
tcaacaatccctcctgaactggtga

SEQ ID NO: 966033 - DNA, 25 bp, Mus musculus
tcaacaatgcaaagtatgccatctc

SEQ ID NO: 966034 - DNA, 25 bp, Mus musculus
tcaacaatgcaatgtatgccatctc

SEQ ID NO: 966035 - DNA, 25 bp, Mus musculus
tcaacacaccctttggggcgatggt

SEQ ID NO: 966036 - DNA, 25 bp, Mus musculus
tcaacacaccgtttggggcgatggt

SEQ ID NO: 966037 - DNA, 25 bp, Mus musculus
tcaacaccagataatgtgtcttgga

SEQ ID NO: 966038 - DNA, 25 bp, Mus musculus
tcaacaccagttaatgtgtcttgga

SEQ ID NO: 966039 - DNA, 25 bp, Mus musculus
tcaacactgacacgagtctggtgtg

SEQ ID NO: 966040 - DNA, 25 bp, Mus musculus
tcaacactgacaggagtctggtgtg

SEQ ID NO: 966041 - DNA, 25 bp, Mus musculus
tcaacactggccgacggatggaatt

SEQ ID NO: 966042 - DNA, 25 bp, Mus musculus
tcaacactggccgagggatggaatt

SEQ ID NO: 966043 - DNA, 25 bp, Mus musculus
tcaacactgttgctcaggagcttct

SEQ ID NO: 966044 - DNA, 25 bp, Mus musculus
tcaacactgttggtcaggagcttct

SEQ ID NO: 966045 - DNA, 25 bp, Mus musculus
tcaacagaacagagctcttggctcc

SEQ ID NO: 966046 - DNA, 25 bp, Mus musculus
tcaacagaacagcatttgtgcagga

SEQ ID NO: 966047 - DNA, 25 bp, Mus musculus
tcaacagaacaggatttgtgcagga

SEQ ID NO: 966048 - DNA, 25 bp, Mus musculus
tcaacagaacagtgctcttggctcc

SEQ ID NO: 966049 - DNA, 25 bp, Mus musculus
tcaacagacacactcctggtacctg

SEQ ID NO: 966050 - DNA, 25 bp, Mus musculus
tcaacagacacagtcctggtacctg

SEQ ID NO: 966051 - DNA, 25 bp, Mus musculus
tcaacagccaagcctctgagagccg

SEQ ID NO: 966052 - DNA, 25 bp, Mus musculus
tcaacagccaaggctctgagagccg

SEQ ID NO: 966053 - DNA, 25 bp, Mus musculus
tcaacagcccagctggtgtggtaac

SEQ ID NO: 966054 - DNA, 25 bp, Mus musculus
tcaacagcccaggtggtgtggtaac

SEQ ID NO: 966055 - DNA, 25 bp, Mus musculus
tcaacagcccatacccatgatggac

SEQ ID NO: 966056 - DNA, 25 bp, Mus musculus
tcaacagcccattcccatgatggac

SEQ ID NO: 966057 - DNA, 25 bp, Mus musculus
tcaacagctgctttccttctccgag

SEQ ID NO: 966058 - DNA, 25 bp, Mus musculus
tcaacagctggtttccttctccgag

SEQ ID NO: 966059 - DNA, 25 bp, Mus musculus
tcaacaggcgacctgggccccacag

SEQ ID NO: 966060 - DNA, 25 bp, Mus musculus
tcaacaggcgtcctgggccccacag

SEQ ID NO: 966061 - DNA, 25 bp, Mus musculus
tcaacatccccaacaacgatgacct

SEQ ID NO: 966062 - DNA, 25 bp, Mus musculus
tcaacatccccaactacgatgacct

SEQ ID NO: 966063 - DNA, 25 bp, Mus musculus
tcaacatctacacttatttacagag

SEQ ID NO: 966064 - DNA, 25 bp, Mus musculus
tcaacatctacagttatttacagag

SEQ ID NO: 966065 - DNA, 25 bp, Mus musculus
tcaacatgaaccagggtggccacgt

SEQ ID NO: 966066 - DNA, 25 bp, Mus musculus
tcaacatgaacctgggtggccacgt

SEQ ID NO: 966067 - DNA, 25 bp, Mus musculus
tcaacattagctcccatttggaagc

SEQ ID NO: 966068 - DNA, 25 bp, Mus musculus
tcaacattaggtcccatttggaagc

SEQ ID NO: 966069 - DNA, 25 bp, Mus musculus
tcaaccacaaagcccatgcctacag

SEQ ID NO: 966070 - DNA, 25 bp, Mus musculus
tcaaccacaaaggccatgcctacag

SEQ ID NO: 966071 - DNA, 25 bp, Mus musculus
tcaaccaccatgcagaacagtctca

SEQ ID NO: 966072 - DNA, 25 bp, Mus musculus
tcaaccaccatggagaacagtctca

SEQ ID NO: 966073 - DNA, 25 bp, Mus musculus
tcaaccacctcactcattcttacac

SEQ ID NO: 966074 - DNA, 25 bp, Mus musculus
tcaaccacctcagtcattcttacac

SEQ ID NO: 966075 - DNA, 25 bp, Mus musculus
tcaaccatatctatttcaagaagcc

SEQ ID NO: 966076 - DNA, 25 bp, Mus musculus
tcaaccatatgtatttcaagaagcc

SEQ ID NO: 966077 - DNA, 25 bp, Mus musculus
tcaacccagcagcttctgtccctca

SEQ ID NO: 966078 - DNA, 25 bp, Mus musculus
tcaacccagcaggttctgtccctca

SEQ ID NO: 966079 - DNA, 25 bp, Mus musculus
tcaaccccataccacatgtgagatc

SEQ ID NO: 966080 - DNA, 25 bp, Mus musculus
tcaaccccataccagatgtgagatc

SEQ ID NO: 966081 - DNA, 25 bp, Mus musculus
tcaacccccgctccataacaagccc

SEQ ID NO: 966082 - DNA, 25 bp, Mus musculus
tcaacccccgctgcataacaagccc

SEQ ID NO: 966083 - DNA, 25 bp, Mus musculus
tcaacccggaccaactctggatgac

SEQ ID NO: 966084 - DNA, 25 bp, Mus musculus
tcaacccggaccaagtctggatgac

SEQ ID NO: 966085 - DNA, 25 bp, Mus musculus
tcaaccctccagaaagccatcgatc

SEQ ID NO: 966086 - DNA, 25 bp, Mus musculus
tcaaccctccagtaagccatcgatc

SEQ ID NO: 966087 - DNA, 25 bp, Mus musculus
tcaaccctgaagatattgtgaacaa

SEQ ID NO: 966088 - DNA, 25 bp, Mus musculus
tcaaccctgaagttattgtgaacaa

SEQ ID NO: 966089 - DNA, 25 bp, Mus musculus
tcaaccggcttaatcgtgattttgc

SEQ ID NO: 966090 - DNA, 25 bp, Mus musculus
tcaaccggcttaatggtgattttgc

SEQ ID NO: 966091 - DNA, 25 bp, Mus musculus
tcaacctaagccctgacaagtcagt

SEQ ID NO: 966092 - DNA, 25 bp, Mus musculus
tcaacctaaggcctgacaagtcagt

SEQ ID NO: 966093 - DNA, 25 bp, Mus musculus
tcaacctctactttggctccaaggt

SEQ ID NO: 966094 - DNA, 25 bp, Mus musculus
tcaacctctagtttggctccaaggt

SEQ ID NO: 966095 - DNA, 25 bp, Mus musculus
tcaacctgatggactttgaccctga

SEQ ID NO: 966096 - DNA, 25 bp, Mus musculus
tcaacctgatggtctttgaccctga

SEQ ID NO: 966097 - DNA, 25 bp, Mus musculus
tcaaccttacagccagctgcacagg

SEQ ID NO: 966098 - DNA, 25 bp, Mus musculus
tcaaccttacaggcagctgcacagg

SEQ ID NO: 966099 - DNA, 25 bp, Mus musculus
tcaaccttagcaaacggatattatg

SEQ ID NO: 966100 - DNA, 25 bp, Mus musculus
tcaaccttagcaaagggatattatg

SEQ ID NO: 966101 - DNA, 25 bp, Mus musculus
tcaacggaggaactgtattggcaat

SEQ ID NO: 966102 - DNA, 25 bp, Mus musculus
tcaacggaggtactgtattggcaat

SEQ ID NO: 966103 - DNA, 25 bp, Mus musculus
tcaacgggactgtgaaatgggcctg

SEQ ID NO: 966104 - DNA, 25 bp, Mus musculus
tcaacgggactgtgtaatgggcctg

SEQ ID NO: 966105 - DNA, 25 bp, Mus musculus
tcaacgggctgacatctcttgatgc

SEQ ID NO: 966106 - DNA, 25 bp, Mus musculus
tcaacgggctgacgtctgtgcagac

SEQ ID NO: 966107 - DNA, 25 bp, Mus musculus
tcaacgggctgagatctcttgatgc

SEQ ID NO: 966108 - DNA, 25 bp, Mus musculus
tcaacgggctgaggtctgtgcagac

SEQ ID NO: 966109 - DNA, 25 bp, Mus musculus
tcaacgttttcgagcagagtttgaa

SEQ ID NO: 966110 - DNA, 25 bp, Mus musculus
tcaacgttttcgtgcagagtttgaa

SEQ ID NO: 966111 - DNA, 25 bp, Mus musculus
tcaactaaggcgtcactgaatcctg

SEQ ID NO: 966112 - DNA, 25 bp, Mus musculus
tcaactaaggggtcactgaatcctg

SEQ ID NO: 966113 - DNA, 25 bp, Mus musculus
tcaactactgcgaggaggcggtggg

SEQ ID NO: 966114 - DNA, 25 bp, Mus musculus
tcaactactgcgtggaggcggtggg

SEQ ID NO: 966115 - DNA, 25 bp, Mus musculus
tcaactatgaagaattcgtacagat

SEQ ID NO: 966116 - DNA, 25 bp, Mus musculus
tcaactatgaagtattcgtacagat

SEQ ID NO: 966117 - DNA, 25 bp, Mus musculus
tcaactctcccacggctttctgagg

SEQ ID NO: 966118 - DNA, 25 bp, Mus musculus
tcaactctcccagggctttctgagg

SEQ ID NO: 966119 - DNA, 25 bp, Mus musculus
tcaactgatgcgaccctgccacttc

SEQ ID NO: 966120 - DNA, 25 bp, Mus musculus
tcaactgatgggaccctgccacttc

SEQ ID NO: 966121 - DNA, 25 bp, Mus musculus
tcaactgcaaaaacctcaatcagtg

SEQ ID NO: 966122 - DNA, 25 bp, Mus musculus
tcaactgcaaaaacgtcaatcagtg

SEQ ID NO: 966123 - DNA, 25 bp, Mus musculus
tcaactgcaactttcaggaaaagga

SEQ ID NO: 966124 - DNA, 25 bp, Mus musculus
tcaactgcaagtttcaggaaaagga

SEQ ID NO: 966125 - DNA, 25 bp, Mus musculus
tcaactgcaccacaccctttttcca

SEQ ID NO: 966126 - DNA, 25 bp, Mus musculus
tcaactgcaccacagcctttttcca

SEQ ID NO: 966127 - DNA, 25 bp, Mus musculus
tcaactggcaatctatgaatgcaaa

SEQ ID NO: 966128 - DNA, 25 bp, Mus musculus
tcaactggcaatgtatgaatgcaaa

SEQ ID NO: 966129 - DNA, 25 bp, Mus musculus
tcaacttacacataccatggcaaag

SEQ ID NO: 966130 - DNA, 25 bp, Mus musculus
tcaacttacagataccatggcaaag

SEQ ID NO: 966131 - DNA, 25 bp, Mus musculus
tcaacttcagaatgttcgatgtggg

SEQ ID NO: 966132 - DNA, 25 bp, Mus musculus
tcaacttcagtatgttcgatgtggg

SEQ ID NO: 966133 - DNA, 25 bp, Mus musculus
tcaacttgtccaatttcgaggactc

SEQ ID NO: 966134 - DNA, 25 bp, Mus musculus
tcaacttgtccattttcgaggactc

SEQ ID NO: 966135 - DNA, 25 bp, Mus musculus
tcaactttatcacgttcctggagag

SEQ ID NO: 966136 - DNA, 25 bp, Mus musculus
tcaactttatcaggttcctggagag

SEQ ID NO: 966137 - DNA, 25 bp, Mus musculus
tcaagaaacgatgttatcgctgctg

SEQ ID NO: 966138 - DNA, 25 bp, Mus musculus
tcaagaaacgttgttatcgctgctg

SEQ ID NO: 966139 - DNA, 25 bp, Mus musculus
tcaagaaagaagactcctgccagct

SEQ ID NO: 966140 - DNA, 25 bp, Mus musculus
tcaagaaagaagtctcctgccagct

SEQ ID NO: 966141 - DNA, 25 bp, Mus musculus
tcaagaacaaaggccacctgcaccg

SEQ ID NO: 966142 - DNA, 25 bp, Mus musculus
tcaagaacaaaggcgacctgcaccg

SEQ ID NO: 966143 - DNA, 25 bp, Mus musculus
tcaagaacagattggtggtaatcca

SEQ ID NO: 966144 - DNA, 25 bp, Mus musculus
tcaagaacagcatgggtacacaatg

SEQ ID NO: 966145 - DNA, 25 bp, Mus musculus
tcaagaacagcctggagtatgaagc

SEQ ID NO: 966146 - DNA, 25 bp, Mus musculus
tcaagaacagctggggaagtgaatg

SEQ ID NO: 966147 - DNA, 25 bp, Mus musculus
tcaagaacaggatgggtacacaatg

SEQ ID NO: 966148 - DNA, 25 bp, Mus musculus
tcaagaacaggctggagtatgaagc

SEQ ID NO: 966149 - DNA, 25 bp, Mus musculus
tcaagaacaggtggggaagtgaatg

SEQ ID NO: 966150 - DNA, 25 bp, Mus musculus
tcaagaacagtttggtggtaatcca

SEQ ID NO: 966151 - DNA, 25 bp, Mus musculus
tcaagaactggaactagtggactgc

SEQ ID NO: 966152 - DNA, 25 bp, Mus musculus
tcaagaactggatctagtggactgc

SEQ ID NO: 966153 - DNA, 25 bp, Mus musculus
tcaagaagacagccaaacatttcat

SEQ ID NO: 966154 - DNA, 25 bp, Mus musculus
tcaagaagacaggcaaacatttcat

SEQ ID NO: 966155 - DNA, 25 bp, Mus musculus
tcaagaagcgggcgtccagtgctcg

SEQ ID NO: 966156 - DNA, 25 bp, Mus musculus
tcaagaagcgggggtccagtgctcg

SEQ ID NO: 966157 - DNA, 25 bp, Mus musculus
tcaagaagctggctaagaagtacga

SEQ ID NO: 966158 - DNA, 25 bp, Mus musculus
tcaagaagctgggtaagaagtacga

SEQ ID NO: 966159 - DNA, 25 bp, Mus musculus
tcaagaaggcaacattactgtgtag

SEQ ID NO: 966160 - DNA, 25 bp, Mus musculus
tcaagaaggcaagattactgtgtag

SEQ ID NO: 966161 - DNA, 25 bp, Mus musculus
tcaagaaggcctaccgaaagaaggc

SEQ ID NO: 966162 - DNA, 25 bp, Mus musculus
tcaagaaggcgtaccgaaagaaggc

SEQ ID NO: 966163 - DNA, 25 bp, Mus musculus
tcaagaataagtagaggagatcaac

SEQ ID NO: 966164 - DNA, 25 bp, Mus musculus
tcaagaataagttgaggagatcaac

SEQ ID NO: 966165 - DNA, 25 bp, Mus musculus
tcaagaatgaagagtatcccctact

SEQ ID NO: 966166 - DNA, 25 bp, Mus musculus
tcaagaatgaagtgtatcccctact

SEQ ID NO: 966167 - DNA, 25 bp, Mus musculus
tcaagaatggcatgattgaggactg

SEQ ID NO: 966168 - DNA, 25 bp, Mus musculus
tcaagaatggcatgcttgaagactg

SEQ ID NO: 966169 - DNA, 25 bp, Mus musculus
tcaagaatggcatggttgaagactg

SEQ ID NO: 966170 - DNA, 25 bp, Mus musculus
tcaagaatggcatgtttgaggactg

SEQ ID NO: 966171 - DNA, 25 bp, Mus musculus
tcaagaattccaatatgtgagctct

SEQ ID NO: 966172 - DNA, 25 bp, Mus musculus
tcaagaattccattatgtgagctct

SEQ ID NO: 966173 - DNA, 25 bp, Mus musculus
tcaagacagtgacgggaaacaggca

SEQ ID NO: 966174 - DNA, 25 bp, Mus musculus
tcaagacagtgaggggaaacaggca

SEQ ID NO: 966175 - DNA, 25 bp, Mus musculus
tcaagaccaaacggcccccttgaga

SEQ ID NO: 966176 - DNA, 25 bp, Mus musculus
tcaagaccaatcggcccccttgaga

SEQ ID NO: 966177 - DNA, 25 bp, Mus musculus
tcaagaccagcaattcagtgaagct

SEQ ID NO: 966178 - DNA, 25 bp, Mus musculus
tcaagaccagcccctggctttggcc

SEQ ID NO: 966179 - DNA, 25 bp, Mus musculus
tcaagaccaggaattcagtgaagct

SEQ ID NO: 966180 - DNA, 25 bp, Mus musculus
tcaagaccaggccctggctttggcc

SEQ ID NO: 966181 - DNA, 25 bp, Mus musculus
tcaagacctccagactggtggattg

SEQ ID NO: 966182 - DNA, 25 bp, Mus musculus
tcaagacctccagagtggtggattg

SEQ ID NO: 966183 - DNA, 25 bp, Mus musculus
tcaagactccgtgtctcacattagc

SEQ ID NO: 966184 - DNA, 25 bp, Mus musculus
tcaagactccgtgtgtcacattagc

SEQ ID NO: 966185 - DNA, 25 bp, Mus musculus
tcaagagagcaacctcatcattctg

SEQ ID NO: 966186 - DNA, 25 bp, Mus musculus
tcaagagagcaagctcatcattctg

SEQ ID NO: 966187 - DNA, 25 bp, Mus musculus
tcaagagaggagtgtcaatgagtcc

SEQ ID NO: 966188 - DNA, 25 bp, Mus musculus
tcaagagaggtgtgtcaatgagtcc

SEQ ID NO: 966189 - DNA, 25 bp, Mus musculus
tcaagagcagagggtaaggttggag

SEQ ID NO: 966190 - DNA, 25 bp, Mus musculus
tcaagagcagtgggtaaggttggag

SEQ ID NO: 966191 - DNA, 25 bp, Mus musculus
tcaagagcatagtgaccaagttcct

SEQ ID NO: 966192 - DNA, 25 bp, Mus musculus
tcaagagcattgtgaccaagttcct

SEQ ID NO: 966193 - DNA, 25 bp, Mus musculus
tcaagaggagctgtcctaacttggc

SEQ ID NO: 966194 - DNA, 25 bp, Mus musculus
tcaagaggaggtgtcctaacttggc

SEQ ID NO: 966195 - DNA, 25 bp, Mus musculus
tcaagagttagcaacaaacatccat

SEQ ID NO: 966196 - DNA, 25 bp, Mus musculus
tcaagagttagcaacaagaaacatc

SEQ ID NO: 966197 - DNA, 25 bp, Mus musculus
tcaagagttagcaagaaacatccat

SEQ ID NO: 966198 - DNA, 25 bp, Mus musculus
tcaagagttagcaagaagaaacatc

SEQ ID NO: 966199 - DNA, 25 bp, Mus musculus
tcaagagtttggcacagtatacgaa

SEQ ID NO: 966200 - DNA, 25 bp, Mus musculus
tcaagagtttggcactgtcaaaggt

SEQ ID NO: 966201 - DNA, 25 bp, Mus musculus
tcaagagtttggcagagtatacgaa

SEQ ID NO: 966202 - DNA, 25 bp, Mus musculus
tcaagagtttggcagtgtcaaaggt

SEQ ID NO: 966203 - DNA, 25 bp, Mus musculus
tcaagataatcacacggcgcttgca

SEQ ID NO: 966204 - DNA, 25 bp, Mus musculus
tcaagataatcagacggcgcttgca

SEQ ID NO: 966205 - DNA, 25 bp, Mus musculus
tcaagatccaagatgctcaccggct

SEQ ID NO: 966206 - DNA, 25 bp, Mus musculus
tcaagatccaagttgctcaccggct

SEQ ID NO: 966207 - DNA, 25 bp, Mus musculus
tcaagatcttagcttcagttactac

SEQ ID NO: 966208 - DNA, 25 bp, Mus musculus
tcaagatcttaggttcagttactac

SEQ ID NO: 966209 - DNA, 25 bp, Mus musculus
tcaagatgctgaaaacgacagccag

SEQ ID NO: 966210 - DNA, 25 bp, Mus musculus
tcaagatgctgaaatcgacagccag

SEQ ID NO: 966211 - DNA, 25 bp, Mus musculus
tcaagcaagaagccacttgctatca

SEQ ID NO: 966212 - DNA, 25 bp, Mus musculus
tcaagcaagaaggcacttgctatca

SEQ ID NO: 966213 - DNA, 25 bp, Mus musculus
tcaagcaagagcaaccccatgatga

SEQ ID NO: 966214 - DNA, 25 bp, Mus musculus
tcaagcaagagcaagcccatgatga

SEQ ID NO: 966215 - DNA, 25 bp, Mus musculus
tcaagcacctcccatggtggattca

SEQ ID NO: 966216 - DNA, 25 bp, Mus musculus
tcaagcacctgccatggtggattca

SEQ ID NO: 966217 - DNA, 25 bp, Mus musculus
tcaagcagataccgcgcccaacgaa

SEQ ID NO: 966218 - DNA, 25 bp, Mus musculus
tcaagcagataccgcgtggggacga

SEQ ID NO: 966219 - DNA, 25 bp, Mus musculus
tcaagcagataccgggcccaacgaa

SEQ ID NO: 966220 - DNA, 25 bp, Mus musculus
tcaagcagataccgggtggggacga

SEQ ID NO: 966221 - DNA, 25 bp, Mus musculus
tcaagcagatgaagatcatccatga

SEQ ID NO: 966222 - DNA, 25 bp, Mus musculus
tcaagcagatgatgatcatccatga

SEQ ID NO: 966223 - DNA, 25 bp, Mus musculus
tcaagcaggttcagcctaaccagga

SEQ ID NO: 966224 - DNA, 25 bp, Mus musculus
tcaagcaggttcaggctaaccagga

SEQ ID NO: 966225 - DNA, 25 bp, Mus musculus
tcaagcatttcgccatgctccaccg

SEQ ID NO: 966226 - DNA, 25 bp, Mus musculus
tcaagcatttcggcatgctccaccg

SEQ ID NO: 966227 - DNA, 25 bp, Mus musculus
tcaagccaacaacagctctgaagat

SEQ ID NO: 966228 - DNA, 25 bp, Mus musculus
tcaagccaacaagagctctgaagat

SEQ ID NO: 966229 - DNA, 25 bp, Mus musculus
tcaagccagacacaattgttcagca

SEQ ID NO: 966230 - DNA, 25 bp, Mus musculus
tcaagccagacacatttgttcagca

SEQ ID NO: 966231 - DNA, 25 bp, Mus musculus
tcaagccatcgcagagaagcgtagg

SEQ ID NO: 966232 - DNA, 25 bp, Mus musculus
tcaagccatcgctgagaagcgtagg

SEQ ID NO: 966233 - DNA, 25 bp, Mus musculus
tcaagcccagacttgcctccagcat

SEQ ID NO: 966234 - DNA, 25 bp, Mus musculus
tcaagcccagctatgggacccctgc

SEQ ID NO: 966235 - DNA, 25 bp, Mus musculus
tcaagcccaggtatgggacccctgc

SEQ ID NO: 966236 - DNA, 25 bp, Mus musculus
tcaagcccagtcttgcctccagcat

SEQ ID NO: 966237 - DNA, 25 bp, Mus musculus
tcaagcccatcacaaaatcaccgtg

SEQ ID NO: 966238 - DNA, 25 bp, Mus musculus
tcaagcccatcagaaaatcaccgtg

SEQ ID NO: 966239 - DNA, 25 bp, Mus musculus
tcaagcctgcggcgacttgactgcg

SEQ ID NO: 966240 - DNA, 25 bp, Mus musculus
tcaagcctgcggggacttgactgcg

SEQ ID NO: 966241 - DNA, 25 bp, Mus musculus
tcaagcgctcagatatgctgaagga

SEQ ID NO: 966242 - DNA, 25 bp, Mus musculus
tcaagcgctcagttatgctgaagga

SEQ ID NO: 966243 - DNA, 25 bp, Mus musculus
tcaagcgctggacgcgtggagtgtc

SEQ ID NO: 966244 - DNA, 25 bp, Mus musculus
tcaagcgctggacgggtggagtgtc

SEQ ID NO: 966245 - DNA, 25 bp, Mus musculus
tcaagctcggaggtggcagggtaaa

SEQ ID NO: 966246 - DNA, 25 bp, Mus musculus
tcaagctcggtggtggcagggtaaa

SEQ ID NO: 966247 - DNA, 25 bp, Mus musculus
tcaagctcttatctgagacgtggaa

SEQ ID NO: 966248 - DNA, 25 bp, Mus musculus
tcaagctcttatgtgagacgtggaa

SEQ ID NO: 966249 - DNA, 25 bp, Mus musculus
tcaagctggagacacctgtgatcct

SEQ ID NO: 966250 - DNA, 25 bp, Mus musculus
tcaagctggagagacctgtgatcct

SEQ ID NO: 966251 - DNA, 25 bp, Mus musculus
tcaagcttgccacactcgaagactt

SEQ ID NO: 966252 - DNA, 25 bp, Mus musculus
tcaagcttgccagactcgaagactt

SEQ ID NO: 966253 - DNA, 25 bp, Mus musculus
tcaaggaaaacacgacccatcctct

SEQ ID NO: 966254 - DNA, 25 bp, Mus musculus
tcaaggaaaacactctataaagcac

SEQ ID NO: 966255 - DNA, 25 bp, Mus musculus
tcaaggaaaacaggacccatcctct

SEQ ID NO: 966256 - DNA, 25 bp, Mus musculus
tcaaggaaaacagtctataaagcac

SEQ ID NO: 966257 - DNA, 25 bp, Mus musculus
tcaaggaagagaaggaggacatcac

SEQ ID NO: 966258 - DNA, 25 bp, Mus musculus
tcaaggaagagatggaggacatcac

SEQ ID NO: 966259 - DNA, 25 bp, Mus musculus
tcaaggaatagtgtcataattggcc

SEQ ID NO: 966260 - DNA, 25 bp, Mus musculus
tcaaggaatagtgtctgcagcttat

SEQ ID NO: 966261 - DNA, 25 bp, Mus musculus
tcaaggaatagtgtgataattggcc

SEQ ID NO: 966262 - DNA, 25 bp, Mus musculus
tcaaggaatagtgtgtgcagcttat

SEQ ID NO: 966263 - DNA, 25 bp, Mus musculus
tcaaggacacactacgcctcggaaa

SEQ ID NO: 966264 - DNA, 25 bp, Mus musculus
tcaaggacacactaggcctcggaaa

SEQ ID NO: 966265 - DNA, 25 bp, Mus musculus
tcaaggacagcaatcgcatgcgccc

SEQ ID NO: 966266 - DNA, 25 bp, Mus musculus
tcaaggacagcaatggcatgcgccc

SEQ ID NO: 966267 - DNA, 25 bp, Mus musculus
tcaaggacagcgagtcattcccaat

SEQ ID NO: 966268 - DNA, 25 bp, Mus musculus
tcaaggacagggagtcattcccaat

SEQ ID NO: 966269 - DNA, 25 bp, Mus musculus
tcaaggacctccaggacctcagggt

SEQ ID NO: 966270 - DNA, 25 bp, Mus musculus
tcaaggacctcctggacctcagggt

SEQ ID NO: 966271 - DNA, 25 bp, Mus musculus
tcaaggacgcagccatgtttgctcc

SEQ ID NO: 966272 - DNA, 25 bp, Mus musculus
tcaaggacgcaggcatgtttgctcc

SEQ ID NO: 966273 - DNA, 25 bp, Mus musculus
tcaaggacggatggtactggaagtt

SEQ ID NO: 966274 - DNA, 25 bp, Mus musculus
tcaaggacggttggtactggaagtt

SEQ ID NO: 966275 - DNA, 25 bp, Mus musculus
tcaaggactccacgcatgtcatgtt

SEQ ID NO: 966276 - DNA, 25 bp, Mus musculus
tcaaggactccaggcatgtcatgtt

SEQ ID NO: 966277 - DNA, 25 bp, Mus musculus
tcaaggactgcgcctctaaggtggg

SEQ ID NO: 966278 - DNA, 25 bp, Mus musculus
tcaaggactgcggctctaaggtggg

SEQ ID NO: 966279 - DNA, 25 bp, Mus musculus
tcaaggagctctaggtggcgatgtc

SEQ ID NO: 966280 - DNA, 25 bp, Mus musculus
tcaaggagctgtaggtggcgatgtc

SEQ ID NO: 966281 - DNA, 25 bp, Mus musculus
tcaaggagggcacgttgtctttcta

SEQ ID NO: 966282 - DNA, 25 bp, Mus musculus
tcaaggagggcaggttgtctttcta

SEQ ID NO: 966283 - DNA, 25 bp, Mus musculus
tcaaggagtgcaagaccaacgagtg

SEQ ID NO: 966284 - DNA, 25 bp, Mus musculus
tcaaggagtgcatgaccaacgagtg

SEQ ID NO: 966285 - DNA, 25 bp, Mus musculus
tcaaggatggacacattcattactt

SEQ ID NO: 966286 - DNA, 25 bp, Mus musculus
tcaaggatggactcattcattactt

SEQ ID NO: 966287 - DNA, 25 bp, Mus musculus
tcaaggcaagataggaaaaatttaa

SEQ ID NO: 966288 - DNA, 25 bp, Mus musculus
tcaaggcaagttaggaaaaatttaa

SEQ ID NO: 966289 - DNA, 25 bp, Mus musculus
tcaaggccagcttgatggaaaccaa

SEQ ID NO: 966290 - DNA, 25 bp, Mus musculus
tcaaggccaggttgatggaaaccaa

SEQ ID NO: 966291 - DNA, 25 bp, Mus musculus
tcaaggctagactgcctgcgaagct

SEQ ID NO: 966292 - DNA, 25 bp, Mus musculus
tcaaggctagactggctgcgaagct

SEQ ID NO: 966293 - DNA, 25 bp, Mus musculus
tcaagggaaccacacggcccaactg

SEQ ID NO: 966294 - DNA, 25 bp, Mus musculus
tcaagggaaccacagggcccaactg

SEQ ID NO: 966295 - DNA, 25 bp, Mus musculus
tcaagggaactggacggaggagacg

SEQ ID NO: 966296 - DNA, 25 bp, Mus musculus
tcaagggaactggagggaggagacg

SEQ ID NO: 966297 - DNA, 25 bp, Mus musculus
tcaagggctcttcctgttccggggc

SEQ ID NO: 966298 - DNA, 25 bp, Mus musculus
tcaagggctcttcggcagcgctcac

SEQ ID NO: 966299 - DNA, 25 bp, Mus musculus
tcaagggctcttgctgttccggggc

SEQ ID NO: 966300 - DNA, 25 bp, Mus musculus
tcaagggctcttgggcagcgctcac

SEQ ID NO: 966301 - DNA, 25 bp, Mus musculus
tcaaggggagcctcgtgtgcgtcta

SEQ ID NO: 966302 - DNA, 25 bp, Mus musculus
tcaaggggaggctcgtgtgcgtcta

SEQ ID NO: 966303 - DNA, 25 bp, Mus musculus
tcaaggtggatgacccggcgggaat

SEQ ID NO: 966304 - DNA, 25 bp, Mus musculus
tcaaggtggatgtcccggcgggaat

SEQ ID NO: 966305 - DNA, 25 bp, Mus musculus
tcaagtacaaagagcttgtagccaa

SEQ ID NO: 966306 - DNA, 25 bp, Mus musculus
tcaagtacaaagtgcttgtagccaa

SEQ ID NO: 966307 - DNA, 25 bp, Mus musculus
tcaagtacagagatgaactcaagcg

SEQ ID NO: 966308 - DNA, 25 bp, Mus musculus
tcaagtacaggtatgaactcaagcg

SEQ ID NO: 966309 - DNA, 25 bp, Mus musculus
tcaagtacaggtttgaactcaagcg

SEQ ID NO: 966310 - DNA, 25 bp, Mus musculus
tcaagtacagtgatgaactcaagcg

SEQ ID NO: 966311 - DNA, 25 bp, Mus musculus
tcaagtactgcttgggtggtccgga

SEQ ID NO: 966312 - DNA, 25 bp, Mus musculus
tcaagtactgctttacaggaacaga

SEQ ID NO: 966313 - DNA, 25 bp, Mus musculus
tcaagtactggttgggtggtccgga

SEQ ID NO: 966314 - DNA, 25 bp, Mus musculus
tcaagtactggtttacaggaacaga

SEQ ID NO: 966315 - DNA, 25 bp, Mus musculus
tcaagtcaacagccatcaactaaac

SEQ ID NO: 966316 - DNA, 25 bp, Mus musculus
tcaagtcaacaggcatcaactaaac

SEQ ID NO: 966317 - DNA, 25 bp, Mus musculus
tcaagtcaagaaaccttgttatcgc

SEQ ID NO: 966318 - DNA, 25 bp, Mus musculus
tcaagtcaagaaacgttgttatcgc

SEQ ID NO: 966319 - DNA, 25 bp, Mus musculus
tcaagtcaagaccttgtcgctcccg

SEQ ID NO: 966320 - DNA, 25 bp, Mus musculus
tcaagtcaagagatatgatcataac

SEQ ID NO: 966321 - DNA, 25 bp, Mus musculus
tcaagtcaagtccttgtcgctcccg

SEQ ID NO: 966322 - DNA, 25 bp, Mus musculus
tcaagtcaagtgatatgatcataac

SEQ ID NO: 966323 - DNA, 25 bp, Mus musculus
tcaagtcacccactgaatacctcat

SEQ ID NO: 966324 - DNA, 25 bp, Mus musculus
tcaagtcacccagtgaatacctcat

SEQ ID NO: 966325 - DNA, 25 bp, Mus musculus
tcaagtcctttcagtcttttgatgg

SEQ ID NO: 966326 - DNA, 25 bp, Mus musculus
tcaagtcctttctgtcttttgatgg

SEQ ID NO: 966327 - DNA, 25 bp, Mus musculus
tcaagtgaaagacgtcaaccggatg

SEQ ID NO: 966328 - DNA, 25 bp, Mus musculus
tcaagtgaaagaggtcaaccggatg

SEQ ID NO: 966329 - DNA, 25 bp, Mus musculus
tcaagtgaagctaattgcagccact

SEQ ID NO: 966330 - DNA, 25 bp, Mus musculus
tcaagtgaaggtaattgcagccact

SEQ ID NO: 966331 - DNA, 25 bp, Mus musculus
tcaagtgcagcatcttctctgccta

SEQ ID NO: 966332 - DNA, 25 bp, Mus musculus
tcaagtgcaggatcttctctgccta

SEQ ID NO: 966333 - DNA, 25 bp, Mus musculus
tcaagtggaacgcccaatgcagcag

SEQ ID NO: 966334 - DNA, 25 bp, Mus musculus
tcaagtggaacggccaatgcagcag

SEQ ID NO: 966335 - DNA, 25 bp, Mus musculus
tcaagtttctcccctaccactgaca

SEQ ID NO: 966336 - DNA, 25 bp, Mus musculus
tcaagtttctgccctaccactgaca

SEQ ID NO: 966337 - DNA, 25 bp, Mus musculus
tcaagtttgggagcaatgcttatcc

SEQ ID NO: 966338 - DNA, 25 bp, Mus musculus
tcaagtttgggagctatgcttatcc

SEQ ID NO: 966339 - DNA, 25 bp, Mus musculus
tcaataagcaacctactgaacttga

SEQ ID NO: 966340 - DNA, 25 bp, Mus musculus
tcaataagcatcctactgaacttga

SEQ ID NO: 966341 - DNA, 25 bp, Mus musculus
tcaataatcccacttatcggcagag

SEQ ID NO: 966342 - DNA, 25 bp, Mus musculus
tcaataatcccagttatcggcagag

SEQ ID NO: 966343 - DNA, 25 bp, Mus musculus
tcaatagataatcgtatatttgttc

SEQ ID NO: 966344 - DNA, 25 bp, Mus musculus
tcaatagataatggtatatttgttc

SEQ ID NO: 966345 - DNA, 25 bp, Mus musculus
tcaataggatccctcgagtccctgg

SEQ ID NO: 966346 - DNA, 25 bp, Mus musculus
tcaataggatccctggagtccctgg

SEQ ID NO: 966347 - DNA, 25 bp, Mus musculus
tcaataggattccacgagtccctgg

SEQ ID NO: 966348 - DNA, 25 bp, Mus musculus
tcaataggattccaggagtccctgg

SEQ ID NO: 966349 - DNA, 25 bp, Mus musculus
tcaatatgaatgaaagtgacgctca

SEQ ID NO: 966350 - DNA, 25 bp, Mus musculus
tcaatatgaatgaatgtgacgctca

SEQ ID NO: 966351 - DNA, 25 bp, Mus musculus
tcaatattccccgaagccgagtgct

SEQ ID NO: 966352 - DNA, 25 bp, Mus musculus
tcaatattccccgatgccgagtgct

SEQ ID NO: 966353 - DNA, 25 bp, Mus musculus
tcaatcaatgctgtcccagatgacc

SEQ ID NO: 966354 - DNA, 25 bp, Mus musculus
tcaatcaatggtgtcccagatgacc

SEQ ID NO: 966355 - DNA, 25 bp, Mus musculus
tcaatcacaacttgaaagatgccaa

SEQ ID NO: 966356 - DNA, 25 bp, Mus musculus
tcaatcacaagttgaaagatgccaa

SEQ ID NO: 966357 - DNA, 25 bp, Mus musculus
tcaatcatttctatgtttgaccgag

SEQ ID NO: 966358 - DNA, 25 bp, Mus musculus
tcaatcatttgtatgtttgaccgag

SEQ ID NO: 966359 - DNA, 25 bp, Mus musculus
tcaatccattatgaaattgaagacc

SEQ ID NO: 966360 - DNA, 25 bp, Mus musculus
tcaatccattatgaagaaacaggga

SEQ ID NO: 966361 - DNA, 25 bp, Mus musculus
tcaatccattatgatattgaagacc

SEQ ID NO: 966362 - DNA, 25 bp, Mus musculus
tcaatccattatgatgaaacaggga

SEQ ID NO: 966363 - DNA, 25 bp, Mus musculus
tcaatccccaagcttcattctgtgg

SEQ ID NO: 966364 - DNA, 25 bp, Mus musculus
tcaatccccaaggttcattctgtgg

SEQ ID NO: 966365 - DNA, 25 bp, Mus musculus
tcaatctaatgaacaaacgctgagg

SEQ ID NO: 966366 - DNA, 25 bp, Mus musculus
tcaatctaatgatcaaacgctgagg

SEQ ID NO: 966367 - DNA, 25 bp, Mus musculus
tcaatcttatcgccaaagctaaaac

SEQ ID NO: 966368 - DNA, 25 bp, Mus musculus
tcaatcttatcggcaaagctaaaac

SEQ ID NO: 966369 - DNA, 25 bp, Mus musculus
tcaatgaaagcaggcactgtgtgta

SEQ ID NO: 966370 - DNA, 25 bp, Mus musculus
tcaatgaaaggaggcactgtgtgta

SEQ ID NO: 966371 - DNA, 25 bp, Mus musculus
tcaatgacggaatcagaggcaacag

SEQ ID NO: 966372 - DNA, 25 bp, Mus musculus
tcaatgacggtatcagaggcaacag

SEQ ID NO: 966373 - DNA, 25 bp, Mus musculus
tcaatgacgtctacctggtgaccca

SEQ ID NO: 966374 - DNA, 25 bp, Mus musculus
tcaatgacgtgtacctggtgaccca

SEQ ID NO: 966375 - DNA, 25 bp, Mus musculus
tcaatgactacccaccagtgaagtt

SEQ ID NO: 966376 - DNA, 25 bp, Mus musculus
tcaatgactaccgaccagtgaagtt

SEQ ID NO: 966377 - DNA, 25 bp, Mus musculus
tcaatgacttcacagaatacctgtc

SEQ ID NO: 966378 - DNA, 25 bp, Mus musculus
tcaatgacttcacctgctgacctca

SEQ ID NO: 966379 - DNA, 25 bp, Mus musculus
tcaatgacttcagagaatacctgtc

SEQ ID NO: 966380 - DNA, 25 bp, Mus musculus
tcaatgacttcagctgctgacctca

SEQ ID NO: 966381 - DNA, 25 bp, Mus musculus
tcaatgagagaaccttttaggttaa

SEQ ID NO: 966382 - DNA, 25 bp, Mus musculus
tcaatgagagaagcttttaggttaa

SEQ ID NO: 966383 - DNA, 25 bp, Mus musculus
tcaatgagagcacgtcaaggaggcc

SEQ ID NO: 966384 - DNA, 25 bp, Mus musculus
tcaatgagagcaggtcaaggaggcc

SEQ ID NO: 966385 - DNA, 25 bp, Mus musculus
tcaatgagccaacagcagctgctat

SEQ ID NO: 966386 - DNA, 25 bp, Mus musculus
tcaatgagcctacagcagctgctat

SEQ ID NO: 966387 - DNA, 25 bp, Mus musculus
tcaatgaggtatcgtcgagcagttc

SEQ ID NO: 966388 - DNA, 25 bp, Mus musculus
tcaatgaggtttcgtcgagcagttc

SEQ ID NO: 966389 - DNA, 25 bp, Mus musculus
tcaatgccagctacaagatgctcat

SEQ ID NO: 966390 - DNA, 25 bp, Mus musculus
tcaatgccaggtacaagatgctcat

SEQ ID NO: 966391 - DNA, 25 bp, Mus musculus
tcaatgctatgtcacaaggcttatc

SEQ ID NO: 966392 - DNA, 25 bp, Mus musculus
tcaatgctatgtcacgaaaccatcc

SEQ ID NO: 966393 - DNA, 25 bp, Mus musculus
tcaatgctatgtcagaaggcttatc

SEQ ID NO: 966394 - DNA, 25 bp, Mus musculus
tcaatgctatgtcaggaaaccatcc

SEQ ID NO: 966395 - DNA, 25 bp, Mus musculus
tcaatgctgaagctgtgattagcta

SEQ ID NO: 966396 - DNA, 25 bp, Mus musculus
tcaatgctgaaggtgtgattagcta

SEQ ID NO: 966397 - DNA, 25 bp, Mus musculus
tcaatggcaaaatcactcataatcc

SEQ ID NO: 966398 - DNA, 25 bp, Mus musculus
tcaatggcaaaatctctcataatcc

SEQ ID NO: 966399 - DNA, 25 bp, Mus musculus
tcaatggcaaagttaccaatcagga

SEQ ID NO: 966400 - DNA, 25 bp, Mus musculus
tcaatggcaatgttaccaatcagga

SEQ ID NO: 966401 - DNA, 25 bp, Mus musculus
tcaatgtcaacgaccccagtccagt

SEQ ID NO: 966402 - DNA, 25 bp, Mus musculus
tcaatgtcaacgtccccagtccagt

SEQ ID NO: 966403 - DNA, 25 bp, Mus musculus
tcaatgtcggcgacatcgggggtaa

SEQ ID NO: 966404 - DNA, 25 bp, Mus musculus
tcaatgtcggggacatcgggggtaa

SEQ ID NO: 966405 - DNA, 25 bp, Mus musculus
tcaatgtctcagatgcactcccatc

SEQ ID NO: 966406 - DNA, 25 bp, Mus musculus
tcaatgtctcagttgcactcccatc

SEQ ID NO: 966407 - DNA, 25 bp, Mus musculus
tcaatgtgctgaaacggttcaactt

SEQ ID NO: 966408 - DNA, 25 bp, Mus musculus
tcaatgtgctgaaagggttcaactt

SEQ ID NO: 966409 - DNA, 25 bp, Mus musculus
tcaattatgaagagtttgtacagat

SEQ ID NO: 966410 - DNA, 25 bp, Mus musculus
tcaattatgaagtgtttgtacagat

SEQ ID NO: 966411 - DNA, 25 bp, Mus musculus
tcaattcaatggatcctgttcgaag

SEQ ID NO: 966412 - DNA, 25 bp, Mus musculus
tcaattcaatggttcctgttcgaag

SEQ ID NO: 966413 - DNA, 25 bp, Mus musculus
tcaattccaatgcaaacaagaatgc

SEQ ID NO: 966414 - DNA, 25 bp, Mus musculus
tcaattccaatggaaacaagaatgc

SEQ ID NO: 966415 - DNA, 25 bp, Mus musculus
tcaattcttacacgtgaatctgtct

SEQ ID NO: 966416 - DNA, 25 bp, Mus musculus
tcaattcttacaggtgaatctgtct

SEQ ID NO: 966417 - DNA, 25 bp, Mus musculus
tcaattcttcacctactacagacaa

SEQ ID NO: 966418 - DNA, 25 bp, Mus musculus
tcaattcttcaccttctacagacaa

SEQ ID NO: 966419 - DNA, 25 bp, Mus musculus
tcaattgctcagcaaactcacaggc

SEQ ID NO: 966420 - DNA, 25 bp, Mus musculus
tcaattgctcaggaaactcacaggc

SEQ ID NO: 966421 - DNA, 25 bp, Mus musculus
tcaattggaaaacaggtccttctgt

SEQ ID NO: 966422 - DNA, 25 bp, Mus musculus
tcaattggaaaacgaatcttctatt

SEQ ID NO: 966423 - DNA, 25 bp, Mus musculus
tcaattggaaaagaggtccttctgt

SEQ ID NO: 966424 - DNA, 25 bp, Mus musculus
tcaattggaaaaggaatcttctatt

SEQ ID NO: 966425 - DNA, 25 bp, Mus musculus
tcaatttagtgacccacagtacacg

SEQ ID NO: 966426 - DNA, 25 bp, Mus musculus
tcaatttagtgagccacagtacacg

SEQ ID NO: 966427 - DNA, 25 bp, Mus musculus
tcacaaaaatataattggccttttg

SEQ ID NO: 966428 - DNA, 25 bp, Mus musculus
tcacaaaaatttaattggccttttg

SEQ ID NO: 966429 - DNA, 25 bp, Mus musculus
tcacaacaagattgaggaagacaca

SEQ ID NO: 966430 - DNA, 25 bp, Mus musculus
tcacaacaagccccatctgctcaac

SEQ ID NO: 966431 - DNA, 25 bp, Mus musculus
tcacaacaaggcccatctgctcaac

SEQ ID NO: 966432 - DNA, 25 bp, Mus musculus
tcacaacaagtttgaggaagacaca

SEQ ID NO: 966433 - DNA, 25 bp, Mus musculus
tcacaaccagcaacggcaccacaaa

SEQ ID NO: 966434 - DNA, 25 bp, Mus musculus
tcacaaccaggaacggcaccacaaa

SEQ ID NO: 966435 - DNA, 25 bp, Mus musculus
tcacaacggatgaaagattggcagg

SEQ ID NO: 966436 - DNA, 25 bp, Mus musculus
tcacaacggatgaatgattggcagg

SEQ ID NO: 966437 - DNA, 25 bp, Mus musculus
tcacaactttcctcggaaaacgttc

SEQ ID NO: 966438 - DNA, 25 bp, Mus musculus
tcacaactttgctcggaaaacgttc

SEQ ID NO: 966439 - DNA, 25 bp, Mus musculus
tcacaagaagaaacatgtcattcag

SEQ ID NO: 966440 - DNA, 25 bp, Mus musculus
tcacaagaagacgcaatgtgtcttc

SEQ ID NO: 966441 - DNA, 25 bp, Mus musculus
tcacaagaagacttccaactgaata

SEQ ID NO: 966442 - DNA, 25 bp, Mus musculus
tcacaagaagtaacatgtcattcag

SEQ ID NO: 966443 - DNA, 25 bp, Mus musculus
tcacaagaagtcgcaatgtgtcttc

SEQ ID NO: 966444 - DNA, 25 bp, Mus musculus
tcacaagaagtcttccaactgaata

SEQ ID NO: 966445 - DNA, 25 bp, Mus musculus
tcacaagcagacatgaaagtccact

SEQ ID NO: 966446 - DNA, 25 bp, Mus musculus
tcacaagcagactgaccaaggacat

SEQ ID NO: 966447 - DNA, 25 bp, Mus musculus
tcacaagcagtcatgaaagtccact

SEQ ID NO: 966448 - DNA, 25 bp, Mus musculus
tcacaagcagtctgaccaaggacat

SEQ ID NO: 966449 - DNA, 25 bp, Mus musculus
tcacaaggaccatcagtaccagttt

SEQ ID NO: 966450 - DNA, 25 bp, Mus musculus
tcacaaggaccatctgtaccagttt

SEQ ID NO: 966451 - DNA, 25 bp, Mus musculus
tcacaaggagaactatgagtctggg

SEQ ID NO: 966452 - DNA, 25 bp, Mus musculus
tcacaaggagtactatgagtctggg

SEQ ID NO: 966453 - DNA, 25 bp, Mus musculus
tcacaagtggcttttattgacttca

SEQ ID NO: 966454 - DNA, 25 bp, Mus musculus
tcacaagtgggttttattgacttca

SEQ ID NO: 966455 - DNA, 25 bp, Mus musculus
tcacaagttgagatgaagcccgagg

SEQ ID NO: 966456 - DNA, 25 bp, Mus musculus
tcacaagttgagttgaagcccgagg

SEQ ID NO: 966457 - DNA, 25 bp, Mus musculus
tcacaattgatccagaaaataatgt

SEQ ID NO: 966458 - DNA, 25 bp, Mus musculus
tcacaattgatcgagaaaataatgt

SEQ ID NO: 966459 - DNA, 25 bp, Mus musculus
tcacacaaacaccaccgtgttccca

SEQ ID NO: 966460 - DNA, 25 bp, Mus musculus
tcacacaaacaccagcgtgttccca

SEQ ID NO: 966461 - DNA, 25 bp, Mus musculus
tcacacaaagaaacaggtatgtgat

SEQ ID NO: 966462 - DNA, 25 bp, Mus musculus
tcacacaaagctatgtgatgatatc

SEQ ID NO: 966463 - DNA, 25 bp, Mus musculus
tcacacaaaggtatgtgatgatatc

SEQ ID NO: 966464 - DNA, 25 bp, Mus musculus
tcacacaaagtaacaggtatgtgat

SEQ ID NO: 966465 - DNA, 25 bp, Mus musculus
tcacacaagtcaatcgaaaatttcc

SEQ ID NO: 966466 - DNA, 25 bp, Mus musculus
tcacacaagtcaatcgccagctaat

SEQ ID NO: 966467 - DNA, 25 bp, Mus musculus
tcacacaagtcaatggaaaatttcc

SEQ ID NO: 966468 - DNA, 25 bp, Mus musculus
tcacacaagtcaatggccagctaat

SEQ ID NO: 966469 - DNA, 25 bp, Mus musculus
tcacacaatgcaattcgctttggaa

SEQ ID NO: 966470 - DNA, 25 bp, Mus musculus
tcacacaatggaattcgctttggaa

SEQ ID NO: 966471 - DNA, 25 bp, Mus musculus
tcacacacaacgcatgaacaagttg

SEQ ID NO: 966472 - DNA, 25 bp, Mus musculus
tcacacacaacggatgaacaagttg

SEQ ID NO: 966473 - DNA, 25 bp, Mus musculus
tcacacaccgcaccttgtcaggatg

SEQ ID NO: 966474 - DNA, 25 bp, Mus musculus
tcacacaccgcagcttgtcaggatg

SEQ ID NO: 966475 - DNA, 25 bp, Mus musculus
tcacacactgcaagaaccagcactg

SEQ ID NO: 966476 - DNA, 25 bp, Mus musculus
tcacacactgcaagtaccagcactg

SEQ ID NO: 966477 - DNA, 25 bp, Mus musculus
tcacacacttaactatgaagagcat

SEQ ID NO: 966478 - DNA, 25 bp, Mus musculus
tcacacacttaagtatgaagagcat

SEQ ID NO: 966479 - DNA, 25 bp, Mus musculus
tcacacagcattaacgctcggctat

SEQ ID NO: 966480 - DNA, 25 bp, Mus musculus
tcacacagcattaaggctcggctat

SEQ ID NO: 966481 - DNA, 25 bp, Mus musculus
tcacacagcctagacgggtgaactg

SEQ ID NO: 966482 - DNA, 25 bp, Mus musculus
tcacacagcctagaggggtgaactg

SEQ ID NO: 966483 - DNA, 25 bp, Mus musculus
tcacaccagagagcaatcattgagg

SEQ ID NO: 966484 - DNA, 25 bp, Mus musculus
tcacaccagagagctatcattgagg

SEQ ID NO: 966485 - DNA, 25 bp, Mus musculus
tcacacccagctgctggctgaggag

SEQ ID NO: 966486 - DNA, 25 bp, Mus musculus
tcacacccaggtgctggctgaggag

SEQ ID NO: 966487 - DNA, 25 bp, Mus musculus
tcacactcaccctcaggctctgagt

SEQ ID NO: 966488 - DNA, 25 bp, Mus musculus
tcacactcaccctctggctctgagt

SEQ ID NO: 966489 - DNA, 25 bp, Mus musculus
tcacactgagagcagacttctttct

SEQ ID NO: 966490 - DNA, 25 bp, Mus musculus
tcacactgagaggagacttctttct

SEQ ID NO: 966491 - DNA, 25 bp, Mus musculus
tcacagaaagctgtccacccagctg

SEQ ID NO: 966492 - DNA, 25 bp, Mus musculus
tcacagaaaggtgtccacccagctg

SEQ ID NO: 966493 - DNA, 25 bp, Mus musculus
tcacagaaggcttgactacagtcag

SEQ ID NO: 966494 - DNA, 25 bp, Mus musculus
tcacagaagggttgactacagtcag

SEQ ID NO: 966495 - DNA, 25 bp, Mus musculus
tcacagaatgcaagtcacacaagga

SEQ ID NO: 966496 - DNA, 25 bp, Mus musculus
tcacagaatgcatgtcacacaagga

SEQ ID NO: 966497 - DNA, 25 bp, Mus musculus
tcacagacaagacacgaaccctgac

SEQ ID NO: 966498 - DNA, 25 bp, Mus musculus
tcacagacaagacaggaaccctgac

SEQ ID NO: 966499 - DNA, 25 bp, Mus musculus
tcacagacttctacctggtgatgcc

SEQ ID NO: 966500 - DNA, 25 bp, Mus musculus
tcacagacttgtacctggtgatgcc

SEQ ID NO: 966501 - DNA, 25 bp, Mus musculus
tcacagagaacgagaaaacagcgga

SEQ ID NO: 966502 - DNA, 25 bp, Mus musculus
tcacagagaacgtgaaaacagcgga

SEQ ID NO: 966503 - DNA, 25 bp, Mus musculus
tcacagagcacaatgattggcagca

SEQ ID NO: 966504 - DNA, 25 bp, Mus musculus
tcacagagcacacctgtcccagaag

SEQ ID NO: 966505 - DNA, 25 bp, Mus musculus
tcacagagcacagctgtcccagaag

SEQ ID NO: 966506 - DNA, 25 bp, Mus musculus
tcacagagcacttttaataacccac

SEQ ID NO: 966507 - DNA, 25 bp, Mus musculus
tcacagagcagaatgattggcagca

SEQ ID NO: 966508 - DNA, 25 bp, Mus musculus
tcacagagcagttttaataacccac

SEQ ID NO: 966509 - DNA, 25 bp, Mus musculus
tcacagagtgtgcaaaagaacacaa

SEQ ID NO: 966510 - DNA, 25 bp, Mus musculus
tcacagagtgtgcgaaaagaacaca

SEQ ID NO: 966511 - DNA, 25 bp, Mus musculus
tcacagagtgtggaaaagaacacaa

SEQ ID NO: 966512 - DNA, 25 bp, Mus musculus
tcacagagtgtgggaaaagaacaca

SEQ ID NO: 966513 - DNA, 25 bp, Mus musculus
tcacagatgaagataacactgtgta

SEQ ID NO: 966514 - DNA, 25 bp, Mus musculus
tcacagatgaagttaacactgtgta

SEQ ID NO: 966515 - DNA, 25 bp, Mus musculus
tcacagatgatcaactatttcaaga

SEQ ID NO: 966516 - DNA, 25 bp, Mus musculus
tcacagatgatcaagtatttcaaga

SEQ ID NO: 966517 - DNA, 25 bp, Mus musculus
tcacagattagcagttattttaact

SEQ ID NO: 966518 - DNA, 25 bp, Mus musculus
tcacagattagctgttattttaact

SEQ ID NO: 966519 - DNA, 25 bp, Mus musculus
tcacagcaagcagcctcccatgtgg

SEQ ID NO: 966520 - DNA, 25 bp, Mus musculus
tcacagcaagcctcccatgtggctc

SEQ ID NO: 966521 - DNA, 25 bp, Mus musculus
tcacagcaaggagcctcccatgtgg

SEQ ID NO: 966522 - DNA, 25 bp, Mus musculus
tcacagcaaggctcccatgtggctc

SEQ ID NO: 966523 - DNA, 25 bp, Mus musculus
tcacagcacataaaatcttgcattg

SEQ ID NO: 966524 - DNA, 25 bp, Mus musculus
tcacagcacataaattcttgcattg

SEQ ID NO: 966525 - DNA, 25 bp, Mus musculus
tcacagcagccacgagatgtcctct

SEQ ID NO: 966526 - DNA, 25 bp, Mus musculus
tcacagcagccaggagatgtcctct

SEQ ID NO: 966527 - DNA, 25 bp, Mus musculus
tcacagcagtctcacctgcccccaa

SEQ ID NO: 966528 - DNA, 25 bp, Mus musculus
tcacagcagtctcagctgcccccaa

SEQ ID NO: 966529 - DNA, 25 bp, Mus musculus
tcacagccagcaagtcacctgggca

SEQ ID NO: 966530 - DNA, 25 bp, Mus musculus
tcacagccaggaagtcacctgggca

SEQ ID NO: 966531 - DNA, 25 bp, Mus musculus
tcacagccccagatcacagccatga

SEQ ID NO: 966532 - DNA, 25 bp, Mus musculus
tcacagccccagttcacagccatga

SEQ ID NO: 966533 - DNA, 25 bp, Mus musculus
tcacagcccccgatcagtatggtgg

SEQ ID NO: 966534 - DNA, 25 bp, Mus musculus
tcacagcccccgttcagtatggtgg

SEQ ID NO: 966535 - DNA, 25 bp, Mus musculus
tcacagctgccacgttatagtaatg

SEQ ID NO: 966536 - DNA, 25 bp, Mus musculus
tcacagctgccaggttatagtaatg

SEQ ID NO: 966537 - DNA, 25 bp, Mus musculus
tcacaggattcacctctgtttccta

SEQ ID NO: 966538 - DNA, 25 bp, Mus musculus
tcacaggattcacgccactaaacct

SEQ ID NO: 966539 - DNA, 25 bp, Mus musculus
tcacaggattcagctctgtttccta

SEQ ID NO: 966540 - DNA, 25 bp, Mus musculus
tcacaggattcaggccactaaacct

SEQ ID NO: 966541 - DNA, 25 bp, Mus musculus
tcacagggatctcgctgccaggaac

SEQ ID NO: 966542 - DNA, 25 bp, Mus musculus
tcacagggatctggctgccaggaac

SEQ ID NO: 966543 - DNA, 25 bp, Mus musculus
tcacagggcctggacttggatccag

SEQ ID NO: 966544 - DNA, 25 bp, Mus musculus
tcacagggcctggagttggatccag

SEQ ID NO: 966545 - DNA, 25 bp, Mus musculus
tcacaggtaaaaatcgattagtcgt

SEQ ID NO: 966546 - DNA, 25 bp, Mus musculus
tcacaggtaaaaatggattagtcgt

SEQ ID NO: 966547 - DNA, 25 bp, Mus musculus
tcacaggtaacgatgaggtcatcgg

SEQ ID NO: 966548 - DNA, 25 bp, Mus musculus
tcacaggtaacgttgaggtcatcgg

SEQ ID NO: 966549 - DNA, 25 bp, Mus musculus
tcacagtagaagagcctccacgctg

SEQ ID NO: 966550 - DNA, 25 bp, Mus musculus
tcacagtagaagtgcctccacgctg

SEQ ID NO: 966551 - DNA, 25 bp, Mus musculus
tcacagtcctggatcctccacgtaa

SEQ ID NO: 966552 - DNA, 25 bp, Mus musculus
tcacagtcctggttcctccacgtaa

SEQ ID NO: 966553 - DNA, 25 bp, Mus musculus
tcacagtctcagaaaccattgaatc

SEQ ID NO: 966554 - DNA, 25 bp, Mus musculus
tcacagtctcagcacccatcgaaac

SEQ ID NO: 966555 - DNA, 25 bp, Mus musculus
tcacagtctcagccacagagaacca

SEQ ID NO: 966556 - DNA, 25 bp, Mus musculus
tcacagtctcaggacccatcgaaac

SEQ ID NO: 966557 - DNA, 25 bp, Mus musculus
tcacagtctcaggcacagagaacca

SEQ ID NO: 966558 - DNA, 25 bp, Mus musculus
tcacagtctcagtaaccattgaatc

SEQ ID NO: 966559 - DNA, 25 bp, Mus musculus
tcacagtctcctcacagagtcagtc

SEQ ID NO: 966560 - DNA, 25 bp, Mus musculus
tcacagtctcctcacagtctgcgag

SEQ ID NO: 966561 - DNA, 25 bp, Mus musculus
tcacagtctcctcacccaaaacaac

SEQ ID NO: 966562 - DNA, 25 bp, Mus musculus
tcacagtctcctcacccaaaacgac

SEQ ID NO: 966563 - DNA, 25 bp, Mus musculus
tcacagtctcctcagagagtcagtc

SEQ ID NO: 966564 - DNA, 25 bp, Mus musculus
tcacagtctcctcagagtctgcgag

SEQ ID NO: 966565 - DNA, 25 bp, Mus musculus
tcacagtctcctcagccaaaacaac

SEQ ID NO: 966566 - DNA, 25 bp, Mus musculus
tcacagtctcctcagccaaaacgac

SEQ ID NO: 966567 - DNA, 25 bp, Mus musculus
tcacagtgacagcgcccaatgtaaa

SEQ ID NO: 966568 - DNA, 25 bp, Mus musculus
tcacagtgacagggcccaatgtaaa

SEQ ID NO: 966569 - DNA, 25 bp, Mus musculus
tcacagtggataaaaagatgcccgt

SEQ ID NO: 966570 - DNA, 25 bp, Mus musculus
tcacagtggataaatagatgcccgt

SEQ ID NO: 966571 - DNA, 25 bp, Mus musculus
tcacagttgttgcactctgatacta

SEQ ID NO: 966572 - DNA, 25 bp, Mus musculus
tcacagttgttggactctgatacta

SEQ ID NO: 966573 - DNA, 25 bp, Mus musculus
tcacatacagcagcgacagttttga

SEQ ID NO: 966574 - DNA, 25 bp, Mus musculus
tcacatacaggagcgacagttttga

SEQ ID NO: 966575 - DNA, 25 bp, Mus musculus
tcacatacctcgccggaggacatca

SEQ ID NO: 966576 - DNA, 25 bp, Mus musculus
tcacatacctcggcggaggacatca

SEQ ID NO: 966577 - DNA, 25 bp, Mus musculus
tcacatactgcatccaaaactactc

SEQ ID NO: 966578 - DNA, 25 bp, Mus musculus
tcacatactggatccaaaactactc

SEQ ID NO: 966579 - DNA, 25 bp, Mus musculus
tcacatatagctcacgtacagctga

SEQ ID NO: 966580 - DNA, 25 bp, Mus musculus
tcacatatagctcaggtacagctga

SEQ ID NO: 966581 - DNA, 25 bp, Mus musculus
tcacatatttagcccgtatacagcg

SEQ ID NO: 966582 - DNA, 25 bp, Mus musculus
tcacatatttaggccgtatacagcg

SEQ ID NO: 966583 - DNA, 25 bp, Mus musculus
tcacatcagcagagcctgcagaagc

SEQ ID NO: 966584 - DNA, 25 bp, Mus musculus
tcacatcagcagcaacgtcatccat

SEQ ID NO: 966585 - DNA, 25 bp, Mus musculus
tcacatcagcaggaacgtcatccat

SEQ ID NO: 966586 - DNA, 25 bp, Mus musculus
tcacatcagcagtgcctgcagaagc

SEQ ID NO: 966587 - DNA, 25 bp, Mus musculus
tcacatctcacacactgtggatatt

SEQ ID NO: 966588 - DNA, 25 bp, Mus musculus
tcacatctcacagactgtggatatt

SEQ ID NO: 966589 - DNA, 25 bp, Mus musculus
tcacatggaaaacgatttgaccgtc

SEQ ID NO: 966590 - DNA, 25 bp, Mus musculus
tcacatggaaaaggatttgaccgtc

SEQ ID NO: 966591 - DNA, 25 bp, Mus musculus
tcacatggagaaactgctgtcattc

SEQ ID NO: 966592 - DNA, 25 bp, Mus musculus
tcacatggagtaactgctgtcattc

SEQ ID NO: 966593 - DNA, 25 bp, Mus musculus
tcacatggtagagacatctgagtgc

SEQ ID NO: 966594 - DNA, 25 bp, Mus musculus
tcacatggtagagagatctgagtgc

SEQ ID NO: 966595 - DNA, 25 bp, Mus musculus
tcacatgtgtactccctcaaaccca

SEQ ID NO: 966596 - DNA, 25 bp, Mus musculus
tcacatgtgtactcgctcaaaccca

SEQ ID NO: 966597 - DNA, 25 bp, Mus musculus
tcacattcagccacaccaagatgaa

SEQ ID NO: 966598 - DNA, 25 bp, Mus musculus
tcacattcagctatcacgtatggac

SEQ ID NO: 966599 - DNA, 25 bp, Mus musculus
tcacattcaggcacaccaagatgaa

SEQ ID NO: 966600 - DNA, 25 bp, Mus musculus
tcacattcaggtatcacgtatggac

SEQ ID NO: 966601 - DNA, 25 bp, Mus musculus
tcacattcgacacgagttgaacacc

SEQ ID NO: 966602 - DNA, 25 bp, Mus musculus
tcacattcgacaggagttgaacacc

SEQ ID NO: 966603 - DNA, 25 bp, Mus musculus
tcacattgctgacacgatgcctagc

SEQ ID NO: 966604 - DNA, 25 bp, Mus musculus
tcacattgctgacaggatgcctagc

SEQ ID NO: 966605 - DNA, 25 bp, Mus musculus
tcacatttggagcgaaggaaaatca

SEQ ID NO: 966606 - DNA, 25 bp, Mus musculus
tcacatttggagggaaggaaaatca

SEQ ID NO: 966607 - DNA, 25 bp, Mus musculus
tcaccaactcagctctctgctctct

SEQ ID NO: 966608 - DNA, 25 bp, Mus musculus
tcaccaactcaggtctctgctctct

SEQ ID NO: 966609 - DNA, 25 bp, Mus musculus
tcaccaaggaggcccaacatccctt

SEQ ID NO: 966610 - DNA, 25 bp, Mus musculus
tcaccaaggaggccgaacatccctt

SEQ ID NO: 966611 - DNA, 25 bp, Mus musculus
tcaccaatcagccacaacagcgatg

SEQ ID NO: 966612 - DNA, 25 bp, Mus musculus
tcaccaatcagccaccagaacagcg

SEQ ID NO: 966613 - DNA, 25 bp, Mus musculus
tcaccaatcagccacccttcgacca

SEQ ID NO: 966614 - DNA, 25 bp, Mus musculus
tcaccaatcagccagaacagcgatg

SEQ ID NO: 966615 - DNA, 25 bp, Mus musculus
tcaccaatcagccagcagaacagcg

SEQ ID NO: 966616 - DNA, 25 bp, Mus musculus
tcaccaatcagccagccttcgacca

SEQ ID NO: 966617 - DNA, 25 bp, Mus musculus
tcaccaatggcgacattctttcaga

SEQ ID NO: 966618 - DNA, 25 bp, Mus musculus
tcaccaatggcgactttctttcaga

SEQ ID NO: 966619 - DNA, 25 bp, Mus musculus
tcaccacacgcacaatcatggagaa

SEQ ID NO: 966620 - DNA, 25 bp, Mus musculus
tcaccacacgcagaatcatggagaa

SEQ ID NO: 966621 - DNA, 25 bp, Mus musculus
tcaccacagactagaacagcagcaa

SEQ ID NO: 966622 - DNA, 25 bp, Mus musculus
tcaccacagacttgaacagcagcaa

SEQ ID NO: 966623 - DNA, 25 bp, Mus musculus
tcaccacagaggcaaacatcttcag

SEQ ID NO: 966624 - DNA, 25 bp, Mus musculus
tcaccacagagggaaacatcttcag

SEQ ID NO: 966625 - DNA, 25 bp, Mus musculus
tcaccacagatgccatcactctggc

SEQ ID NO: 966626 - DNA, 25 bp, Mus musculus
tcaccacagatggcatcactctggc

SEQ ID NO: 966627 - DNA, 25 bp, Mus musculus
tcaccacaggagcaggtgttacagc

SEQ ID NO: 966628 - DNA, 25 bp, Mus musculus
tcaccacaggagctgttacagccat

SEQ ID NO: 966629 - DNA, 25 bp, Mus musculus
tcaccacaggaggaggtgttacagc

SEQ ID NO: 966630 - DNA, 25 bp, Mus musculus
tcaccacaggaggtgttacagccat

SEQ ID NO: 966631 - DNA, 25 bp, Mus musculus
tcaccaccaatgagtacgtctaccg

SEQ ID NO: 966632 - DNA, 25 bp, Mus musculus
tcaccaccaatgtgtacgtctaccg

SEQ ID NO: 966633 - DNA, 25 bp, Mus musculus
tcaccaccacagcacgcactacaga

SEQ ID NO: 966634 - DNA, 25 bp, Mus musculus
tcaccaccacagcaggcactacaga

SEQ ID NO: 966635 - DNA, 25 bp, Mus musculus
tcaccaccatctccccggaacagga

SEQ ID NO: 966636 - DNA, 25 bp, Mus musculus
tcaccaccatgtccccggaacagga

SEQ ID NO: 966637 - DNA, 25 bp, Mus musculus
tcaccaccgtcgagggggagcccat

SEQ ID NO: 966638 - DNA, 25 bp, Mus musculus
tcaccaccgtcgtgggggagcccat

SEQ ID NO: 966639 - DNA, 25 bp, Mus musculus
tcaccaccgtcgttcccactgcagc

SEQ ID NO: 966640 - DNA, 25 bp, Mus musculus
tcaccaccgtggttcccactgcagc

SEQ ID NO: 966641 - DNA, 25 bp, Mus musculus
tcaccagccaatcggcctgccgatt

SEQ ID NO: 966642 - DNA, 25 bp, Mus musculus
tcaccagccaatgggcctgccgatt

SEQ ID NO: 966643 - DNA, 25 bp, Mus musculus
tcaccaggatccccacctgtgcccc

SEQ ID NO: 966644 - DNA, 25 bp, Mus musculus
tcaccaggatccccaggcctcgctg

SEQ ID NO: 966645 - DNA, 25 bp, Mus musculus
tcaccaggatcccctcctgtgcccc

SEQ ID NO: 966646 - DNA, 25 bp, Mus musculus
tcaccaggatcccctggcctcgctg

SEQ ID NO: 966647 - DNA, 25 bp, Mus musculus
tcaccaggggcaaccgcatcgcctt

SEQ ID NO: 966648 - DNA, 25 bp, Mus musculus
tcaccaggggcaacggcatcgcctt

SEQ ID NO: 966649 - DNA, 25 bp, Mus musculus
tcaccaggtggacagcatatccgag

SEQ ID NO: 966650 - DNA, 25 bp, Mus musculus
tcaccaggtggacataagtcattgt

SEQ ID NO: 966651 - DNA, 25 bp, Mus musculus
tcaccaggtggagagcatatccgag

SEQ ID NO: 966652 - DNA, 25 bp, Mus musculus
tcaccaggtggagataagtcattgt

SEQ ID NO: 966653 - DNA, 25 bp, Mus musculus
tcaccagtcatgaggagaaccctgc

SEQ ID NO: 966654 - DNA, 25 bp, Mus musculus
tcaccagtcatgtggagaaccctgc

SEQ ID NO: 966655 - DNA, 25 bp, Mus musculus
tcaccagtgaagaatttgacaaatt

SEQ ID NO: 966656 - DNA, 25 bp, Mus musculus
tcaccagtgaagtatttgacaaatt

SEQ ID NO: 966657 - DNA, 25 bp, Mus musculus
tcaccagtgagccggccccacacaa

SEQ ID NO: 966658 - DNA, 25 bp, Mus musculus
tcaccagtgagcgggccccacacaa

SEQ ID NO: 966659 - DNA, 25 bp, Mus musculus
tcaccatacatgcaccaaagaccag

SEQ ID NO: 966660 - DNA, 25 bp, Mus musculus
tcaccatacatgcagcaaagaccag

SEQ ID NO: 966661 - DNA, 25 bp, Mus musculus
tcaccatagccaccacagcgctgga

SEQ ID NO: 966662 - DNA, 25 bp, Mus musculus
tcaccatagccagcacagcgctgga

SEQ ID NO: 966663 - DNA, 25 bp, Mus musculus
tcaccatcaaaagcaagccgctttt

SEQ ID NO: 966664 - DNA, 25 bp, Mus musculus
tcaccatcaatagcaagccgctttt

SEQ ID NO: 966665 - DNA, 25 bp, Mus musculus
tcaccatccatactgaccatgaggg

SEQ ID NO: 966666 - DNA, 25 bp, Mus musculus
tcaccatccatagtgaccatgaggg

SEQ ID NO: 966667 - DNA, 25 bp, Mus musculus
tcaccatcccaaggcctgacccagt

SEQ ID NO: 966668 - DNA, 25 bp, Mus musculus
tcaccatcccaagggctgacccagt

SEQ ID NO: 966669 - DNA, 25 bp, Mus musculus
tcaccatcctgaaacgcgagaaagg

SEQ ID NO: 966670 - DNA, 25 bp, Mus musculus
tcaccatcctgaaaggcgagaaagg

SEQ ID NO: 966671 - DNA, 25 bp, Mus musculus
tcaccatggcaacactggtgctgac

SEQ ID NO: 966672 - DNA, 25 bp, Mus musculus
tcaccatggcaacagtggtgctgac

SEQ ID NO: 966673 - DNA, 25 bp, Mus musculus
tcaccatggtgacatgtcactgatg

SEQ ID NO: 966674 - DNA, 25 bp, Mus musculus
tcaccatggtgagatgtcactgatg

SEQ ID NO: 966675 - DNA, 25 bp, Mus musculus
tcaccattggagccagagcaccctg

SEQ ID NO: 966676 - DNA, 25 bp, Mus musculus
tcaccattggaggcagagcaccctg

SEQ ID NO: 966677 - DNA, 25 bp, Mus musculus
tcacccacagagtgctgacctagct

SEQ ID NO: 966678 - DNA, 25 bp, Mus musculus
tcacccacagtgtgctgacctagct

SEQ ID NO: 966679 - DNA, 25 bp, Mus musculus
tcacccactgtggacacaccaacga

SEQ ID NO: 966680 - DNA, 25 bp, Mus musculus
tcacccactgtggagacaccaacga

SEQ ID NO: 966681 - DNA, 25 bp, Mus musculus
tcacccagaggataaatgcagctgt

SEQ ID NO: 966682 - DNA, 25 bp, Mus musculus
tcacccagaggatatatgcagctgt

SEQ ID NO: 966683 - DNA, 25 bp, Mus musculus
tcacccagccagactcaggcgagcc

SEQ ID NO: 966684 - DNA, 25 bp, Mus musculus
tcacccagccagtctcaggcgagcc

SEQ ID NO: 966685 - DNA, 25 bp, Mus musculus
tcacccaggaagagatggcctgtgg

SEQ ID NO: 966686 - DNA, 25 bp, Mus musculus
tcacccaggaagtgatggcctgtgg

SEQ ID NO: 966687 - DNA, 25 bp, Mus musculus
tcacccatggaacacaaagtctgga

SEQ ID NO: 966688 - DNA, 25 bp, Mus musculus
tcacccatggaaccaccccccattg

SEQ ID NO: 966689 - DNA, 25 bp, Mus musculus
tcacccatggaagacaaagtctgga

SEQ ID NO: 966690 - DNA, 25 bp, Mus musculus
tcacccatggaagcaccccccattg

SEQ ID NO: 966691 - DNA, 25 bp, Mus musculus
tcaccccactcattcgcctgggtgt

SEQ ID NO: 966692 - DNA, 25 bp, Mus musculus
tcaccccactcattggcctgggtgt

SEQ ID NO: 966693 - DNA, 25 bp, Mus musculus
tcacccccaatgagtacactgcagc

SEQ ID NO: 966694 - DNA, 25 bp, Mus musculus
tcacccccaatgtgtacactgcagc

SEQ ID NO: 966695 - DNA, 25 bp, Mus musculus
tcaccccgatgaagagaactccctc

SEQ ID NO: 966696 - DNA, 25 bp, Mus musculus
tcaccccgatgaagtgaactccctc

SEQ ID NO: 966697 - DNA, 25 bp, Mus musculus
tcacccctccacctcttccaggtga

SEQ ID NO: 966698 - DNA, 25 bp, Mus musculus
tcacccctccacctgttccaggtga

SEQ ID NO: 966699 - DNA, 25 bp, Mus musculus
tcacccctgtatatcaacctgaatt

SEQ ID NO: 966700 - DNA, 25 bp, Mus musculus
tcacccctgtttatcaacctgaatt

SEQ ID NO: 966701 - DNA, 25 bp, Mus musculus
tcacccgactcgacagagactctaa

SEQ ID NO: 966702 - DNA, 25 bp, Mus musculus
tcacccgactcgtcagagactctaa

SEQ ID NO: 966703 - DNA, 25 bp, Mus musculus
tcacccgagtcccctgagggatctg

SEQ ID NO: 966704 - DNA, 25 bp, Mus musculus
tcacccgagtccgctgagggatctg

SEQ ID NO: 966705 - DNA, 25 bp, Mus musculus
tcacccggagaaggcttctttggct

SEQ ID NO: 966706 - DNA, 25 bp, Mus musculus
tcacccggagccttctttggcttgc

SEQ ID NO: 966707 - DNA, 25 bp, Mus musculus
tcacccggaggcttctttggcttgc

SEQ ID NO: 966708 - DNA, 25 bp, Mus musculus
tcacccggagtaggcttctttggct

SEQ ID NO: 966709 - DNA, 25 bp, Mus musculus
tcaccctaatatgacgaactgtact

SEQ ID NO: 966710 - DNA, 25 bp, Mus musculus
tcaccctaatatgaggaactgtact

SEQ ID NO: 966711 - DNA, 25 bp, Mus musculus
tcaccctagccgcacgctcgcgcgg

SEQ ID NO: 966712 - DNA, 25 bp, Mus musculus
tcaccctagccgcaggctcgcgcgg

SEQ ID NO: 966713 - DNA, 25 bp, Mus musculus
tcaccctcagcaaaggcgggaacaa

SEQ ID NO: 966714 - DNA, 25 bp, Mus musculus
tcaccctcagcgaagtgatttcctc

SEQ ID NO: 966715 - DNA, 25 bp, Mus musculus
tcaccctcaggaaaggcgggaacaa

SEQ ID NO: 966716 - DNA, 25 bp, Mus musculus
tcaccctcagggaagtgatttcctc

SEQ ID NO: 966717 - DNA, 25 bp, Mus musculus
tcaccctctacacgagttttcttca

SEQ ID NO: 966718 - DNA, 25 bp, Mus musculus
tcaccctctacaggagttttcttca

SEQ ID NO: 966719 - DNA, 25 bp, Mus musculus
tcaccctgagatggcagcctgcatg

SEQ ID NO: 966720 - DNA, 25 bp, Mus musculus
tcaccctgagatgggagcctgcatg

SEQ ID NO: 966721 - DNA, 25 bp, Mus musculus
tcacccttcttactgggtcctgtgt

SEQ ID NO: 966722 - DNA, 25 bp, Mus musculus
tcacccttcttagtgggtcctgtgt

SEQ ID NO: 966723 - DNA, 25 bp, Mus musculus
tcacccttggccatccactaaattc

SEQ ID NO: 966724 - DNA, 25 bp, Mus musculus
tcacccttgggcatccactaaattc

SEQ ID NO: 966725 - DNA, 25 bp, Mus musculus
tcaccctttgggaaccgcctgctga

SEQ ID NO: 966726 - DNA, 25 bp, Mus musculus
tcaccctttgggaagcgcctgctga

SEQ ID NO: 966727 - DNA, 25 bp, Mus musculus
tcaccgccagatcttttggccactt

SEQ ID NO: 966728 - DNA, 25 bp, Mus musculus
tcaccgccagatgttttggccactt

SEQ ID NO: 966729 - DNA, 25 bp, Mus musculus
tcaccgctgcagcctgtaaatgaaa

SEQ ID NO: 966730 - DNA, 25 bp, Mus musculus
tcaccgctgcaggctgtaaatgaaa

SEQ ID NO: 966731 - DNA, 25 bp, Mus musculus
tcaccgggaaaacacctattcagag

SEQ ID NO: 966732 - DNA, 25 bp, Mus musculus
tcaccgggaaaagacctattcagag

SEQ ID NO: 966733 - DNA, 25 bp, Mus musculus
tcaccgtctcctcacagtctgcgag

SEQ ID NO: 966734 - DNA, 25 bp, Mus musculus
tcaccgtctcctcagagtctgcgag

SEQ ID NO: 966735 - DNA, 25 bp, Mus musculus
tcaccgtggcagcggttcttacaga

SEQ ID NO: 966736 - DNA, 25 bp, Mus musculus
tcaccgtggcaggggttcttacaga

SEQ ID NO: 966737 - DNA, 25 bp, Mus musculus
tcaccgtgtgcacgttctctgtgaa

SEQ ID NO: 966738 - DNA, 25 bp, Mus musculus
tcaccgtgtgcaggttctctgtgaa

SEQ ID NO: 966739 - DNA, 25 bp, Mus musculus
tcacctaaagatactgagccaaaac

SEQ ID NO: 966740 - DNA, 25 bp, Mus musculus
tcacctaaagttactgagccaaaac

SEQ ID NO: 966741 - DNA, 25 bp, Mus musculus
tcacctacaacgacttcctgatcct

SEQ ID NO: 966742 - DNA, 25 bp, Mus musculus
tcacctacaaggacttcctgatcct

SEQ ID NO: 966743 - DNA, 25 bp, Mus musculus
tcacctacacccaatacaagcagct

SEQ ID NO: 966744 - DNA, 25 bp, Mus musculus
tcacctacaccctatacaagcagct

SEQ ID NO: 966745 - DNA, 25 bp, Mus musculus
tcacctacatcaagcttagtgggta

SEQ ID NO: 966746 - DNA, 25 bp, Mus musculus
tcacctacatcatgcttagtgggta

SEQ ID NO: 966747 - DNA, 25 bp, Mus musculus
tcacctacatccacctgagcggagc

SEQ ID NO: 966748 - DNA, 25 bp, Mus musculus
tcacctacatcctcctgagcggagc

SEQ ID NO: 966749 - DNA, 25 bp, Mus musculus
tcacctagatctcacagcatctaac

SEQ ID NO: 966750 - DNA, 25 bp, Mus musculus
tcacctagatctcagagcatctaac

SEQ ID NO: 966751 - DNA, 25 bp, Mus musculus
tcacctatgatgaggactaccagca

SEQ ID NO: 966752 - DNA, 25 bp, Mus musculus
tcacctatgatgcacaagaagctga

SEQ ID NO: 966753 - DNA, 25 bp, Mus musculus
tcacctatgatggacaagaagctga

SEQ ID NO: 966754 - DNA, 25 bp, Mus musculus
tcacctatgatgtggactaccagca

SEQ ID NO: 966755 - DNA, 25 bp, Mus musculus
tcacctcgccagcctgcctaaacca

SEQ ID NO: 966756 - DNA, 25 bp, Mus musculus
tcacctcgccagcgtgcactcgtga

SEQ ID NO: 966757 - DNA, 25 bp, Mus musculus
tcacctcgccaggctgcctaaacca

SEQ ID NO: 966758 - DNA, 25 bp, Mus musculus
tcacctcgccagggtgcactcgtga

SEQ ID NO: 966759 - DNA, 25 bp, Mus musculus
tcacctcgcctgcacgttgtcaggt

SEQ ID NO: 966760 - DNA, 25 bp, Mus musculus
tcacctcgcctggacgttgtcaggt

SEQ ID NO: 966761 - DNA, 25 bp, Mus musculus
tcacctctatcaagtaaatggtgtc

SEQ ID NO: 966762 - DNA, 25 bp, Mus musculus
tcacctctatgaagtaaatggtgtc

SEQ ID NO: 966763 - DNA, 25 bp, Mus musculus
tcacctctcatccacgtcagattgt

SEQ ID NO: 966764 - DNA, 25 bp, Mus musculus
tcacctctcatccaggtcagattgt

SEQ ID NO: 966765 - DNA, 25 bp, Mus musculus
tcacctctgcctactatcgtggggc

SEQ ID NO: 966766 - DNA, 25 bp, Mus musculus
tcacctctgcgtactatcgtggggc

SEQ ID NO: 966767 - DNA, 25 bp, Mus musculus
tcacctgcagatactttatgcatgg

SEQ ID NO: 966768 - DNA, 25 bp, Mus musculus
tcacctgcagctattttatgcatgg

SEQ ID NO: 966769 - DNA, 25 bp, Mus musculus
tcacctgcaggtattttatgcatgg

SEQ ID NO: 966770 - DNA, 25 bp, Mus musculus
tcacctgcagttactttatgcatgg

SEQ ID NO: 966771 - DNA, 25 bp, Mus musculus
tcacctggagacaacctacgcatgg

SEQ ID NO: 966772 - DNA, 25 bp, Mus musculus
tcacctggagacaagctacgcatgg

SEQ ID NO: 966773 - DNA, 25 bp, Mus musculus
tcacctgtagaatggtgccctcggt

SEQ ID NO: 966774 - DNA, 25 bp, Mus musculus
tcacctgtagtatggtgccctcggt

SEQ ID NO: 966775 - DNA, 25 bp, Mus musculus
tcacctgtgcagtacgggacggagg

SEQ ID NO: 966776 - DNA, 25 bp, Mus musculus
tcacctgtgcagtaggggacggagg

SEQ ID NO: 966777 - DNA, 25 bp, Mus musculus
tcaccttcagctacccctgcagacc

SEQ ID NO: 966778 - DNA, 25 bp, Mus musculus
tcaccttcaggtacccctgcagacc

SEQ ID NO: 966779 - DNA, 25 bp, Mus musculus
tcaccttcctcccactggccaggct

SEQ ID NO: 966780 - DNA, 25 bp, Mus musculus
tcaccttcctcccagtggccaggct

SEQ ID NO: 966781 - DNA, 25 bp, Mus musculus
tcaccttctcggccagtgttctgcc

SEQ ID NO: 966782 - DNA, 25 bp, Mus musculus
tcaccttctcgggcagtgttctgcc

SEQ ID NO: 966783 - DNA, 25 bp, Mus musculus
tcacctttaccagccgcactcagtc

SEQ ID NO: 966784 - DNA, 25 bp, Mus musculus
tcacctttaccagcggcactcagtc

SEQ ID NO: 966785 - DNA, 25 bp, Mus musculus
tcacctttgcaatccatggcagctc

SEQ ID NO: 966786 - DNA, 25 bp, Mus musculus
tcacctttgcaatcgatggcagctc

SEQ ID NO: 966787 - DNA, 25 bp, Mus musculus
tcacctttggagtcctgtgcatgtg

SEQ ID NO: 966788 - DNA, 25 bp, Mus musculus
tcacctttggtgtcctgtgcatgtg

SEQ ID NO: 966789 - DNA, 25 bp, Mus musculus
tcacgaagcagacgctgaggagcct

SEQ ID NO: 966790 - DNA, 25 bp, Mus musculus
tcacgaagcagaggctgaggagcct

SEQ ID NO: 966791 - DNA, 25 bp, Mus musculus
tcacgactctgacgaagcaggctga

SEQ ID NO: 966792 - DNA, 25 bp, Mus musculus
tcacgactctgaggaagcaggctga

SEQ ID NO: 966793 - DNA, 25 bp, Mus musculus
tcacgagaagatgtgtatgtcgaca

SEQ ID NO: 966794 - DNA, 25 bp, Mus musculus
tcacgagaagttgtgtatgtcgaca

SEQ ID NO: 966795 - DNA, 25 bp, Mus musculus
tcacgagacacagttagcagagctg

SEQ ID NO: 966796 - DNA, 25 bp, Mus musculus
tcacgagacagagttagcagagctg

SEQ ID NO: 966797 - DNA, 25 bp, Mus musculus
tcacgaggaccgcccatccccagtg

SEQ ID NO: 966798 - DNA, 25 bp, Mus musculus
tcacgaggaccggccatccccagtg

SEQ ID NO: 966799 - DNA, 25 bp, Mus musculus
tcacgagggcgacgctcggctatta

SEQ ID NO: 966800 - DNA, 25 bp, Mus musculus
tcacgagggcgaggctcggctatta

SEQ ID NO: 966801 - DNA, 25 bp, Mus musculus
tcacgataggcaaggggaagtcaga

SEQ ID NO: 966802 - DNA, 25 bp, Mus musculus
tcacgatagggaaggggaagtcaga

SEQ ID NO: 966803 - DNA, 25 bp, Mus musculus
tcacgattacttcgtgtcccttact

SEQ ID NO: 966804 - DNA, 25 bp, Mus musculus
tcacgattacttggtgtcccttact

SEQ ID NO: 966805 - DNA, 25 bp, Mus musculus
tcacgccaagagcatcgtgcagtcc

SEQ ID NO: 966806 - DNA, 25 bp, Mus musculus
tcacgccaagtgcatcgtgcagtcc

SEQ ID NO: 966807 - DNA, 25 bp, Mus musculus
tcacgccagtaaagtagacttcgac

SEQ ID NO: 966808 - DNA, 25 bp, Mus musculus
tcacgccagtgcaaaagtagacttc

SEQ ID NO: 966809 - DNA, 25 bp, Mus musculus
tcacgccagtgctaaagtagacttc

SEQ ID NO: 966810 - DNA, 25 bp, Mus musculus
tcacgccagttaagtagacttcgac

SEQ ID NO: 966811 - DNA, 25 bp, Mus musculus
tcacgcccccagatgaagactgtcc

SEQ ID NO: 966812 - DNA, 25 bp, Mus musculus
tcacgcccccagttgaagactgtcc

SEQ ID NO: 966813 - DNA, 25 bp, Mus musculus
tcacgccgggcactgaccagctggg

SEQ ID NO: 966814 - DNA, 25 bp, Mus musculus
tcacgccggggactgaccagctggg

SEQ ID NO: 966815 - DNA, 25 bp, Mus musculus
tcacgcctctagaccagcagttatt

SEQ ID NO: 966816 - DNA, 25 bp, Mus musculus
tcacgcctctcttctgtattatggg

SEQ ID NO: 966817 - DNA, 25 bp, Mus musculus
tcacgcctctgttctgtattatggg

SEQ ID NO: 966818 - DNA, 25 bp, Mus musculus
tcacgcctcttgaccagcagttatt

SEQ ID NO: 966819 - DNA, 25 bp, Mus musculus
tcacgcgccgcgcccttagaagaaa

SEQ ID NO: 966820 - DNA, 25 bp, Mus musculus
tcacgcgccgcgcctccatgttcta

SEQ ID NO: 966821 - DNA, 25 bp, Mus musculus
tcacgcgccgcggccttagaagaaa

SEQ ID NO: 966822 - DNA, 25 bp, Mus musculus
tcacgcgccgcggctccatgttcta

SEQ ID NO: 966823 - DNA, 25 bp, Mus musculus
tcacgctaagcattctgagggcatc

SEQ ID NO: 966824 - DNA, 25 bp, Mus musculus
tcacgctaaggattctgagggcatc

SEQ ID NO: 966825 - DNA, 25 bp, Mus musculus
tcacgctacggaatgaagctaccca

SEQ ID NO: 966826 - DNA, 25 bp, Mus musculus
tcacgctacggattgaagctaccca

SEQ ID NO: 966827 - DNA, 25 bp, Mus musculus
tcacgctcacagccttaagcgagat

SEQ ID NO: 966828 - DNA, 25 bp, Mus musculus
tcacgctcacaggcttaagcgagat

SEQ ID NO: 966829 - DNA, 25 bp, Mus musculus
tcacgctgcgaccacgggagcccca

SEQ ID NO: 966830 - DNA, 25 bp, Mus musculus
tcacgctgcgaccaggggagcccca

SEQ ID NO: 966831 - DNA, 25 bp, Mus musculus
tcacgcttactgcccgaacccagac

SEQ ID NO: 966832 - DNA, 25 bp, Mus musculus
tcacgcttactgccggaacccagac

SEQ ID NO: 966833 - DNA, 25 bp, Mus musculus
tcacggaaatactcattgcaaacca

SEQ ID NO: 966834 - DNA, 25 bp, Mus musculus
tcacggaaattctcattgcaaacca

SEQ ID NO: 966835 - DNA, 25 bp, Mus musculus
tcacggaactcgagaatgataccaa

SEQ ID NO: 966836 - DNA, 25 bp, Mus musculus
tcacggaactcgctaagccgggcaa

SEQ ID NO: 966837 - DNA, 25 bp, Mus musculus
tcacggaactcggtaagccgggcaa

SEQ ID NO: 966838 - DNA, 25 bp, Mus musculus
tcacggaactcgtgaatgataccaa

SEQ ID NO: 966839 - DNA, 25 bp, Mus musculus
tcacggagctctgcacagaagagct

SEQ ID NO: 966840 - DNA, 25 bp, Mus musculus
tcacggagctgtgcacagaagagct

SEQ ID NO: 966841 - DNA, 25 bp, Mus musculus
tcacggaggccacgctgtccttcta

SEQ ID NO: 966842 - DNA, 25 bp, Mus musculus
tcacggaggccaggctgtccttcta

SEQ ID NO: 966843 - DNA, 25 bp, Mus musculus
tcacggcctaccctggatgagcgat

SEQ ID NO: 966844 - DNA, 25 bp, Mus musculus
tcacggcctagcctggatgagcgat

SEQ ID NO: 966845 - DNA, 25 bp, Mus musculus
tcacgggacaagcacgagctgctca

SEQ ID NO: 966846 - DNA, 25 bp, Mus musculus
tcacgggacaagcaggagctgctca

SEQ ID NO: 966847 - DNA, 25 bp, Mus musculus
tcacggtcattacaccacttcctgg

SEQ ID NO: 966848 - DNA, 25 bp, Mus musculus
tcacggtcattagaccacttcctgg

SEQ ID NO: 966849 - DNA, 25 bp, Mus musculus
tcacggtcgagtggaaagcacaatc

SEQ ID NO: 966850 - DNA, 25 bp, Mus musculus
tcacggtcgagtggtaagcacaatc

SEQ ID NO: 966851 - DNA, 25 bp, Mus musculus
tcacggtgctgccacaggaagacct

SEQ ID NO: 966852 - DNA, 25 bp, Mus musculus
tcacggtgctgccagaggaagacct

SEQ ID NO: 966853 - DNA, 25 bp, Mus musculus
tcacgtatttaccgcagaaacagta

SEQ ID NO: 966854 - DNA, 25 bp, Mus musculus
tcacgtatttacggcagaaacagta

SEQ ID NO: 966855 - DNA, 25 bp, Mus musculus
tcacgtcacgagcgaccgtgaaggt

SEQ ID NO: 966856 - DNA, 25 bp, Mus musculus
tcacgtcacgagggaccgtgaaggt

SEQ ID NO: 966857 - DNA, 25 bp, Mus musculus
tcacgtcgcacaccatggaggagtg

SEQ ID NO: 966858 - DNA, 25 bp, Mus musculus
tcacgtcgcacagcatggaggagtg

SEQ ID NO: 966859 - DNA, 25 bp, Mus musculus
tcacgtgcacgccagaaagccaagt

SEQ ID NO: 966860 - DNA, 25 bp, Mus musculus
tcacgtgcacgcgagaaagccaagt

SEQ ID NO: 966861 - DNA, 25 bp, Mus musculus
tcacgttccgagcccataaggaagc

SEQ ID NO: 966862 - DNA, 25 bp, Mus musculus
tcacgttccgaggccataaggaagc

SEQ ID NO: 966863 - DNA, 25 bp, Mus musculus
tcactaataaagaagtgtgctggtg

SEQ ID NO: 966864 - DNA, 25 bp, Mus musculus
tcactaataaagtagtgtgctggtg

SEQ ID NO: 966865 - DNA, 25 bp, Mus musculus
tcactaccagctgcagacccacctg

SEQ ID NO: 966866 - DNA, 25 bp, Mus musculus
tcactaccaggtgcagacccacctg

SEQ ID NO: 966867 - DNA, 25 bp, Mus musculus
tcactaccgatccggatatcgtggc

SEQ ID NO: 966868 - DNA, 25 bp, Mus musculus
tcactaccgatcgggatatcgtggc

SEQ ID NO: 966869 - DNA, 25 bp, Mus musculus
tcactacctgcggaaggttcaggat

SEQ ID NO: 966870 - DNA, 25 bp, Mus musculus
tcactacctgcggatggttcaggat

SEQ ID NO: 966871 - DNA, 25 bp, Mus musculus
tcactactcactcacggatgactat

SEQ ID NO: 966872 - DNA, 25 bp, Mus musculus
tcactactcactcagggatgactat

SEQ ID NO: 966873 - DNA, 25 bp, Mus musculus
tcactcaacagccacgctctgaggt

SEQ ID NO: 966874 - DNA, 25 bp, Mus musculus
tcactcaacagccaggctctgaggt

SEQ ID NO: 966875 - DNA, 25 bp, Mus musculus
tcactcagagccagccatggaacgt

SEQ ID NO: 966876 - DNA, 25 bp, Mus musculus
tcactcagaggcagccatggaacgt

SEQ ID NO: 966877 - DNA, 25 bp, Mus musculus
tcactcatgagcgccacatacttca

SEQ ID NO: 966878 - DNA, 25 bp, Mus musculus
tcactcatgagcgcgacatacttca

SEQ ID NO: 966879 - DNA, 25 bp, Mus musculus
tcactcatgcagcttgctgatgccc

SEQ ID NO: 966880 - DNA, 25 bp, Mus musculus
tcactcatgcaggttgctgatgccc

SEQ ID NO: 966881 - DNA, 25 bp, Mus musculus
tcactctacaagcaatgctgtgact

SEQ ID NO: 966882 - DNA, 25 bp, Mus musculus
tcactctacaagcactccctgctgc

SEQ ID NO: 966883 - DNA, 25 bp, Mus musculus
tcactctacaaggaatgctgtgact

SEQ ID NO: 966884 - DNA, 25 bp, Mus musculus
tcactctacaaggactccctgctgc

SEQ ID NO: 966885 - DNA, 25 bp, Mus musculus
tcactctcaacatgcagaggcacca

SEQ ID NO: 966886 - DNA, 25 bp, Mus musculus
tcactctcaacatggagaggcacca

SEQ ID NO: 966887 - DNA, 25 bp, Mus musculus
tcactctggccgtcccggctggact

SEQ ID NO: 966888 - DNA, 25 bp, Mus musculus
tcactctggccgtcgcggctggact

SEQ ID NO: 966889 - DNA, 25 bp, Mus musculus
tcactgaaaaatctagttcctaata

SEQ ID NO: 966890 - DNA, 25 bp, Mus musculus
tcactgaaaaatgtagttcctaata

SEQ ID NO: 966891 - DNA, 25 bp, Mus musculus
tcactgaaagctgggaagtcatcaa

SEQ ID NO: 966892 - DNA, 25 bp, Mus musculus
tcactgaaaggtgggaagtcatcaa

SEQ ID NO: 966893 - DNA, 25 bp, Mus musculus
tcactgaactgaagaatccctccaa

SEQ ID NO: 966894 - DNA, 25 bp, Mus musculus
tcactgaactgatgaatccctccaa

SEQ ID NO: 966895 - DNA, 25 bp, Mus musculus
tcactgaatttatcctcagatacag

SEQ ID NO: 966896 - DNA, 25 bp, Mus musculus
tcactgaatttatcgtcagatacag

SEQ ID NO: 966897 - DNA, 25 bp, Mus musculus
tcactgacatctcgcccgtgggcgt

SEQ ID NO: 966898 - DNA, 25 bp, Mus musculus
tcactgacatctggcccgtgggcgt

SEQ ID NO: 966899 - DNA, 25 bp, Mus musculus
tcactgacttgctacgaggtctttt

SEQ ID NO: 966900 - DNA, 25 bp, Mus musculus
tcactgacttgctaggaggtctttt

SEQ ID NO: 966901 - DNA, 25 bp, Mus musculus
tcactgactttgagcacaggatccc

SEQ ID NO: 966902 - DNA, 25 bp, Mus musculus
tcactgactttgtgcacaggatccc

SEQ ID NO: 966903 - DNA, 25 bp, Mus musculus
tcactgcaaaggaacctcaatgaca

SEQ ID NO: 966904 - DNA, 25 bp, Mus musculus
tcactgcaaaggaagctcaatgaca

SEQ ID NO: 966905 - DNA, 25 bp, Mus musculus
tcactgcaacaacgtgtcagctgat

SEQ ID NO: 966906 - DNA, 25 bp, Mus musculus
tcactgcaacaaggtgtcagctgat

SEQ ID NO: 966907 - DNA, 25 bp, Mus musculus
tcactgcactggaacctcaatgaga

SEQ ID NO: 966908 - DNA, 25 bp, Mus musculus
tcactgcactggaagctcaatgaga

SEQ ID NO: 966909 - DNA, 25 bp, Mus musculus
tcactgcaggcaagtttcttgaagc

SEQ ID NO: 966910 - DNA, 25 bp, Mus musculus
tcactgcagggaagtttcttgaagc

SEQ ID NO: 966911 - DNA, 25 bp, Mus musculus
tcactgccaccccaaggtaagtgca

SEQ ID NO: 966912 - DNA, 25 bp, Mus musculus
tcactgccacccgaaggtaagtgca

SEQ ID NO: 966913 - DNA, 25 bp, Mus musculus
tcactgccagaactcggttaccatc

SEQ ID NO: 966914 - DNA, 25 bp, Mus musculus
tcactgccagcacgttggtgtcagc

SEQ ID NO: 966915 - DNA, 25 bp, Mus musculus
tcactgccagcaggttggtgtcagc

SEQ ID NO: 966916 - DNA, 25 bp, Mus musculus
tcactgccagtactcggttaccatc

SEQ ID NO: 966917 - DNA, 25 bp, Mus musculus
tcactgcctcttggcagcccttgca

SEQ ID NO: 966918 - DNA, 25 bp, Mus musculus
tcactgcctcttgggagcccttgca

SEQ ID NO: 966919 - DNA, 25 bp, Mus musculus
tcactgcctgataaatacaacacca

SEQ ID NO: 966920 - DNA, 25 bp, Mus musculus
tcactgcctgatcttgtccaggaag

SEQ ID NO: 966921 - DNA, 25 bp, Mus musculus
tcactgcctgatgttgtccaggaag

SEQ ID NO: 966922 - DNA, 25 bp, Mus musculus
tcactgcctgattaatacaacacca

SEQ ID NO: 966923 - DNA, 25 bp, Mus musculus
tcactgctagctatggcactgcaac

SEQ ID NO: 966924 - DNA, 25 bp, Mus musculus
tcactgctaggtatggcactgcaac

SEQ ID NO: 966925 - DNA, 25 bp, Mus musculus
tcactgcttgccgtactactaactg

SEQ ID NO: 966926 - DNA, 25 bp, Mus musculus
tcactgcttggcgtactactaactg

SEQ ID NO: 966927 - DNA, 25 bp, Mus musculus
tcactggaatgatgcggctatcctg

SEQ ID NO: 966928 - DNA, 25 bp, Mus musculus
tcactggaatgatggggctatcctg

SEQ ID NO: 966929 - DNA, 25 bp, Mus musculus
tcactggacatgcgtgaagaagggg

SEQ ID NO: 966930 - DNA, 25 bp, Mus musculus
tcactggacatgggtgaagaagggg

SEQ ID NO: 966931 - DNA, 25 bp, Mus musculus
tcactggagtcccacaaggaacggc

SEQ ID NO: 966932 - DNA, 25 bp, Mus musculus
tcactggagtcccagaaggaacggc

SEQ ID NO: 966933 - DNA, 25 bp, Mus musculus
tcactggccaagaccgggagcccac

SEQ ID NO: 966934 - DNA, 25 bp, Mus musculus
tcactggccaagtccgggagcccac

SEQ ID NO: 966935 - DNA, 25 bp, Mus musculus
tcactgggaacacggtcttcttcag

SEQ ID NO: 966936 - DNA, 25 bp, Mus musculus
tcactgggaacagggtcttcttcag

SEQ ID NO: 966937 - DNA, 25 bp, Mus musculus
tcactggttatgcatccatctgttg

SEQ ID NO: 966938 - DNA, 25 bp, Mus musculus
tcactggttatgctttccatgaagt

SEQ ID NO: 966939 - DNA, 25 bp, Mus musculus
tcactggttatggatccatctgttg

SEQ ID NO: 966940 - DNA, 25 bp, Mus musculus
tcactggttatggtttccatgaagt

SEQ ID NO: 966941 - DNA, 25 bp, Mus musculus
tcactggtttctcacacccctatgt

SEQ ID NO: 966942 - DNA, 25 bp, Mus musculus
tcactggtttctcagacccctatgt

SEQ ID NO: 966943 - DNA, 25 bp, Mus musculus
tcactgtaagattctgattttagat

SEQ ID NO: 966944 - DNA, 25 bp, Mus musculus
tcactgtaagtttctgattttagat

SEQ ID NO: 966945 - DNA, 25 bp, Mus musculus
tcactgtccaagacccagcaactac

SEQ ID NO: 966946 - DNA, 25 bp, Mus musculus
tcactgtccaagaggacacgggcct

SEQ ID NO: 966947 - DNA, 25 bp, Mus musculus
tcactgtccaagcgcccaagtccag

SEQ ID NO: 966948 - DNA, 25 bp, Mus musculus
tcactgtccaagggcccaagtccag

SEQ ID NO: 966949 - DNA, 25 bp, Mus musculus
tcactgtccaagtcccagcaactac

SEQ ID NO: 966950 - DNA, 25 bp, Mus musculus
tcactgtccaagtggacacgggcct

SEQ ID NO: 966951 - DNA, 25 bp, Mus musculus
tcactgtctctgcacagtctgcgag

SEQ ID NO: 966952 - DNA, 25 bp, Mus musculus
tcactgtctctgcagagtctgcgag

SEQ ID NO: 966953 - DNA, 25 bp, Mus musculus
tcactgtgcattatgcgccaactat

SEQ ID NO: 966954 - DNA, 25 bp, Mus musculus
tcactgtgcattttgcgccaactat

SEQ ID NO: 966955 - DNA, 25 bp, Mus musculus
tcactgtgcgccagctggaggctat

SEQ ID NO: 966956 - DNA, 25 bp, Mus musculus
tcactgtgcggcagctggaggctat

SEQ ID NO: 966957 - DNA, 25 bp, Mus musculus
tcactgtgctaaaggcccacgttgt

SEQ ID NO: 966958 - DNA, 25 bp, Mus musculus
tcactgtgctaatggcccacgttgt

SEQ ID NO: 966959 - DNA, 25 bp, Mus musculus
tcactgtgctcgcaatcccacagaa

SEQ ID NO: 966960 - DNA, 25 bp, Mus musculus
tcactgtgctcggaatcccacagaa

SEQ ID NO: 966961 - DNA, 25 bp, Mus musculus
tcactgtgctctacccagcccaggt

SEQ ID NO: 966962 - DNA, 25 bp, Mus musculus
tcactgtgctcttcccagcccaggt

SEQ ID NO: 966963 - DNA, 25 bp, Mus musculus
tcactgtggtaacgtggaagggact

SEQ ID NO: 966964 - DNA, 25 bp, Mus musculus
tcactgtggtaaggtggaagggact

SEQ ID NO: 966965 - DNA, 25 bp, Mus musculus
tcacttagacagacttacaacagct

SEQ ID NO: 966966 - DNA, 25 bp, Mus musculus
tcacttagacagtcttacaacagct

SEQ ID NO: 966967 - DNA, 25 bp, Mus musculus
tcacttcaagctggacctggtgtgt

SEQ ID NO: 966968 - DNA, 25 bp, Mus musculus
tcacttcaaggtggacctggtgtgt

SEQ ID NO: 966969 - DNA, 25 bp, Mus musculus
tcacttccaatgcaccctgtggcat

SEQ ID NO: 966970 - DNA, 25 bp, Mus musculus
tcacttccaatgcagcctgtggcat

SEQ ID NO: 966971 - DNA, 25 bp, Mus musculus
tcacttccacggagggatacttatc

SEQ ID NO: 966972 - DNA, 25 bp, Mus musculus
tcacttccacggtgggatacttatc

SEQ ID NO: 966973 - DNA, 25 bp, Mus musculus
tcacttcccacagacgttgaaatgg

SEQ ID NO: 966974 - DNA, 25 bp, Mus musculus
tcacttcccacagaggttgaaatgg

SEQ ID NO: 966975 - DNA, 25 bp, Mus musculus
tcacttccttcactgtgtactgcag

SEQ ID NO: 966976 - DNA, 25 bp, Mus musculus
tcacttccttcagtgtgtactgcag

SEQ ID NO: 966977 - DNA, 25 bp, Mus musculus
tcacttcgtgacatcaccgcaaacg

SEQ ID NO: 966978 - DNA, 25 bp, Mus musculus
tcacttcgtgtcatcaccgcaaacg

SEQ ID NO: 966979 - DNA, 25 bp, Mus musculus
tcacttctcaagaccaccttgtcaa

SEQ ID NO: 966980 - DNA, 25 bp, Mus musculus
tcacttctcaagtccaccttgtcaa

SEQ ID NO: 966981 - DNA, 25 bp, Mus musculus
tcacttctcctccactctgggcatc

SEQ ID NO: 966982 - DNA, 25 bp, Mus musculus
tcacttctcctcgactctgggcatc

SEQ ID NO: 966983 - DNA, 25 bp, Mus musculus
tcacttgaagcccatctctgagcga

SEQ ID NO: 966984 - DNA, 25 bp, Mus musculus
tcacttgaaggccatctctgagcga

SEQ ID NO: 966985 - DNA, 25 bp, Mus musculus
tcacttgcagacgagcaaaagacgt

SEQ ID NO: 966986 - DNA, 25 bp, Mus musculus
tcacttgcagctgttgtttgtggca

SEQ ID NO: 966987 - DNA, 25 bp, Mus musculus
tcacttgcaggtgttgtttgtggca

SEQ ID NO: 966988 - DNA, 25 bp, Mus musculus
tcacttgcagtcgagcaaaagacgt

SEQ ID NO: 966989 - DNA, 25 bp, Mus musculus
tcacttgcttcacccagagtaacag

SEQ ID NO: 966990 - DNA, 25 bp, Mus musculus
tcacttgcttcagccagagtaacag

SEQ ID NO: 966991 - DNA, 25 bp, Mus musculus
tcacttgggcatcatccagagcaat

SEQ ID NO: 966992 - DNA, 25 bp, Mus musculus
tcacttgggcatcctttggtggccc

SEQ ID NO: 966993 - DNA, 25 bp, Mus musculus
tcacttgggcatgatccagagcaat

SEQ ID NO: 966994 - DNA, 25 bp, Mus musculus
tcacttgggcatgctttggtggccc

SEQ ID NO: 966995 - DNA, 25 bp, Mus musculus
tcacttggtcagctactggatctca

SEQ ID NO: 966996 - DNA, 25 bp, Mus musculus
tcacttggtcaggtactggatctca

SEQ ID NO: 966997 - DNA, 25 bp, Mus musculus
tcacttgtacagcgacttatcggat

SEQ ID NO: 966998 - DNA, 25 bp, Mus musculus
tcacttgtacagggacttatcggat

SEQ ID NO: 966999 - DNA, 25 bp, Mus musculus
tcactttaagacagctattgagaag

SEQ ID NO: 967000 - DNA, 25 bp, Mus musculus
tcactttaagctgcctgctgttcct

SEQ ID NO: 967001 - DNA, 25 bp, Mus musculus
tcactttaaggtgcctgctgttcct

SEQ ID NO: 967002 - DNA, 25 bp, Mus musculus
tcactttaagtcagctattgagaag

SEQ ID NO: 967003 - DNA, 25 bp, Mus musculus
tcactttcaaagccatctagtcttg

SEQ ID NO: 967004 - DNA, 25 bp, Mus musculus
tcactttcaaaggcatctagtcttg

SEQ ID NO: 967005 - DNA, 25 bp, Mus musculus
tcactttcaacggtgtttgcacaca

SEQ ID NO: 967006 - DNA, 25 bp, Mus musculus
tcactttcaagggtgtttgcacaca

SEQ ID NO: 967007 - DNA, 25 bp, Mus musculus
tcactttcctaaccgcacagaccag

SEQ ID NO: 967008 - DNA, 25 bp, Mus musculus
tcactttcctaccagcaatgccagt

SEQ ID NO: 967009 - DNA, 25 bp, Mus musculus
tcactttccttaccgcacagaccag

SEQ ID NO: 967010 - DNA, 25 bp, Mus musculus
tcactttccttccagcaatgccagt

SEQ ID NO: 967011 - DNA, 25 bp, Mus musculus
tcactttggaagagctcattgccca

SEQ ID NO: 967012 - DNA, 25 bp, Mus musculus
tcactttggaagtgctcattgccca

SEQ ID NO: 967013 - DNA, 25 bp, Mus musculus
tcactttggccacgaggagttgcag

SEQ ID NO: 967014 - DNA, 25 bp, Mus musculus
tcactttggccaggaggagttgcag

SEQ ID NO: 967015 - DNA, 25 bp, Mus musculus
tcactttgtctccacttcatctgac

SEQ ID NO: 967016 - DNA, 25 bp, Mus musculus
tcactttgtctccagttcatctgac

SEQ ID NO: 967017 - DNA, 25 bp, Mus musculus
tcacttttgaaacagtggagcagat

SEQ ID NO: 967018 - DNA, 25 bp, Mus musculus
tcacttttgaaagagtggagcagat

SEQ ID NO: 967019 - DNA, 25 bp, Mus musculus
tcagaaaaatctctgctccagctca

SEQ ID NO: 967020 - DNA, 25 bp, Mus musculus
tcagaaaaatgtctgctccagctca

SEQ ID NO: 967021 - DNA, 25 bp, Mus musculus
tcagaaaactaagctttccatagcc

SEQ ID NO: 967022 - DNA, 25 bp, Mus musculus
tcagaaaacttagctttccatagcc

SEQ ID NO: 967023 - DNA, 25 bp, Mus musculus
tcagaaaagactctcattactaaga

SEQ ID NO: 967024 - DNA, 25 bp, Mus musculus
tcagaaaagactgtcattactaaga

SEQ ID NO: 967025 - DNA, 25 bp, Mus musculus
tcagaaaataaaccaattgaacctg

SEQ ID NO: 967026 - DNA, 25 bp, Mus musculus
tcagaaaataaagcaattgaacctg

SEQ ID NO: 967027 - DNA, 25 bp, Mus musculus
tcagaaaatcttagtcttcagttca

SEQ ID NO: 967028 - DNA, 25 bp, Mus musculus
tcagaaaatctttgtcttcagttca

SEQ ID NO: 967029 - DNA, 25 bp, Mus musculus
tcagaaaatgcctcctcggtggcag

SEQ ID NO: 967030 - DNA, 25 bp, Mus musculus
tcagaaaatggctcctcggtggcag

SEQ ID NO: 967031 - DNA, 25 bp, Mus musculus
tcagaaaatgggaccggaaaatgct

SEQ ID NO: 967032 - DNA, 25 bp, Mus musculus
tcagaaaatgggacgggaaaatgct

SEQ ID NO: 967033 - DNA, 25 bp, Mus musculus
tcagaaacagccggaaaaactgatg

SEQ ID NO: 967034 - DNA, 25 bp, Mus musculus
tcagaaacaggcggaaaaactgatg

SEQ ID NO: 967035 - DNA, 25 bp, Mus musculus
tcagaaactacacgaagttgaaatt

SEQ ID NO: 967036 - DNA, 25 bp, Mus musculus
tcagaaactacaggaagttgaaatt

SEQ ID NO: 967037 - DNA, 25 bp, Mus musculus
tcagaaactccactagtggccacag

SEQ ID NO: 967038 - DNA, 25 bp, Mus musculus
tcagaaactccactggccacagagg

SEQ ID NO: 967039 - DNA, 25 bp, Mus musculus
tcagaaactccagtagtggccacag

SEQ ID NO: 967040 - DNA, 25 bp, Mus musculus
tcagaaactccagtggccacagagg

SEQ ID NO: 967041 - DNA, 25 bp, Mus musculus
tcagaaacttatgaaatgggacacc

SEQ ID NO: 967042 - DNA, 25 bp, Mus musculus
tcagaaacttatgatatgggacacc

SEQ ID NO: 967043 - DNA, 25 bp, Mus musculus
tcagaaagacaacaaaacagaaata

SEQ ID NO: 967044 - DNA, 25 bp, Mus musculus
tcagaaagacaagaaaacagaaata

SEQ ID NO: 967045 - DNA, 25 bp, Mus musculus
tcagaaagattacacgcagagtggc

SEQ ID NO: 967046 - DNA, 25 bp, Mus musculus
tcagaaagattacaggcagagtggc

SEQ ID NO: 967047 - DNA, 25 bp, Mus musculus
tcagaaagcacacatggacagctcc

SEQ ID NO: 967048 - DNA, 25 bp, Mus musculus
tcagaaagcacagatggacagctcc

SEQ ID NO: 967049 - DNA, 25 bp, Mus musculus
tcagaaatcgcacaaagccacaggt

SEQ ID NO: 967050 - DNA, 25 bp, Mus musculus
tcagaaatcgcagaaagccacaggt

SEQ ID NO: 967051 - DNA, 25 bp, Mus musculus
tcagaacaaatgctgaaagagatca

SEQ ID NO: 967052 - DNA, 25 bp, Mus musculus
tcagaacaaatggtgaaagagatca

SEQ ID NO: 967053 - DNA, 25 bp, Mus musculus
tcagaacattcacgtatttgatttc

SEQ ID NO: 967054 - DNA, 25 bp, Mus musculus
tcagaacattcaggtatttgatttc

SEQ ID NO: 967055 - DNA, 25 bp, Mus musculus
tcagaacgttagcactatcctgtta

SEQ ID NO: 967056 - DNA, 25 bp, Mus musculus
tcagaacgttaggactatcctgtta

SEQ ID NO: 967057 - DNA, 25 bp, Mus musculus
tcagaactacaaacgctgtttggag

SEQ ID NO: 967058 - DNA, 25 bp, Mus musculus
tcagaactacaatcgctgtttggag

SEQ ID NO: 967059 - DNA, 25 bp, Mus musculus
tcagaactatgacgtagcctacccg

SEQ ID NO: 967060 - DNA, 25 bp, Mus musculus
tcagaactatgaggtagcctacccg

SEQ ID NO: 967061 - DNA, 25 bp, Mus musculus
tcagaactgagacgttatgggccag

SEQ ID NO: 967062 - DNA, 25 bp, Mus musculus
tcagaactgagaggttatgggccag

SEQ ID NO: 967063 - DNA, 25 bp, Mus musculus
tcagaagaaaagatgatggagtttc

SEQ ID NO: 967064 - DNA, 25 bp, Mus musculus
tcagaagaaaagttgatggagtttc

SEQ ID NO: 967065 - DNA, 25 bp, Mus musculus
tcagaagaaagccgtcaagaatttc

SEQ ID NO: 967066 - DNA, 25 bp, Mus musculus
tcagaagaaagcggtcaagaatttc

SEQ ID NO: 967067 - DNA, 25 bp, Mus musculus
tcagaagcagaagccccaccaccaa

SEQ ID NO: 967068 - DNA, 25 bp, Mus musculus
tcagaagcagaagcgccaccaccaa

SEQ ID NO: 967069 - DNA, 25 bp, Mus musculus
tcagaagcagcagctatctggaggg

SEQ ID NO: 967070 - DNA, 25 bp, Mus musculus
tcagaagcaggagctatctggaggg

SEQ ID NO: 967071 - DNA, 25 bp, Mus musculus
tcagaagcatctccatcgcctggtt

SEQ ID NO: 967072 - DNA, 25 bp, Mus musculus
tcagaagcatgtccatcgcctggtt

SEQ ID NO: 967073 - DNA, 25 bp, Mus musculus
tcagaaggactgcaactgcctgcat

SEQ ID NO: 967074 - DNA, 25 bp, Mus musculus
tcagaaggactggaactgcctgcat

SEQ ID NO: 967075 - DNA, 25 bp, Mus musculus
tcagaaggtgcccttcccaggacag

SEQ ID NO: 967076 - DNA, 25 bp, Mus musculus
tcagaaggtggccttcccaggacag

SEQ ID NO: 967077 - DNA, 25 bp, Mus musculus
tcagaagttaagcaaacatattcaa

SEQ ID NO: 967078 - DNA, 25 bp, Mus musculus
tcagaagttaaggaaacatattcaa

SEQ ID NO: 967079 - DNA, 25 bp, Mus musculus
tcagaatcaaaacgtggcagatgag

SEQ ID NO: 967080 - DNA, 25 bp, Mus musculus
tcagaatcaaaaggtggcagatgag

SEQ ID NO: 967081 - DNA, 25 bp, Mus musculus
tcagaatctatgcgtgaggaagatc

SEQ ID NO: 967082 - DNA, 25 bp, Mus musculus
tcagaatctatgggtgaggaagatc

SEQ ID NO: 967083 - DNA, 25 bp, Mus musculus
tcagaatgaaaacgaaagtgctttg

SEQ ID NO: 967084 - DNA, 25 bp, Mus musculus
tcagaatgaaaaggaaagtgctttg

SEQ ID NO: 967085 - DNA, 25 bp, Mus musculus
tcagacaatgatgaaggcactgagg

SEQ ID NO: 967086 - DNA, 25 bp, Mus musculus
tcagacaatgttgaaggcactgagg

SEQ ID NO: 967087 - DNA, 25 bp, Mus musculus
tcagacagctctagctgtttccaaa

SEQ ID NO: 967088 - DNA, 25 bp, Mus musculus
tcagacagctcttgctgtttccaaa

SEQ ID NO: 967089 - DNA, 25 bp, Mus musculus
tcagacagtaagcttgtggagaatt

SEQ ID NO: 967090 - DNA, 25 bp, Mus musculus
tcagacagtaaggttgtggagaatt

SEQ ID NO: 967091 - DNA, 25 bp, Mus musculus
tcagacatagacctgaagaagctgg

SEQ ID NO: 967092 - DNA, 25 bp, Mus musculus
tcagacatagtcctgaagaagctgg

SEQ ID NO: 967093 - DNA, 25 bp, Mus musculus
tcagacatgacacgagggcttcgtt

SEQ ID NO: 967094 - DNA, 25 bp, Mus musculus
tcagacatgacaggagggcttcgtt

SEQ ID NO: 967095 - DNA, 25 bp, Mus musculus
tcagaccaagcccaccttcttgaag

SEQ ID NO: 967096 - DNA, 25 bp, Mus musculus
tcagaccaaggccaccttcttgaag

SEQ ID NO: 967097 - DNA, 25 bp, Mus musculus
tcagaccagcagaacgagatggtgc

SEQ ID NO: 967098 - DNA, 25 bp, Mus musculus
tcagaccagcagtacgagatggtgc

SEQ ID NO: 967099 - DNA, 25 bp, Mus musculus
tcagaccaggcaccgagtactaaca

SEQ ID NO: 967100 - DNA, 25 bp, Mus musculus
tcagaccaggcagcgagtactaaca

SEQ ID NO: 967101 - DNA, 25 bp, Mus musculus
tcagaccagtgacccacagggttct

SEQ ID NO: 967102 - DNA, 25 bp, Mus musculus
tcagaccagtgagccacagggttct

SEQ ID NO: 967103 - DNA, 25 bp, Mus musculus
tcagacccagcctcttgccatcagt

SEQ ID NO: 967104 - DNA, 25 bp, Mus musculus
tcagacccaggctcttgccatcagt

SEQ ID NO: 967105 - DNA, 25 bp, Mus musculus
tcagacccttgaacagaggaacggg

SEQ ID NO: 967106 - DNA, 25 bp, Mus musculus
tcagacccttgaactgaggaacggg

SEQ ID NO: 967107 - DNA, 25 bp, Mus musculus
tcagacctcaggagtttagcatgag

SEQ ID NO: 967108 - DNA, 25 bp, Mus musculus
tcagacctcaggtgtttagcatgag

SEQ ID NO: 967109 - DNA, 25 bp, Mus musculus
tcagacctctcctgagatgggggtt

SEQ ID NO: 967110 - DNA, 25 bp, Mus musculus
tcagacctctgctgagatgggggtt

SEQ ID NO: 967111 - DNA, 25 bp, Mus musculus
tcagactcagcgttgagctccataa

SEQ ID NO: 967112 - DNA, 25 bp, Mus musculus
tcagactcagggttgagctccataa

SEQ ID NO: 967113 - DNA, 25 bp, Mus musculus
tcagactgggcccagtcttctggga

SEQ ID NO: 967114 - DNA, 25 bp, Mus musculus
tcagactggggccagtcttctggga

SEQ ID NO: 967115 - DNA, 25 bp, Mus musculus
tcagacttccagctgaatctaaaca

SEQ ID NO: 967116 - DNA, 25 bp, Mus musculus
tcagacttccaggtgaatctaaaca

SEQ ID NO: 967117 - DNA, 25 bp, Mus musculus
tcagacttctaacgcctctcctgca

SEQ ID NO: 967118 - DNA, 25 bp, Mus musculus
tcagacttctaaggcctctcctgca

SEQ ID NO: 967119 - DNA, 25 bp, Mus musculus
tcagagaaaaaccgctcttgcttct

SEQ ID NO: 967120 - DNA, 25 bp, Mus musculus
tcagagaaaaacggctcttgcttct

SEQ ID NO: 967121 - DNA, 25 bp, Mus musculus
tcagagaaaccaaacactgtgatgc

SEQ ID NO: 967122 - DNA, 25 bp, Mus musculus
tcagagaaaccaaagactgtgatgc

SEQ ID NO: 967123 - DNA, 25 bp, Mus musculus
tcagagaaagctggaagctcccttc

SEQ ID NO: 967124 - DNA, 25 bp, Mus musculus
tcagagaaaggtggaagctcccttc

SEQ ID NO: 967125 - DNA, 25 bp, Mus musculus
tcagagacaaatttggggatgctgt

SEQ ID NO: 967126 - DNA, 25 bp, Mus musculus
tcagagacaattttggggatgctgt

SEQ ID NO: 967127 - DNA, 25 bp, Mus musculus
tcagagacagcaaacctatttcata

SEQ ID NO: 967128 - DNA, 25 bp, Mus musculus
tcagagacagccctcaggatatcat

SEQ ID NO: 967129 - DNA, 25 bp, Mus musculus
tcagagacaggaaacctatttcata

SEQ ID NO: 967130 - DNA, 25 bp, Mus musculus
tcagagacaggcctcaggatatcat

SEQ ID NO: 967131 - DNA, 25 bp, Mus musculus
tcagagacccaactgcataagtaaa

SEQ ID NO: 967132 - DNA, 25 bp, Mus musculus
tcagagacccaagtgcataagtaaa

SEQ ID NO: 967133 - DNA, 25 bp, Mus musculus
tcagagaccgcaatctcactggtct

SEQ ID NO: 967134 - DNA, 25 bp, Mus musculus
tcagagaccgcaatgtgtatgtcga

SEQ ID NO: 967135 - DNA, 25 bp, Mus musculus
tcagagaccgcattctcactggtct

SEQ ID NO: 967136 - DNA, 25 bp, Mus musculus
tcagagaccgcattgtgtatgtcga

SEQ ID NO: 967137 - DNA, 25 bp, Mus musculus
tcagagactcagcattgaaaagatg

SEQ ID NO: 967138 - DNA, 25 bp, Mus musculus
tcagagactcaggattgaaaagatg

SEQ ID NO: 967139 - DNA, 25 bp, Mus musculus
tcagagactccagaccatggttttt

SEQ ID NO: 967140 - DNA, 25 bp, Mus musculus
tcagagactccagacggtttttgga

SEQ ID NO: 967141 - DNA, 25 bp, Mus musculus
tcagagactccagagcatggttttt

SEQ ID NO: 967142 - DNA, 25 bp, Mus musculus
tcagagactccagagggtttttgga

SEQ ID NO: 967143 - DNA, 25 bp, Mus musculus
tcagagagacatcttctctgtcacc

SEQ ID NO: 967144 - DNA, 25 bp, Mus musculus
tcagagagacttcttctctgtcacc

SEQ ID NO: 967145 - DNA, 25 bp, Mus musculus
tcagagagagactttctgcaggtac

SEQ ID NO: 967146 - DNA, 25 bp, Mus musculus
tcagagagagctaccgacccttgac

SEQ ID NO: 967147 - DNA, 25 bp, Mus musculus
tcagagagaggtaccgacccttgac

SEQ ID NO: 967148 - DNA, 25 bp, Mus musculus
tcagagagagtctttctgcaggtac

SEQ ID NO: 967149 - DNA, 25 bp, Mus musculus
tcagagagcggacgtctccggccaa

SEQ ID NO: 967150 - DNA, 25 bp, Mus musculus
tcagagagcggaggtctccggccaa

SEQ ID NO: 967151 - DNA, 25 bp, Mus musculus
tcagagaggacaaccatgtcattga

SEQ ID NO: 967152 - DNA, 25 bp, Mus musculus
tcagagaggacaacgatgtcattga

SEQ ID NO: 967153 - DNA, 25 bp, Mus musculus
tcagagaggtggaacaccatgtctg

SEQ ID NO: 967154 - DNA, 25 bp, Mus musculus
tcagagaggtggaagaccatgtctg

SEQ ID NO: 967155 - DNA, 25 bp, Mus musculus
tcagagatgacacgtttgtggtggc

SEQ ID NO: 967156 - DNA, 25 bp, Mus musculus
tcagagatgacaggtttgtggtggc

SEQ ID NO: 967157 - DNA, 25 bp, Mus musculus
tcagagcaaaggcgggctctactac

SEQ ID NO: 967158 - DNA, 25 bp, Mus musculus
tcagagcaaaggggggctctactac

SEQ ID NO: 967159 - DNA, 25 bp, Mus musculus
tcagagcaagaggtggatatagagg

SEQ ID NO: 967160 - DNA, 25 bp, Mus musculus
tcagagcaagtggtggatatagagg

SEQ ID NO: 967161 - DNA, 25 bp, Mus musculus
tcagagcagtgaccagtgggagaca

SEQ ID NO: 967162 - DNA, 25 bp, Mus musculus
tcagagcagtgacgataccgctatt

SEQ ID NO: 967163 - DNA, 25 bp, Mus musculus
tcagagcagtgagcagtgggagaca

SEQ ID NO: 967164 - DNA, 25 bp, Mus musculus
tcagagcagtgaggataccgctatt

SEQ ID NO: 967165 - DNA, 25 bp, Mus musculus
tcagagcgagaggagattgaagtgg

SEQ ID NO: 967166 - DNA, 25 bp, Mus musculus
tcagagcgagtggagattgaagtgg

SEQ ID NO: 967167 - DNA, 25 bp, Mus musculus
tcagagcgatgtctggtccttcggg

SEQ ID NO: 967168 - DNA, 25 bp, Mus musculus
tcagagcgatgtgtggtccttcggg

SEQ ID NO: 967169 - DNA, 25 bp, Mus musculus
tcagagcgtctcatcatggagagaa

SEQ ID NO: 967170 - DNA, 25 bp, Mus musculus
tcagagcgtctcatgatggagagaa

SEQ ID NO: 967171 - DNA, 25 bp, Mus musculus
tcagagctctttcatgacttgggtg

SEQ ID NO: 967172 - DNA, 25 bp, Mus musculus
tcagagctctttgatgacttgggtg

SEQ ID NO: 967173 - DNA, 25 bp, Mus musculus
tcagagctgaagccagcaagcctgc

SEQ ID NO: 967174 - DNA, 25 bp, Mus musculus
tcagagctgaagcctattctagact

SEQ ID NO: 967175 - DNA, 25 bp, Mus musculus
tcagagctgaaggcagcaagcctgc

SEQ ID NO: 967176 - DNA, 25 bp, Mus musculus
tcagagctgaaggctattctagact

SEQ ID NO: 967177 - DNA, 25 bp, Mus musculus
tcagagctggacaccgctgtccagg

SEQ ID NO: 967178 - DNA, 25 bp, Mus musculus
tcagagctggacacggctgtccagg

SEQ ID NO: 967179 - DNA, 25 bp, Mus musculus
tcagagctggagcacaggagataat

SEQ ID NO: 967180 - DNA, 25 bp, Mus musculus
tcagagctggagcacaggagatcat

SEQ ID NO: 967181 - DNA, 25 bp, Mus musculus
tcagagctggagcagaggagataat

SEQ ID NO: 967182 - DNA, 25 bp, Mus musculus
tcagagctggagcagaggagatcat

SEQ ID NO: 967183 - DNA, 25 bp, Mus musculus
tcagaggaaaatatgacatgcaccg

SEQ ID NO: 967184 - DNA, 25 bp, Mus musculus
tcagaggaaattatgacatgcaccg

SEQ ID NO: 967185 - DNA, 25 bp, Mus musculus
tcagaggaatggcgtactcagttcg

SEQ ID NO: 967186 - DNA, 25 bp, Mus musculus
tcagaggaatggggtactcagttcg

SEQ ID NO: 967187 - DNA, 25 bp, Mus musculus
tcagaggccaagcatgctggggctg

SEQ ID NO: 967188 - DNA, 25 bp, Mus musculus
tcagaggccaaggatgctggggctg

SEQ ID NO: 967189 - DNA, 25 bp, Mus musculus
tcagaggctgagaaaataatgttga

SEQ ID NO: 967190 - DNA, 25 bp, Mus musculus
tcagaggctgagcacaaatgagaag

SEQ ID NO: 967191 - DNA, 25 bp, Mus musculus
tcagaggctgaggacaaatgagaag

SEQ ID NO: 967192 - DNA, 25 bp, Mus musculus
tcagaggctgagtaaataatgttga

SEQ ID NO: 967193 - DNA, 25 bp, Mus musculus
tcagagtatgagaaaataaaggact

SEQ ID NO: 967194 - DNA, 25 bp, Mus musculus
tcagagtatgagaggctgttatgtt

SEQ ID NO: 967195 - DNA, 25 bp, Mus musculus
tcagagtatgagattctcctcatct

SEQ ID NO: 967196 - DNA, 25 bp, Mus musculus
tcagagtatgagcaagaagattcca

SEQ ID NO: 967197 - DNA, 25 bp, Mus musculus
tcagagtatgaggaagaagattcca

SEQ ID NO: 967198 - DNA, 25 bp, Mus musculus
tcagagtatgagtaaataaaggact

SEQ ID NO: 967199 - DNA, 25 bp, Mus musculus
tcagagtatgagtggctgttatgtt

SEQ ID NO: 967200 - DNA, 25 bp, Mus musculus
tcagagtatgagtttctcctcatct

SEQ ID NO: 967201 - DNA, 25 bp, Mus musculus
tcagagtctgcacaaccagtgtgca

SEQ ID NO: 967202 - DNA, 25 bp, Mus musculus
tcagagtctgcagaaccagtgtgca

SEQ ID NO: 967203 - DNA, 25 bp, Mus musculus
tcagagtgagatcatcatccaagtc

SEQ ID NO: 967204 - DNA, 25 bp, Mus musculus
tcagagtgagatgatcatccaagtc

SEQ ID NO: 967205 - DNA, 25 bp, Mus musculus
tcagagtgtgagcccggcgtgtctg

SEQ ID NO: 967206 - DNA, 25 bp, Mus musculus
tcagagtgtgaggccggcgtgtctg

SEQ ID NO: 967207 - DNA, 25 bp, Mus musculus
tcagagttcaagctgatggtgaaca

SEQ ID NO: 967208 - DNA, 25 bp, Mus musculus
tcagagttcaaggtgatggtgaaca

SEQ ID NO: 967209 - DNA, 25 bp, Mus musculus
tcagagttctcacggagctgacaat

SEQ ID NO: 967210 - DNA, 25 bp, Mus musculus
tcagagttctcagggagctgacaat

SEQ ID NO: 967211 - DNA, 25 bp, Mus musculus
tcagataaaaaccggaatccactca

SEQ ID NO: 967212 - DNA, 25 bp, Mus musculus
tcagataaaaacgggaatccactca

SEQ ID NO: 967213 - DNA, 25 bp, Mus musculus
tcagataatcagaccaaacctctga

SEQ ID NO: 967214 - DNA, 25 bp, Mus musculus
tcagataatcagtccaaacctctga

SEQ ID NO: 967215 - DNA, 25 bp, Mus musculus
tcagatactgatgatgctggagggt

SEQ ID NO: 967216 - DNA, 25 bp, Mus musculus
tcagatactgttgatgctggagggt

SEQ ID NO: 967217 - DNA, 25 bp, Mus musculus
tcagatcacacctcagggatttaga

SEQ ID NO: 967218 - DNA, 25 bp, Mus musculus
tcagatcacagctcagggatttaga

SEQ ID NO: 967219 - DNA, 25 bp, Mus musculus
tcagatcatccaaacgtgcagctag

SEQ ID NO: 967220 - DNA, 25 bp, Mus musculus
tcagatcatccaaaggtgcagctag

SEQ ID NO: 967221 - DNA, 25 bp, Mus musculus
tcagatccaaatcgtaactcacctc

SEQ ID NO: 967222 - DNA, 25 bp, Mus musculus
tcagatccaaatggtaactcacctc

SEQ ID NO: 967223 - DNA, 25 bp, Mus musculus
tcagatccagcatgctcggaaggcc

SEQ ID NO: 967224 - DNA, 25 bp, Mus musculus
tcagatccaggatgctcggaaggcc

SEQ ID NO: 967225 - DNA, 25 bp, Mus musculus
tcagatcctcagcaagaacctgaac

SEQ ID NO: 967226 - DNA, 25 bp, Mus musculus
tcagatcctcaggaagaacctgaac

SEQ ID NO: 967227 - DNA, 25 bp, Mus musculus
tcagatctgtctatgtggtactgga

SEQ ID NO: 967228 - DNA, 25 bp, Mus musculus
tcagatctgtgtatgtggtactgga

SEQ ID NO: 967229 - DNA, 25 bp, Mus musculus
tcagatcttgcttacatggcaggtt

SEQ ID NO: 967230 - DNA, 25 bp, Mus musculus
tcagatcttgcttagatggcaggtt

SEQ ID NO: 967231 - DNA, 25 bp, Mus musculus
tcagatgagcctcgcacagctgctt

SEQ ID NO: 967232 - DNA, 25 bp, Mus musculus
tcagatgagcctggcacagctgctt

SEQ ID NO: 967233 - DNA, 25 bp, Mus musculus
tcagatgagttcaacgccttgctgt

SEQ ID NO: 967234 - DNA, 25 bp, Mus musculus
tcagatgagttcaacgtggtggtcg

SEQ ID NO: 967235 - DNA, 25 bp, Mus musculus
tcagatgagttcaaggccttgctgt

SEQ ID NO: 967236 - DNA, 25 bp, Mus musculus
tcagatgagttcaaggtggtggtcg

SEQ ID NO: 967237 - DNA, 25 bp, Mus musculus
tcagatgcagcttgcgttacagtaa

SEQ ID NO: 967238 - DNA, 25 bp, Mus musculus
tcagatgcaggttgcgttacagtaa

SEQ ID NO: 967239 - DNA, 25 bp, Mus musculus
tcagatgcccagcaccccttgggga

SEQ ID NO: 967240 - DNA, 25 bp, Mus musculus
tcagatgcccaggaccccttgggga

SEQ ID NO: 967241 - DNA, 25 bp, Mus musculus
tcagatggcaaaccaacaggaacaa

SEQ ID NO: 967242 - DNA, 25 bp, Mus musculus
tcagatggcaaagcaacaggaacaa

SEQ ID NO: 967243 - DNA, 25 bp, Mus musculus
tcagatgtggagatcacttggactg

SEQ ID NO: 967244 - DNA, 25 bp, Mus musculus
tcagatgtggagatcgagtatacaa

SEQ ID NO: 967245 - DNA, 25 bp, Mus musculus
tcagatgtggagatgacttggactg

SEQ ID NO: 967246 - DNA, 25 bp, Mus musculus
tcagatgtggagatggagtatacaa

SEQ ID NO: 967247 - DNA, 25 bp, Mus musculus
tcagattcgagccaaattctttgca

SEQ ID NO: 967248 - DNA, 25 bp, Mus musculus
tcagattcgagcgaaattctttgca

SEQ ID NO: 967249 - DNA, 25 bp, Mus musculus
tcagattgattccctgtctacaaaa

SEQ ID NO: 967250 - DNA, 25 bp, Mus musculus
tcagattgattcgctgtctacaaaa

SEQ ID NO: 967251 - DNA, 25 bp, Mus musculus
tcagatttggcacacagcaggccag

SEQ ID NO: 967252 - DNA, 25 bp, Mus musculus
tcagatttgggacacagcaggccag

SEQ ID NO: 967253 - DNA, 25 bp, Mus musculus
tcagcaaaagcaggaacacctctgt

SEQ ID NO: 967254 - DNA, 25 bp, Mus musculus
tcagcaaaaggaggaacacctctgt

SEQ ID NO: 967255 - DNA, 25 bp, Mus musculus
tcagcaaataatgacgtccagacct

SEQ ID NO: 967256 - DNA, 25 bp, Mus musculus
tcagcaaataatgaggtccagacct

SEQ ID NO: 967257 - DNA, 25 bp, Mus musculus
tcagcaaatccagacgatctctctc

SEQ ID NO: 967258 - DNA, 25 bp, Mus musculus
tcagcaaatccagacgtgaaaatcc

SEQ ID NO: 967259 - DNA, 25 bp, Mus musculus
tcagcaaatccagaggatctctctc

SEQ ID NO: 967260 - DNA, 25 bp, Mus musculus
tcagcaaatccagaggtgaaaatcc

SEQ ID NO: 967261 - DNA, 25 bp, Mus musculus
tcagcaaatgaggtaaacagctgga

SEQ ID NO: 967262 - DNA, 25 bp, Mus musculus
tcagcaaatgtggtaaacagctgga

SEQ ID NO: 967263 - DNA, 25 bp, Mus musculus
tcagcaacctccaaccctgaagggc

SEQ ID NO: 967264 - DNA, 25 bp, Mus musculus
tcagcaacctccaagcctgaagggc

SEQ ID NO: 967265 - DNA, 25 bp, Mus musculus
tcagcaactgctcaatttttcagaa

SEQ ID NO: 967266 - DNA, 25 bp, Mus musculus
tcagcaactggtcaatttttcagaa

SEQ ID NO: 967267 - DNA, 25 bp, Mus musculus
tcagcaacttgtcacatgtttctgt

SEQ ID NO: 967268 - DNA, 25 bp, Mus musculus
tcagcaacttgtcagatgtttctgt

SEQ ID NO: 967269 - DNA, 25 bp, Mus musculus
tcagcaagatccttcgttctcgctg

SEQ ID NO: 967270 - DNA, 25 bp, Mus musculus
tcagcaagatccttggttctcgctg

SEQ ID NO: 967271 - DNA, 25 bp, Mus musculus
tcagcacaccagaactatgccgagt

SEQ ID NO: 967272 - DNA, 25 bp, Mus musculus
tcagcacaccagtactatgccgagt

SEQ ID NO: 967273 - DNA, 25 bp, Mus musculus
tcagcacactgacatatgcagatcg

SEQ ID NO: 967274 - DNA, 25 bp, Mus musculus
tcagcacactgagatatgcagatcg

SEQ ID NO: 967275 - DNA, 25 bp, Mus musculus
tcagcacattcaagtccatacaagg

SEQ ID NO: 967276 - DNA, 25 bp, Mus musculus
tcagcacattcatgtccatacaagg

SEQ ID NO: 967277 - DNA, 25 bp, Mus musculus
tcagcaccagatccctgctgtctga

SEQ ID NO: 967278 - DNA, 25 bp, Mus musculus
tcagcaccagttccctgctgtctga

SEQ ID NO: 967279 - DNA, 25 bp, Mus musculus
tcagcacgaatgctgcagtctttgt

SEQ ID NO: 967280 - DNA, 25 bp, Mus musculus
tcagcacgaatggtgcagtctttgt

SEQ ID NO: 967281 - DNA, 25 bp, Mus musculus
tcagcacgacagagggcgtccctca

SEQ ID NO: 967282 - DNA, 25 bp, Mus musculus
tcagcacgacagtgggcgtccctca

SEQ ID NO: 967283 - DNA, 25 bp, Mus musculus
tcagcacgcccacttatggatgctg

SEQ ID NO: 967284 - DNA, 25 bp, Mus musculus
tcagcacgcccagttatggatgctg

SEQ ID NO: 967285 - DNA, 25 bp, Mus musculus
tcagcacttttcctatgatcgctgc

SEQ ID NO: 967286 - DNA, 25 bp, Mus musculus
tcagcacttttcctttgatcgctgc

SEQ ID NO: 967287 - DNA, 25 bp, Mus musculus
tcagcagaaatgaacctctgattgc

SEQ ID NO: 967288 - DNA, 25 bp, Mus musculus
tcagcagaaatgaagctctgattgc

SEQ ID NO: 967289 - DNA, 25 bp, Mus musculus
tcagcagaagaaaacaagaaacaag

SEQ ID NO: 967290 - DNA, 25 bp, Mus musculus
tcagcagaagaaaagaagaaacaag

SEQ ID NO: 967291 - DNA, 25 bp, Mus musculus
tcagcagaagcttccagatgaagaa

SEQ ID NO: 967292 - DNA, 25 bp, Mus musculus
tcagcagaaggttccagatgaagaa

SEQ ID NO: 967293 - DNA, 25 bp, Mus musculus
tcagcagatattagaaagtgaaaaa

SEQ ID NO: 967294 - DNA, 25 bp, Mus musculus
tcagcagatatttgaaagtgaaaaa

SEQ ID NO: 967295 - DNA, 25 bp, Mus musculus
tcagcagatgatcctctaggcaccg

SEQ ID NO: 967296 - DNA, 25 bp, Mus musculus
tcagcagatgttcctctaggcaccg

SEQ ID NO: 967297 - DNA, 25 bp, Mus musculus
tcagcagccaggcccacatcaaact

SEQ ID NO: 967298 - DNA, 25 bp, Mus musculus
tcagcagccagggccacatcaaact

SEQ ID NO: 967299 - DNA, 25 bp, Mus musculus
tcagcagcgagtcactaccatctgc

SEQ ID NO: 967300 - DNA, 25 bp, Mus musculus
tcagcagcgagtcagtaccatctgc

SEQ ID NO: 967301 - DNA, 25 bp, Mus musculus
tcagcagctgagtcagctgtggtcc

SEQ ID NO: 967302 - DNA, 25 bp, Mus musculus
tcagcagctggacgaccttattaat

SEQ ID NO: 967303 - DNA, 25 bp, Mus musculus
tcagcagctggaggaccttattaat

SEQ ID NO: 967304 - DNA, 25 bp, Mus musculus
tcagcagctgtgtcagctgtggtcc

SEQ ID NO: 967305 - DNA, 25 bp, Mus musculus
tcagcaggacgtcgtgacagagtta

SEQ ID NO: 967306 - DNA, 25 bp, Mus musculus
tcagcaggacgtggtgacagagtta

SEQ ID NO: 967307 - DNA, 25 bp, Mus musculus
tcagcaggatggaacagaagctgaa

SEQ ID NO: 967308 - DNA, 25 bp, Mus musculus
tcagcaggatggaagagaagctgaa

SEQ ID NO: 967309 - DNA, 25 bp, Mus musculus
tcagcaggccaactctacaatggct

SEQ ID NO: 967310 - DNA, 25 bp, Mus musculus
tcagcaggccaagtctacaatggct

SEQ ID NO: 967311 - DNA, 25 bp, Mus musculus
tcagcaggtaataagtgaaatggtt

SEQ ID NO: 967312 - DNA, 25 bp, Mus musculus
tcagcaggtaattagtgaaatggtt

SEQ ID NO: 967313 - DNA, 25 bp, Mus musculus
tcagcagtaccgatcgtaccagatg

SEQ ID NO: 967314 - DNA, 25 bp, Mus musculus
tcagcagtaccgatggtaccagatg

SEQ ID NO: 967315 - DNA, 25 bp, Mus musculus
tcagcagtggctttgatgacattga

SEQ ID NO: 967316 - DNA, 25 bp, Mus musculus
tcagcagtgggtttgatgacattga

SEQ ID NO: 967317 - DNA, 25 bp, Mus musculus
tcagcatacaagcgagactctggag

SEQ ID NO: 967318 - DNA, 25 bp, Mus musculus
tcagcatacaagggagactctggag

SEQ ID NO: 967319 - DNA, 25 bp, Mus musculus
tcagcatagcagagtaagtcacaga

SEQ ID NO: 967320 - DNA, 25 bp, Mus musculus
tcagcatagcagtgtaagtcacaga

SEQ ID NO: 967321 - DNA, 25 bp, Mus musculus
tcagcatctatcaacggagcaccat

SEQ ID NO: 967322 - DNA, 25 bp, Mus musculus
tcagcatctatcaagggagcaccat

SEQ ID NO: 967323 - DNA, 25 bp, Mus musculus
tcagcatgaaaccatatgaacttcc

SEQ ID NO: 967324 - DNA, 25 bp, Mus musculus
tcagcatgaaacgatatgaacttcc

SEQ ID NO: 967325 - DNA, 25 bp, Mus musculus
tcagcatgcaggcgagccctggagg

SEQ ID NO: 967326 - DNA, 25 bp, Mus musculus
tcagcatgcaggggagccctggagg

SEQ ID NO: 967327 - DNA, 25 bp, Mus musculus
tcagcatgctaataaccacttttat

SEQ ID NO: 967328 - DNA, 25 bp, Mus musculus
tcagcatgcttataaccacttttat

SEQ ID NO: 967329 - DNA, 25 bp, Mus musculus
tcagcatgtccacagggatggacaa

SEQ ID NO: 967330 - DNA, 25 bp, Mus musculus
tcagcatgtccagagggatggacaa

SEQ ID NO: 967331 - DNA, 25 bp, Mus musculus
tcagcattgtcctcatcgttctcat

SEQ ID NO: 967332 - DNA, 25 bp, Mus musculus
tcagcattgtgctcatcgttctcat

SEQ ID NO: 967333 - DNA, 25 bp, Mus musculus
tcagcatttcgcaacggtcatgtaa

SEQ ID NO: 967334 - DNA, 25 bp, Mus musculus
tcagcatttcgcaagggtcatgtaa

SEQ ID NO: 967335 - DNA, 25 bp, Mus musculus
tcagcattttctggcgaatgaattc

SEQ ID NO: 967336 - DNA, 25 bp, Mus musculus
tcagcattttctggggaatgaattc

SEQ ID NO: 967337 - DNA, 25 bp, Mus musculus
tcagccaaatagaggatgccatgag

SEQ ID NO: 967338 - DNA, 25 bp, Mus musculus
tcagccaaatcgtgttgtgtgaagg

SEQ ID NO: 967339 - DNA, 25 bp, Mus musculus
tcagccaaatctctttctgtaactc

SEQ ID NO: 967340 - DNA, 25 bp, Mus musculus
tcagccaaatggtgttgtgtgaagg

SEQ ID NO: 967341 - DNA, 25 bp, Mus musculus
tcagccaaatgtctttctgtaactc

SEQ ID NO: 967342 - DNA, 25 bp, Mus musculus
tcagccaaattgaggatgccatgag

SEQ ID NO: 967343 - DNA, 25 bp, Mus musculus
tcagccaaccagacatgccatgtcg

SEQ ID NO: 967344 - DNA, 25 bp, Mus musculus
tcagccaaccagacttgccatgtcg

SEQ ID NO: 967345 - DNA, 25 bp, Mus musculus
tcagccaagaacaataccattgtga

SEQ ID NO: 967346 - DNA, 25 bp, Mus musculus
tcagccaagaactataccattgtga

SEQ ID NO: 967347 - DNA, 25 bp, Mus musculus
tcagccaatgctgacagcaactgtg

SEQ ID NO: 967348 - DNA, 25 bp, Mus musculus
tcagccaatgctgacgatgcccaag

SEQ ID NO: 967349 - DNA, 25 bp, Mus musculus
tcagccaatgctgagagcaactgtg

SEQ ID NO: 967350 - DNA, 25 bp, Mus musculus
tcagccaatgctgaggatgcccaag

SEQ ID NO: 967351 - DNA, 25 bp, Mus musculus
tcagccacagagcccgttcccatat

SEQ ID NO: 967352 - DNA, 25 bp, Mus musculus
tcagccacagaggccgttcccatat

SEQ ID NO: 967353 - DNA, 25 bp, Mus musculus
tcagccacctggacctattccaccg

SEQ ID NO: 967354 - DNA, 25 bp, Mus musculus
tcagccacctggacgtattccaccg

SEQ ID NO: 967355 - DNA, 25 bp, Mus musculus
tcagccacttactacaatttctgaa

SEQ ID NO: 967356 - DNA, 25 bp, Mus musculus
tcagccacttactagaatttctgaa

SEQ ID NO: 967357 - DNA, 25 bp, Mus musculus
tcagccagaagcaacgagttcacag

SEQ ID NO: 967358 - DNA, 25 bp, Mus musculus
tcagccagaagcaaggagttcacag

SEQ ID NO: 967359 - DNA, 25 bp, Mus musculus
tcagccaggacgagctgacagtcca

SEQ ID NO: 967360 - DNA, 25 bp, Mus musculus
tcagccaggacgtgctgacagtcca

SEQ ID NO: 967361 - DNA, 25 bp, Mus musculus
tcagccagggaggacattttacatc

SEQ ID NO: 967362 - DNA, 25 bp, Mus musculus
tcagccagggaggagattttacatc

SEQ ID NO: 967363 - DNA, 25 bp, Mus musculus
tcagccagtgaacaggaagttagaa

SEQ ID NO: 967364 - DNA, 25 bp, Mus musculus
tcagccagtgaagaggaagttagaa

SEQ ID NO: 967365 - DNA, 25 bp, Mus musculus
tcagccagtgcctgcagaccctgag

SEQ ID NO: 967366 - DNA, 25 bp, Mus musculus
tcagccagtggctgcagaccctgag

SEQ ID NO: 967367 - DNA, 25 bp, Mus musculus
tcagccagtttgctaagaccctaag

SEQ ID NO: 967368 - DNA, 25 bp, Mus musculus
tcagccagtttggtaagaccctaag

SEQ ID NO: 967369 - DNA, 25 bp, Mus musculus
tcagccccagctcgtgcccccttat

SEQ ID NO: 967370 - DNA, 25 bp, Mus musculus
tcagccccagctggtgcccccttat

SEQ ID NO: 967371 - DNA, 25 bp, Mus musculus
tcagcccctgcctgccaccatggcc

SEQ ID NO: 967372 - DNA, 25 bp, Mus musculus
tcagcccctggctgccaccatggcc

SEQ ID NO: 967373 - DNA, 25 bp, Mus musculus
tcagcccggcagcatgatgcccgga

SEQ ID NO: 967374 - DNA, 25 bp, Mus musculus
tcagcccggcaggatgatgcccgga

SEQ ID NO: 967375 - DNA, 25 bp, Mus musculus
tcagccctcacacgcacccggtcct

SEQ ID NO: 967376 - DNA, 25 bp, Mus musculus
tcagccctcacaggcacccggtcct

SEQ ID NO: 967377 - DNA, 25 bp, Mus musculus
tcagccctcatcaatgaggaactct

SEQ ID NO: 967378 - DNA, 25 bp, Mus musculus
tcagccctcatctatgaggaactct

SEQ ID NO: 967379 - DNA, 25 bp, Mus musculus
tcagccctcccacttatgcccgccg

SEQ ID NO: 967380 - DNA, 25 bp, Mus musculus
tcagccctcccagttatgcccgccg

SEQ ID NO: 967381 - DNA, 25 bp, Mus musculus
tcagccctctaatggaccaattagc

SEQ ID NO: 967382 - DNA, 25 bp, Mus musculus
tcagccctcttatggaccaattagc

SEQ ID NO: 967383 - DNA, 25 bp, Mus musculus
tcagccgcaagtttcgggaggcgat

SEQ ID NO: 967384 - DNA, 25 bp, Mus musculus
tcagccgcaagtttggggaggcgat

SEQ ID NO: 967385 - DNA, 25 bp, Mus musculus
tcagccgcagcctggaggagaacac

SEQ ID NO: 967386 - DNA, 25 bp, Mus musculus
tcagccgcaggctggaggagaacac

SEQ ID NO: 967387 - DNA, 25 bp, Mus musculus
tcagccgcatcgctctgaagaaaga

SEQ ID NO: 967388 - DNA, 25 bp, Mus musculus
tcagccgcatcggtctgaagaaaga

SEQ ID NO: 967389 - DNA, 25 bp, Mus musculus
tcagcctaaagccggaccagtccaa

SEQ ID NO: 967390 - DNA, 25 bp, Mus musculus
tcagcctaaagcgggaccagtccaa

SEQ ID NO: 967391 - DNA, 25 bp, Mus musculus
tcagcctacgatttcttttgatgga

SEQ ID NO: 967392 - DNA, 25 bp, Mus musculus
tcagcctacgttttcttttgatgga

SEQ ID NO: 967393 - DNA, 25 bp, Mus musculus
tcagcctagcagccccagcaacaca

SEQ ID NO: 967394 - DNA, 25 bp, Mus musculus
tcagcctagcaggcccagcaacaca

SEQ ID NO: 967395 - DNA, 25 bp, Mus musculus
tcagcctatctgcctctcaggctga

SEQ ID NO: 967396 - DNA, 25 bp, Mus musculus
tcagcctatctggctctcaggctga

SEQ ID NO: 967397 - DNA, 25 bp, Mus musculus
tcagcctcctgaatcgacagtcacc

SEQ ID NO: 967398 - DNA, 25 bp, Mus musculus
tcagcctcctgaatggacagtcacc

SEQ ID NO: 967399 - DNA, 25 bp, Mus musculus
tcagcctctcgaagcgaaacagcat

SEQ ID NO: 967400 - DNA, 25 bp, Mus musculus
tcagcctctcgaagggaaacagcat

SEQ ID NO: 967401 - DNA, 25 bp, Mus musculus
tcagcctggaagacctgccaggcct

SEQ ID NO: 967402 - DNA, 25 bp, Mus musculus
tcagcctggatgacctgccaggcct

SEQ ID NO: 967403 - DNA, 25 bp, Mus musculus
tcagccttatgccctggttccacgg

SEQ ID NO: 967404 - DNA, 25 bp, Mus musculus
tcagccttatgcgctggttccacgg

SEQ ID NO: 967405 - DNA, 25 bp, Mus musculus
tcagccttcagcaacatgaggatgt

SEQ ID NO: 967406 - DNA, 25 bp, Mus musculus
tcagccttcagcaagatgaggatgt

SEQ ID NO: 967407 - DNA, 25 bp, Mus musculus
tcagcgaaaccacgtccacaggatg

SEQ ID NO: 967408 - DNA, 25 bp, Mus musculus
tcagcgaaaccaggtccacaggatg

SEQ ID NO: 967409 - DNA, 25 bp, Mus musculus
tcagcgacagattccggtattcaga

SEQ ID NO: 967410 - DNA, 25 bp, Mus musculus
tcagcgacagtttccggtattcaga

SEQ ID NO: 967411 - DNA, 25 bp, Mus musculus
tcagcgagcccgcgctgttgataat

SEQ ID NO: 967412 - DNA, 25 bp, Mus musculus
tcagcgagcccgggctgttgataat

SEQ ID NO: 967413 - DNA, 25 bp, Mus musculus
tcagcgaggaagatgaggacgatgt

SEQ ID NO: 967414 - DNA, 25 bp, Mus musculus
tcagcgaggaagttgaggacgatgt

SEQ ID NO: 967415 - DNA, 25 bp, Mus musculus
tcagcgaggctggacgcaccatgag

SEQ ID NO: 967416 - DNA, 25 bp, Mus musculus
tcagcgaggctggaggcaccatgag

SEQ ID NO: 967417 - DNA, 25 bp, Mus musculus
tcagcgcaaactcggcaaacgctac

SEQ ID NO: 967418 - DNA, 25 bp, Mus musculus
tcagcgcaaactgggcaaacgctac

SEQ ID NO: 967419 - DNA, 25 bp, Mus musculus
tcagcgccgccgctggagagatgtc

SEQ ID NO: 967420 - DNA, 25 bp, Mus musculus
tcagcgccgccggtggagagatgtc

SEQ ID NO: 967421 - DNA, 25 bp, Mus musculus
tcagcgccgcctctccgcttcccgc

SEQ ID NO: 967422 - DNA, 25 bp, Mus musculus
tcagcgccgcctgtccgcttcccgc

SEQ ID NO: 967423 - DNA, 25 bp, Mus musculus
tcagcgcgtgaacctctccagtcct

SEQ ID NO: 967424 - DNA, 25 bp, Mus musculus
tcagcgcgtgaagctctccagtcct

SEQ ID NO: 967425 - DNA, 25 bp, Mus musculus
tcagcgctcacgatcttgagagtcg

SEQ ID NO: 967426 - DNA, 25 bp, Mus musculus
tcagcgctcacgttcttgagagtcg

SEQ ID NO: 967427 - DNA, 25 bp, Mus musculus
tcagcgctgacacgtacagagctat

SEQ ID NO: 967428 - DNA, 25 bp, Mus musculus
tcagcgctgacaggtacagagctat

SEQ ID NO: 967429 - DNA, 25 bp, Mus musculus
tcagcggtaatagtcgtgctttagc

SEQ ID NO: 967430 - DNA, 25 bp, Mus musculus
tcagcggtaatagtggtgctttagc

SEQ ID NO: 967431 - DNA, 25 bp, Mus musculus
tcagcgtggcagcttctatcagcct

SEQ ID NO: 967432 - DNA, 25 bp, Mus musculus
tcagcgtggcaggttctatcagcct

SEQ ID NO: 967433 - DNA, 25 bp, Mus musculus
tcagcgtgtctcatactacaaggaa

SEQ ID NO: 967434 - DNA, 25 bp, Mus musculus
tcagcgtgtctcttactacaaggaa

SEQ ID NO: 967435 - DNA, 25 bp, Mus musculus
tcagctaaagaaaagtggagaccat

SEQ ID NO: 967436 - DNA, 25 bp, Mus musculus
tcagctaaagaatagtggagaccat

SEQ ID NO: 967437 - DNA, 25 bp, Mus musculus
tcagctacatgacggcagtggattt

SEQ ID NO: 967438 - DNA, 25 bp, Mus musculus
tcagctacatgagggcagtggattt

SEQ ID NO: 967439 - DNA, 25 bp, Mus musculus
tcagctacctaactcgccccaccaa

SEQ ID NO: 967440 - DNA, 25 bp, Mus musculus
tcagctacctaactggccccaccaa

SEQ ID NO: 967441 - DNA, 25 bp, Mus musculus
tcagctaccttctgatactgtttgc

SEQ ID NO: 967442 - DNA, 25 bp, Mus musculus
tcagctaccttctgttactgtttgc

SEQ ID NO: 967443 - DNA, 25 bp, Mus musculus
tcagctcaagcctgtcaagtcctct

SEQ ID NO: 967444 - DNA, 25 bp, Mus musculus
tcagctcaagcgcaaatgactcagc

SEQ ID NO: 967445 - DNA, 25 bp, Mus musculus
tcagctcaaggctgtcaagtcctct

SEQ ID NO: 967446 - DNA, 25 bp, Mus musculus
tcagctcaagggcaaatgactcagc

SEQ ID NO: 967447 - DNA, 25 bp, Mus musculus
tcagctcagcatcaaagccgggctg

SEQ ID NO: 967448 - DNA, 25 bp, Mus musculus
tcagctcagcatgaaagccgggctg

SEQ ID NO: 967449 - DNA, 25 bp, Mus musculus
tcagctcagcctggaagacctgcca

SEQ ID NO: 967450 - DNA, 25 bp, Mus musculus
tcagctcagcctggtagacctgcca

SEQ ID NO: 967451 - DNA, 25 bp, Mus musculus
tcagctcatccacatgagctgggcc

SEQ ID NO: 967452 - DNA, 25 bp, Mus musculus
tcagctcatccagatgagctgggcc

SEQ ID NO: 967453 - DNA, 25 bp, Mus musculus
tcagctcctacaccacccgtttgtt

SEQ ID NO: 967454 - DNA, 25 bp, Mus musculus
tcagctcctacagcacccgtttgtt

SEQ ID NO: 967455 - DNA, 25 bp, Mus musculus
tcagctcctgcaccaaattagccgt

SEQ ID NO: 967456 - DNA, 25 bp, Mus musculus
tcagctcctgcagcaaattagccgt

SEQ ID NO: 967457 - DNA, 25 bp, Mus musculus
tcagctcggaggacaggtcaatggc

SEQ ID NO: 967458 - DNA, 25 bp, Mus musculus
tcagctcggaggtcaggtcaatggc

SEQ ID NO: 967459 - DNA, 25 bp, Mus musculus
tcagctctctccccatgactgactt

SEQ ID NO: 967460 - DNA, 25 bp, Mus musculus
tcagctctctccccttgactgactt

SEQ ID NO: 967461 - DNA, 25 bp, Mus musculus
tcagctctgagacgatgtgcccgat

SEQ ID NO: 967462 - DNA, 25 bp, Mus musculus
tcagctctgagaggatgtgcccgat

SEQ ID NO: 967463 - DNA, 25 bp, Mus musculus
tcagctgcagctggccaagacgaag

SEQ ID NO: 967464 - DNA, 25 bp, Mus musculus
tcagctgcaggtggccaagacgaag

SEQ ID NO: 967465 - DNA, 25 bp, Mus musculus
tcagctgctgagcacgttcaatttt

SEQ ID NO: 967466 - DNA, 25 bp, Mus musculus
tcagctgctgagcaggttcaatttt

SEQ ID NO: 967467 - DNA, 25 bp, Mus musculus
tcagctggacagcttaccagaagtg

SEQ ID NO: 967468 - DNA, 25 bp, Mus musculus
tcagctggacaggttaccagaagtg

SEQ ID NO: 967469 - DNA, 25 bp, Mus musculus
tcagctggttctgcagacaaaatgg

SEQ ID NO: 967470 - DNA, 25 bp, Mus musculus
tcagctggttctgcagtcaaaatgg

SEQ ID NO: 967471 - DNA, 25 bp, Mus musculus
tcagctggttgtgcagacaaaatgg

SEQ ID NO: 967472 - DNA, 25 bp, Mus musculus
tcagctggttgtgcagtcaaaatgg

SEQ ID NO: 967473 - DNA, 25 bp, Mus musculus
tcagctgtaatgctgcgtctaatgc

SEQ ID NO: 967474 - DNA, 25 bp, Mus musculus
tcagctgtaatggtgcgtctaatgc

SEQ ID NO: 967475 - DNA, 25 bp, Mus musculus
tcagctgtaccacggaacggagaag

SEQ ID NO: 967476 - DNA, 25 bp, Mus musculus
tcagctgtaccagggaacggagaag

SEQ ID NO: 967477 - DNA, 25 bp, Mus musculus
tcagcttattgtcacgtctgtgaga

SEQ ID NO: 967478 - DNA, 25 bp, Mus musculus
tcagcttattgtcaggtctgtgaga

SEQ ID NO: 967479 - DNA, 25 bp, Mus musculus
tcagcttcaaatcagtaccacactt

SEQ ID NO: 967480 - DNA, 25 bp, Mus musculus
tcagcttcaacgtttggattcagga

SEQ ID NO: 967481 - DNA, 25 bp, Mus musculus
tcagcttcaaggtttggattcagga

SEQ ID NO: 967482 - DNA, 25 bp, Mus musculus
tcagcttcaattcagtaccacactt

SEQ ID NO: 967483 - DNA, 25 bp, Mus musculus
tcagcttcagcaatgcactggaagg

SEQ ID NO: 967484 - DNA, 25 bp, Mus musculus
tcagcttcaggaatgcactggaagg

SEQ ID NO: 967485 - DNA, 25 bp, Mus musculus
tcagcttccacacaaactcaagtca

SEQ ID NO: 967486 - DNA, 25 bp, Mus musculus
tcagcttccacacaccatgccttaa

SEQ ID NO: 967487 - DNA, 25 bp, Mus musculus
tcagcttccacacgtttcctttgga

SEQ ID NO: 967488 - DNA, 25 bp, Mus musculus
tcagcttccacagaaactcaagtca

SEQ ID NO: 967489 - DNA, 25 bp, Mus musculus
tcagcttccacagaccatgccttaa

SEQ ID NO: 967490 - DNA, 25 bp, Mus musculus
tcagcttccacaggtttcctttgga

SEQ ID NO: 967491 - DNA, 25 bp, Mus musculus
tcagcttcccagacatttcagcctg

SEQ ID NO: 967492 - DNA, 25 bp, Mus musculus
tcagcttcccagtcatttcagcctg

SEQ ID NO: 967493 - DNA, 25 bp, Mus musculus
tcaggaaaagcttggatgtcgatat

SEQ ID NO: 967494 - DNA, 25 bp, Mus musculus
tcaggaaaaggttggatgtcgatat

SEQ ID NO: 967495 - DNA, 25 bp, Mus musculus
tcaggaaaatagcttggaacttagc

SEQ ID NO: 967496 - DNA, 25 bp, Mus musculus
tcaggaaaataggttggaacttagc

SEQ ID NO: 967497 - DNA, 25 bp, Mus musculus
tcaggaaagatgaccagaaagagaa

SEQ ID NO: 967498 - DNA, 25 bp, Mus musculus
tcaggaaagatgtccagaaagagaa

SEQ ID NO: 967499 - DNA, 25 bp, Mus musculus
tcaggaaccagaaacgacagtctgg

SEQ ID NO: 967500 - DNA, 25 bp, Mus musculus
tcaggaaccagaaaggacagtctgg

SEQ ID NO: 967501 - DNA, 25 bp, Mus musculus
tcaggaagatcaagccaaagaactc

SEQ ID NO: 967502 - DNA, 25 bp, Mus musculus
tcaggaagatcaagccaaagaatgc

SEQ ID NO: 967503 - DNA, 25 bp, Mus musculus
tcaggaagatcatgccaaagaactc

SEQ ID NO: 967504 - DNA, 25 bp, Mus musculus
tcaggaagatcatgccaaagaatgc

SEQ ID NO: 967505 - DNA, 25 bp, Mus musculus
tcaggaagcccacaaaatccaatca

SEQ ID NO: 967506 - DNA, 25 bp, Mus musculus
tcaggaagcccagaaaatccaatca

SEQ ID NO: 967507 - DNA, 25 bp, Mus musculus
tcaggaaggcctcacgaagaagatg

SEQ ID NO: 967508 - DNA, 25 bp, Mus musculus
tcaggaaggcctcaggaagaagatg

SEQ ID NO: 967509 - DNA, 25 bp, Mus musculus
tcaggaatggaacgcaaacagttct

SEQ ID NO: 967510 - DNA, 25 bp, Mus musculus
tcaggaatggaaggcaaacagttct

SEQ ID NO: 967511 - DNA, 25 bp, Mus musculus
tcaggacacacacacactgtcctgt

SEQ ID NO: 967512 - DNA, 25 bp, Mus musculus
tcaggacacacagacactgtcctgt

SEQ ID NO: 967513 - DNA, 25 bp, Mus musculus
tcaggacacagacgcaccaggtaac

SEQ ID NO: 967514 - DNA, 25 bp, Mus musculus
tcaggacacagaggcaccaggtaac

SEQ ID NO: 967515 - DNA, 25 bp, Mus musculus
tcaggaccaactatgagacagagct

SEQ ID NO: 967516 - DNA, 25 bp, Mus musculus
tcaggaccaactatgagtcagagct

SEQ ID NO: 967517 - DNA, 25 bp, Mus musculus
tcaggaccaagtatgagacagagct

SEQ ID NO: 967518 - DNA, 25 bp, Mus musculus
tcaggaccaagtatgagtcagagct

SEQ ID NO: 967519 - DNA, 25 bp, Mus musculus
tcaggaccagctagattccataatg

SEQ ID NO: 967520 - DNA, 25 bp, Mus musculus
tcaggaccaggtagattccataatg

SEQ ID NO: 967521 - DNA, 25 bp, Mus musculus
tcaggaccccagcaccttgccacac

SEQ ID NO: 967522 - DNA, 25 bp, Mus musculus
tcaggaccccagctctgtcagcatc

SEQ ID NO: 967523 - DNA, 25 bp, Mus musculus
tcaggaccccaggaccttgccacac

SEQ ID NO: 967524 - DNA, 25 bp, Mus musculus
tcaggaccccaggtctgtcagcatc

SEQ ID NO: 967525 - DNA, 25 bp, Mus musculus
tcaggactctcaggtaaatgcattg

SEQ ID NO: 967526 - DNA, 25 bp, Mus musculus
tcaggactctgaggtaaatgcattg

SEQ ID NO: 967527 - DNA, 25 bp, Mus musculus
tcaggactgacacaacaactaatgc

SEQ ID NO: 967528 - DNA, 25 bp, Mus musculus
tcaggactgacagaacaactaatgc

SEQ ID NO: 967529 - DNA, 25 bp, Mus musculus
tcaggactgaggcagaaggatgaca

SEQ ID NO: 967530 - DNA, 25 bp, Mus musculus
tcaggactgagggagaaggatgaca

SEQ ID NO: 967531 - DNA, 25 bp, Mus musculus
tcaggagaacagatggcctcctact

SEQ ID NO: 967532 - DNA, 25 bp, Mus musculus
tcaggagaacagttggcctcctact

SEQ ID NO: 967533 - DNA, 25 bp, Mus musculus
tcaggagaatgtcgacatcagcagc

SEQ ID NO: 967534 - DNA, 25 bp, Mus musculus
tcaggagaatgtggacatcagcagc

SEQ ID NO: 967535 - DNA, 25 bp, Mus musculus
tcaggagagccacgcttagaatcag

SEQ ID NO: 967536 - DNA, 25 bp, Mus musculus
tcaggagagccaggcttagaatcag

SEQ ID NO: 967537 - DNA, 25 bp, Mus musculus
tcaggagattctgacaccttgctac

SEQ ID NO: 967538 - DNA, 25 bp, Mus musculus
tcaggagattctgacgcgaatggac

SEQ ID NO: 967539 - DNA, 25 bp, Mus musculus
tcaggagattctgagaccttgctac

SEQ ID NO: 967540 - DNA, 25 bp, Mus musculus
tcaggagattctgaggcgaatggac

SEQ ID NO: 967541 - DNA, 25 bp, Mus musculus
tcaggagcagattgccagggcaaca

SEQ ID NO: 967542 - DNA, 25 bp, Mus musculus
tcaggagcagcgcgtttattgccta

SEQ ID NO: 967543 - DNA, 25 bp, Mus musculus
tcaggagcagcgggtttattgccta

SEQ ID NO: 967544 - DNA, 25 bp, Mus musculus
tcaggagcagtttgccagggcaaca

SEQ ID NO: 967545 - DNA, 25 bp, Mus musculus
tcaggagcgaaactgacaccagcag

SEQ ID NO: 967546 - DNA, 25 bp, Mus musculus
tcaggagcgaaagtgacaccagcag

SEQ ID NO: 967547 - DNA, 25 bp, Mus musculus
tcaggagcgcagaacgctgagaccg

SEQ ID NO: 967548 - DNA, 25 bp, Mus musculus
tcaggagcgcagaaggctgagaccg

SEQ ID NO: 967549 - DNA, 25 bp, Mus musculus
tcaggagcggcactctcagagagaa

SEQ ID NO: 967550 - DNA, 25 bp, Mus musculus
tcaggagcggcagtctcagagagaa

SEQ ID NO: 967551 - DNA, 25 bp, Mus musculus
tcaggagctcaacgagctggactac

SEQ ID NO: 967552 - DNA, 25 bp, Mus musculus
tcaggagctcaaggagctggactac

SEQ ID NO: 967553 - DNA, 25 bp, Mus musculus
tcaggagctggagacaaaaatatca

SEQ ID NO: 967554 - DNA, 25 bp, Mus musculus
tcaggagctggagacgaaagccata

SEQ ID NO: 967555 - DNA, 25 bp, Mus musculus
tcaggagctggagagaaaaatatca

SEQ ID NO: 967556 - DNA, 25 bp, Mus musculus
tcaggagctggagaggaaagccata

SEQ ID NO: 967557 - DNA, 25 bp, Mus musculus
tcaggaggagctttgaaaagcgaat

SEQ ID NO: 967558 - DNA, 25 bp, Mus musculus
tcaggaggaggtttgaaaagcgaat

SEQ ID NO: 967559 - DNA, 25 bp, Mus musculus
tcaggatccccacgctgcccttggg

SEQ ID NO: 967560 - DNA, 25 bp, Mus musculus
tcaggatccccaggctgcccttggg

SEQ ID NO: 967561 - DNA, 25 bp, Mus musculus
tcaggatgacagccccttcttcctg

SEQ ID NO: 967562 - DNA, 25 bp, Mus musculus
tcaggatgacaggcccttcttcctg

SEQ ID NO: 967563 - DNA, 25 bp, Mus musculus
tcaggatggccactcgtggggcctg

SEQ ID NO: 967564 - DNA, 25 bp, Mus musculus
tcaggatggccagtcgtggggcctg

SEQ ID NO: 967565 - DNA, 25 bp, Mus musculus
tcaggatgtcgacgtacggtcagaa

SEQ ID NO: 967566 - DNA, 25 bp, Mus musculus
tcaggatgtcgaggtacggtcagaa

SEQ ID NO: 967567 - DNA, 25 bp, Mus musculus
tcaggatgtgatcgtgccctacttt

SEQ ID NO: 967568 - DNA, 25 bp, Mus musculus
tcaggatgtgatggtgccctacttt

SEQ ID NO: 967569 - DNA, 25 bp, Mus musculus
tcaggatgttgacgtgtctcaaaag

SEQ ID NO: 967570 - DNA, 25 bp, Mus musculus
tcaggatgttgaggtgtctcaaaag

SEQ ID NO: 967571 - DNA, 25 bp, Mus musculus
tcaggattggaacatcgaagcctgt

SEQ ID NO: 967572 - DNA, 25 bp, Mus musculus
tcaggattggaagatcgaagcctgt

SEQ ID NO: 967573 - DNA, 25 bp, Mus musculus
tcaggatttggactctgtctccaag

SEQ ID NO: 967574 - DNA, 25 bp, Mus musculus
tcaggatttggagtctgtctccaag

SEQ ID NO: 967575 - DNA, 25 bp, Mus musculus
tcaggcagatctaccgttgttctca

SEQ ID NO: 967576 - DNA, 25 bp, Mus musculus
tcaggcagatctacggttgttctca

SEQ ID NO: 967577 - DNA, 25 bp, Mus musculus
tcaggcatcaatgcagttttctact

SEQ ID NO: 967578 - DNA, 25 bp, Mus musculus
tcaggcatcaatgctgttttctact

SEQ ID NO: 967579 - DNA, 25 bp, Mus musculus
tcaggccaagacatgcccggaaccg

SEQ ID NO: 967580 - DNA, 25 bp, Mus musculus
tcaggccaagacttgcccggaaccg

SEQ ID NO: 967581 - DNA, 25 bp, Mus musculus
tcaggccaggcaccgagaacacgcc

SEQ ID NO: 967582 - DNA, 25 bp, Mus musculus
tcaggccagggaccgagaacacgcc

SEQ ID NO: 967583 - DNA, 25 bp, Mus musculus
tcaggccatgctccagagaaatctc

SEQ ID NO: 967584 - DNA, 25 bp, Mus musculus
tcaggccatggtccagagaaatctc

SEQ ID NO: 967585 - DNA, 25 bp, Mus musculus
tcaggccgtcagaaatgtttcacaa

SEQ ID NO: 967586 - DNA, 25 bp, Mus musculus
tcaggccgtcagtaatgtttcacaa

SEQ ID NO: 967587 - DNA, 25 bp, Mus musculus
tcaggcctttcacagacgaagagag

SEQ ID NO: 967588 - DNA, 25 bp, Mus musculus
tcaggcctttcagagacgaagagag

SEQ ID NO: 967589 - DNA, 25 bp, Mus musculus
tcaggcggagaactactctcaaaaa

SEQ ID NO: 967590 - DNA, 25 bp, Mus musculus
tcaggcggagaagtactctcaaaaa

SEQ ID NO: 967591 - DNA, 25 bp, Mus musculus
tcaggcgggatacgtctggagcctg

SEQ ID NO: 967592 - DNA, 25 bp, Mus musculus
tcaggcgggataggtctggagcctg

SEQ ID NO: 967593 - DNA, 25 bp, Mus musculus
tcaggctcaactatgagaatgagct

SEQ ID NO: 967594 - DNA, 25 bp, Mus musculus
tcaggctcaagtatgagaatgagct

SEQ ID NO: 967595 - DNA, 25 bp, Mus musculus
tcaggctgagaactactctcagaag

SEQ ID NO: 967596 - DNA, 25 bp, Mus musculus
tcaggctgagaagtactctcagaag

SEQ ID NO: 967597 - DNA, 25 bp, Mus musculus
tcaggctgtgagatatctgtttcaa

SEQ ID NO: 967598 - DNA, 25 bp, Mus musculus
tcaggctgtgagttatctgtttcaa

SEQ ID NO: 967599 - DNA, 25 bp, Mus musculus
tcaggctttccccacgccctccatg

SEQ ID NO: 967600 - DNA, 25 bp, Mus musculus
tcaggctttccccaggccctccatg

SEQ ID NO: 967601 - DNA, 25 bp, Mus musculus
tcagggaaagcacgttcgacttcat

SEQ ID NO: 967602 - DNA, 25 bp, Mus musculus
tcagggaaagcaggttcgacttcat

SEQ ID NO: 967603 - DNA, 25 bp, Mus musculus
tcagggaacaagcccaggactgtgg

SEQ ID NO: 967604 - DNA, 25 bp, Mus musculus
tcagggaacaaggccaggactgtgg

SEQ ID NO: 967605 - DNA, 25 bp, Mus musculus
tcagggaatagtctctgctgcgtac

SEQ ID NO: 967606 - DNA, 25 bp, Mus musculus
tcagggaatagtctgtgctgcgtac

SEQ ID NO: 967607 - DNA, 25 bp, Mus musculus
tcagggaatggactatttgcatgca

SEQ ID NO: 967608 - DNA, 25 bp, Mus musculus
tcagggaatggagtatttgcatgca

SEQ ID NO: 967609 - DNA, 25 bp, Mus musculus
tcagggacttcacctttgaaggaca

SEQ ID NO: 967610 - DNA, 25 bp, Mus musculus
tcagggacttcagctttgaaggaca

SEQ ID NO: 967611 - DNA, 25 bp, Mus musculus
tcagggacttcaggcctttgaagga

SEQ ID NO: 967612 - DNA, 25 bp, Mus musculus
tcagggacttcagggctttgaagga

SEQ ID NO: 967613 - DNA, 25 bp, Mus musculus
tcagggagaaagagcctggcccaac

SEQ ID NO: 967614 - DNA, 25 bp, Mus musculus
tcagggagaaagtgcctggcccaac

SEQ ID NO: 967615 - DNA, 25 bp, Mus musculus
tcagggagtgctggccgcacagcca

SEQ ID NO: 967616 - DNA, 25 bp, Mus musculus
tcagggagtggtggccgcacagcca

SEQ ID NO: 967617 - DNA, 25 bp, Mus musculus
tcagggccgcaacgtcctggagctc

SEQ ID NO: 967618 - DNA, 25 bp, Mus musculus
tcagggccgcaaggtcctggagctc

SEQ ID NO: 967619 - DNA, 25 bp, Mus musculus
tcagggcctttgctcgggacagtaa

SEQ ID NO: 967620 - DNA, 25 bp, Mus musculus
tcagggcctttgctggggacagtaa

SEQ ID NO: 967621 - DNA, 25 bp, Mus musculus
tcagggcgagctgactgtgatgaga

SEQ ID NO: 967622 - DNA, 25 bp, Mus musculus
tcagggcgaggtgactgtgatgaga

SEQ ID NO: 967623 - DNA, 25 bp, Mus musculus
tcagggctcaagcaggtagatgact

SEQ ID NO: 967624 - DNA, 25 bp, Mus musculus
tcagggctcaaggaggtagatgact

SEQ ID NO: 967625 - DNA, 25 bp, Mus musculus
tcagggctgttgagcttccagagaa

SEQ ID NO: 967626 - DNA, 25 bp, Mus musculus
tcagggctgttgtgcttccagagaa

SEQ ID NO: 967627 - DNA, 25 bp, Mus musculus
tcaggggaagacaatcctagtacag

SEQ ID NO: 967628 - DNA, 25 bp, Mus musculus
tcaggggaagactatcctagtacag

SEQ ID NO: 967629 - DNA, 25 bp, Mus musculus
tcaggggaccagcaaatcacccctg

SEQ ID NO: 967630 - DNA, 25 bp, Mus musculus
tcaggggaccaggaaatcacccctg

SEQ ID NO: 967631 - DNA, 25 bp, Mus musculus
tcaggggattgaatatgagaagatc

SEQ ID NO: 967632 - DNA, 25 bp, Mus musculus
tcaggggattgattatgagaagatc

SEQ ID NO: 967633 - DNA, 25 bp, Mus musculus
tcagggggacaagacgttgcctgca

SEQ ID NO: 967634 - DNA, 25 bp, Mus musculus
tcagggggacaagaggttgcctgca

SEQ ID NO: 967635 - DNA, 25 bp, Mus musculus
tcagggggacacacaagcaaaatat

SEQ ID NO: 967636 - DNA, 25 bp, Mus musculus
tcagggggacacactagcaaaatat

SEQ ID NO: 967637 - DNA, 25 bp, Mus musculus
tcagggggtaaaagtgattagtgtt

SEQ ID NO: 967638 - DNA, 25 bp, Mus musculus
tcagggggtaaatgtgattagtgtt

SEQ ID NO: 967639 - DNA, 25 bp, Mus musculus
tcaggggttcagatgccccatatag

SEQ ID NO: 967640 - DNA, 25 bp, Mus musculus
tcaggggttcagccaacaattctct

SEQ ID NO: 967641 - DNA, 25 bp, Mus musculus
tcaggggttcaggcaacaattctct

SEQ ID NO: 967642 - DNA, 25 bp, Mus musculus
tcaggggttcagttgccccatatag

SEQ ID NO: 967643 - DNA, 25 bp, Mus musculus
tcagggtcagaacggtgagcgaggt

SEQ ID NO: 967644 - DNA, 25 bp, Mus musculus
tcagggtcagaagggtgagcgaggt

SEQ ID NO: 967645 - DNA, 25 bp, Mus musculus
tcagggtcccagaacggtcagaaag

SEQ ID NO: 967646 - DNA, 25 bp, Mus musculus
tcagggtcccagaagggtcagaaag

SEQ ID NO: 967647 - DNA, 25 bp, Mus musculus
tcaggtcaacaacgttggacttttc

SEQ ID NO: 967648 - DNA, 25 bp, Mus musculus
tcaggtcaacaaggttggacttttc

SEQ ID NO: 967649 - DNA, 25 bp, Mus musculus
tcaggtcaccagcatgggattttgc

SEQ ID NO: 967650 - DNA, 25 bp, Mus musculus
tcaggtcaccagcgaggccatcagt

SEQ ID NO: 967651 - DNA, 25 bp, Mus musculus
tcaggtcaccaggatgggattttgc

SEQ ID NO: 967652 - DNA, 25 bp, Mus musculus
tcaggtcaccagggaggccatcagt

SEQ ID NO: 967653 - DNA, 25 bp, Mus musculus
tcaggtccagcgcaatggcagcaga

SEQ ID NO: 967654 - DNA, 25 bp, Mus musculus
tcaggtccagggcaatggcagcaga

SEQ ID NO: 967655 - DNA, 25 bp, Mus musculus
tcaggtgagcagcatcggaacgtca

SEQ ID NO: 967656 - DNA, 25 bp, Mus musculus
tcaggtgagcaggatcggaacgtca

SEQ ID NO: 967657 - DNA, 25 bp, Mus musculus
tcaggtgaggcctttaccctccggt

SEQ ID NO: 967658 - DNA, 25 bp, Mus musculus
tcaggtgagggctttaccctccggt

SEQ ID NO: 967659 - DNA, 25 bp, Mus musculus
tcaggtgcaaaatggaacactgtgg

SEQ ID NO: 967660 - DNA, 25 bp, Mus musculus
tcaggtgcaactgcagaatggaaca

SEQ ID NO: 967661 - DNA, 25 bp, Mus musculus
tcaggtgcaagtgcagaatggaaca

SEQ ID NO: 967662 - DNA, 25 bp, Mus musculus
tcaggtgcaatatggaacactgtgg

SEQ ID NO: 967663 - DNA, 25 bp, Mus musculus
tcaggttcagagcagtcggattgta

SEQ ID NO: 967664 - DNA, 25 bp, Mus musculus
tcaggttcagaggagtcggattgta

SEQ ID NO: 967665 - DNA, 25 bp, Mus musculus
tcaggttttgcctaccggctctctg

SEQ ID NO: 967666 - DNA, 25 bp, Mus musculus
tcaggttttggctaccggctctctg

SEQ ID NO: 967667 - DNA, 25 bp, Mus musculus
tcagtaaaatgaaacaaacagcgca

SEQ ID NO: 967668 - DNA, 25 bp, Mus musculus
tcagtaaaatgaaagaaacagcgca

SEQ ID NO: 967669 - DNA, 25 bp, Mus musculus
tcagtacaacattgtcggcttgcgc

SEQ ID NO: 967670 - DNA, 25 bp, Mus musculus
tcagtacaactttgtcggcttgcgc

SEQ ID NO: 967671 - DNA, 25 bp, Mus musculus
tcagtacctacatcgacagctgaaa

SEQ ID NO: 967672 - DNA, 25 bp, Mus musculus
tcagtacctaccgtgctgtgcggaa

SEQ ID NO: 967673 - DNA, 25 bp, Mus musculus
tcagtacctagatcgacagctgaaa

SEQ ID NO: 967674 - DNA, 25 bp, Mus musculus
tcagtacctagcgtgctgtgcggaa

SEQ ID NO: 967675 - DNA, 25 bp, Mus musculus
tcagtacctcacagactccaaattt

SEQ ID NO: 967676 - DNA, 25 bp, Mus musculus
tcagtacctcactgactccaaattt

SEQ ID NO: 967677 - DNA, 25 bp, Mus musculus
tcagtacttttgggcgagctgaaga

SEQ ID NO: 967678 - DNA, 25 bp, Mus musculus
tcagtacttttgggggagctgaaga

SEQ ID NO: 967679 - DNA, 25 bp, Mus musculus
tcagtagcttcacacggtgcctggt

SEQ ID NO: 967680 - DNA, 25 bp, Mus musculus
tcagtagcttcacagggtgcctggt

SEQ ID NO: 967681 - DNA, 25 bp, Mus musculus
tcagtatacaataacgtgtcatcct

SEQ ID NO: 967682 - DNA, 25 bp, Mus musculus
tcagtatacaataaggtgtcatcct

SEQ ID NO: 967683 - DNA, 25 bp, Mus musculus
tcagtatacatgcgagactctggag

SEQ ID NO: 967684 - DNA, 25 bp, Mus musculus
tcagtatacatgggagactctggag

SEQ ID NO: 967685 - DNA, 25 bp, Mus musculus
tcagtatcagagctaatatcggggt

SEQ ID NO: 967686 - DNA, 25 bp, Mus musculus
tcagtatcagaggtaatatcggggt

SEQ ID NO: 967687 - DNA, 25 bp, Mus musculus
tcagtatccaggacaacagctttat

SEQ ID NO: 967688 - DNA, 25 bp, Mus musculus
tcagtatccaggtcaacagctttat

SEQ ID NO: 967689 - DNA, 25 bp, Mus musculus
tcagtatccatgattgccagtagaa

SEQ ID NO: 967690 - DNA, 25 bp, Mus musculus
tcagtatccatgtttgccagtagaa

SEQ ID NO: 967691 - DNA, 25 bp, Mus musculus
tcagtatgaaagatacaggtctttc

SEQ ID NO: 967692 - DNA, 25 bp, Mus musculus
tcagtatgaaagttacaggtctttc

SEQ ID NO: 967693 - DNA, 25 bp, Mus musculus
tcagtatgttcacgcatatcctcct

SEQ ID NO: 967694 - DNA, 25 bp, Mus musculus
tcagtatgttcaggcatatcctcct

SEQ ID NO: 967695 - DNA, 25 bp, Mus musculus
tcagtcacatccatcgaaagaaagg

SEQ ID NO: 967696 - DNA, 25 bp, Mus musculus
tcagtcacatccatcgtcctattaa

SEQ ID NO: 967697 - DNA, 25 bp, Mus musculus
tcagtcacatccatggaaagaaagg

SEQ ID NO: 967698 - DNA, 25 bp, Mus musculus
tcagtcacatccatggtcctattaa

SEQ ID NO: 967699 - DNA, 25 bp, Mus musculus
tcagtcacccagcggaccttggaga

SEQ ID NO: 967700 - DNA, 25 bp, Mus musculus
tcagtcacccaggggaccttggaga

SEQ ID NO: 967701 - DNA, 25 bp, Mus musculus
tcagtcagatcatgactcaggcacg

SEQ ID NO: 967702 - DNA, 25 bp, Mus musculus
tcagtcagatgatgactcaggcacg

SEQ ID NO: 967703 - DNA, 25 bp, Mus musculus
tcagtcctggcccccaagttgaagt

SEQ ID NO: 967704 - DNA, 25 bp, Mus musculus
tcagtcctggccgccaagttgaagt

SEQ ID NO: 967705 - DNA, 25 bp, Mus musculus
tcagtcctggcctgggccgtcggaa

SEQ ID NO: 967706 - DNA, 25 bp, Mus musculus
tcagtcctgggctgggccgtcggaa

SEQ ID NO: 967707 - DNA, 25 bp, Mus musculus
tcagtctaacctcactgtcactgca

SEQ ID NO: 967708 - DNA, 25 bp, Mus musculus
tcagtctaacctcagtgtcactgca

SEQ ID NO: 967709 - DNA, 25 bp, Mus musculus
tcagtctcagcatcctcatgtgtac

SEQ ID NO: 967710 - DNA, 25 bp, Mus musculus
tcagtctcaggatcctcatgtgtac

SEQ ID NO: 967711 - DNA, 25 bp, Mus musculus
tcagtgaaaaccagcttgtttctgg

SEQ ID NO: 967712 - DNA, 25 bp, Mus musculus
tcagtgaaaacctgcttgtttctgg

SEQ ID NO: 967713 - DNA, 25 bp, Mus musculus
tcagtgaacctgcaagttgcttgta

SEQ ID NO: 967714 - DNA, 25 bp, Mus musculus
tcagtgaacctgcatgttgcttgta

SEQ ID NO: 967715 - DNA, 25 bp, Mus musculus
tcagtgagcgaatggctgcagtctg

SEQ ID NO: 967716 - DNA, 25 bp, Mus musculus
tcagtgagcgtatggctgcagtctg

SEQ ID NO: 967717 - DNA, 25 bp, Mus musculus
tcagtgagtcggcacggctctgagt

SEQ ID NO: 967718 - DNA, 25 bp, Mus musculus
tcagtgagtcggcacttgaaagtgg

SEQ ID NO: 967719 - DNA, 25 bp, Mus musculus
tcagtgagtcggcagggctctgagt

SEQ ID NO: 967720 - DNA, 25 bp, Mus musculus
tcagtgagtcggcagttgaaagtgg

SEQ ID NO: 967721 - DNA, 25 bp, Mus musculus
tcagtgatatcacgaaggaggattc

SEQ ID NO: 967722 - DNA, 25 bp, Mus musculus
tcagtgatatcaggaaggaggattc

SEQ ID NO: 967723 - DNA, 25 bp, Mus musculus
tcagtgatcgccaacttcagtgaac

SEQ ID NO: 967724 - DNA, 25 bp, Mus musculus
tcagtgatcggcaacttcagtgaac

SEQ ID NO: 967725 - DNA, 25 bp, Mus musculus
tcagtgcaagaacagagactcagcc

SEQ ID NO: 967726 - DNA, 25 bp, Mus musculus
tcagtgcaagcatggaaggaccctc

SEQ ID NO: 967727 - DNA, 25 bp, Mus musculus
tcagtgcaagcttatcctgctcgga

SEQ ID NO: 967728 - DNA, 25 bp, Mus musculus
tcagtgcaaggatggaaggaccctc

SEQ ID NO: 967729 - DNA, 25 bp, Mus musculus
tcagtgcaaggttatcctgctcgga

SEQ ID NO: 967730 - DNA, 25 bp, Mus musculus
tcagtgcaagtacagagactcagcc

SEQ ID NO: 967731 - DNA, 25 bp, Mus musculus
tcagtgccaaccaacggaatggcga

SEQ ID NO: 967732 - DNA, 25 bp, Mus musculus
tcagtgccaaccaagggaatggcga

SEQ ID NO: 967733 - DNA, 25 bp, Mus musculus
tcagtgcctattcacggacagaggc

SEQ ID NO: 967734 - DNA, 25 bp, Mus musculus
tcagtgcctattcagggacagaggc

SEQ ID NO: 967735 - DNA, 25 bp, Mus musculus
tcagtgctcccacgggtgatctgct

SEQ ID NO: 967736 - DNA, 25 bp, Mus musculus
tcagtgctcccaggggtgatctgct

SEQ ID NO: 967737 - DNA, 25 bp, Mus musculus
tcagtgctggcttttcagagcacag

SEQ ID NO: 967738 - DNA, 25 bp, Mus musculus
tcagtgctgggttttcagagcacag

SEQ ID NO: 967739 - DNA, 25 bp, Mus musculus
tcagtggaaatagccggtaccactg

SEQ ID NO: 967740 - DNA, 25 bp, Mus musculus
tcagtggaaatagcgggtaccactg

SEQ ID NO: 967741 - DNA, 25 bp, Mus musculus
tcagtggaagctaaacagaatctgg

SEQ ID NO: 967742 - DNA, 25 bp, Mus musculus
tcagtggaaggtaaacagaatctgg

SEQ ID NO: 967743 - DNA, 25 bp, Mus musculus
tcagtggattctcaccacctcatcc

SEQ ID NO: 967744 - DNA, 25 bp, Mus musculus
tcagtggattctgaccacctcatcc

SEQ ID NO: 967745 - DNA, 25 bp, Mus musculus
tcagtggcacaatgccagctgatga

SEQ ID NO: 967746 - DNA, 25 bp, Mus musculus
tcagtggcactatgccagctgatga

SEQ ID NO: 967747 - DNA, 25 bp, Mus musculus
tcagtggggcagcaccttgtcttta

SEQ ID NO: 967748 - DNA, 25 bp, Mus musculus
tcagtggggcagcagcttgtcttta

SEQ ID NO: 967749 - DNA, 25 bp, Mus musculus
tcagtggggcggcccctgcccggat

SEQ ID NO: 967750 - DNA, 25 bp, Mus musculus
tcagtggggcgggccctgcccggat

SEQ ID NO: 967751 - DNA, 25 bp, Mus musculus
tcagtggtcgtgctggctttggtgg

SEQ ID NO: 967752 - DNA, 25 bp, Mus musculus
tcagtggtcgtggtggctttggtgg

SEQ ID NO: 967753 - DNA, 25 bp, Mus musculus
tcagtggtgtcgccattgctagctt

SEQ ID NO: 967754 - DNA, 25 bp, Mus musculus
tcagtggtgtcgctgttgccagtgt

SEQ ID NO: 967755 - DNA, 25 bp, Mus musculus
tcagtggtgtcggcattgctagctt

SEQ ID NO: 967756 - DNA, 25 bp, Mus musculus
tcagtggtgtcggtgttgccagtgt

SEQ ID NO: 967757 - DNA, 25 bp, Mus musculus
tcagtgtatcagcatgatgctgttg

SEQ ID NO: 967758 - DNA, 25 bp, Mus musculus
tcagtgtatcaggatgatgctgttg

SEQ ID NO: 967759 - DNA, 25 bp, Mus musculus
tcagtgtcagattctcagcaggttg

SEQ ID NO: 967760 - DNA, 25 bp, Mus musculus
tcagtgtcagtttctcagcaggttg

SEQ ID NO: 967761 - DNA, 25 bp, Mus musculus
tcagtgtcatcacgggtggtctcag

SEQ ID NO: 967762 - DNA, 25 bp, Mus musculus
tcagtgtcatcaggggtggtctcag

SEQ ID NO: 967763 - DNA, 25 bp, Mus musculus
tcagtgtccagcagcgcagggaggg

SEQ ID NO: 967764 - DNA, 25 bp, Mus musculus
tcagtgtccagcagggcagggaggg

SEQ ID NO: 967765 - DNA, 25 bp, Mus musculus
tcagtgtgttataacgaatgcccac

SEQ ID NO: 967766 - DNA, 25 bp, Mus musculus
tcagtgtgttataaggaatgcccac

SEQ ID NO: 967767 - DNA, 25 bp, Mus musculus
tcagttacacagatgccctaaacta

SEQ ID NO: 967768 - DNA, 25 bp, Mus musculus
tcagttacacagttgccctaaacta

SEQ ID NO: 967769 - DNA, 25 bp, Mus musculus
tcagttacagagaagtcataaagct

SEQ ID NO: 967770 - DNA, 25 bp, Mus musculus
tcagttacagagtagtcataaagct

SEQ ID NO: 967771 - DNA, 25 bp, Mus musculus
tcagttccacctggcccagcagctc

SEQ ID NO: 967772 - DNA, 25 bp, Mus musculus
tcagttccacgtggcccagcagctc

SEQ ID NO: 967773 - DNA, 25 bp, Mus musculus
tcagttcccaagatatttcacagct

SEQ ID NO: 967774 - DNA, 25 bp, Mus musculus
tcagttcccaagttatttcacagct

SEQ ID NO: 967775 - DNA, 25 bp, Mus musculus
tcagttcccagatccggctcacgct

SEQ ID NO: 967776 - DNA, 25 bp, Mus musculus
tcagttcccagatcgggctcacgct

SEQ ID NO: 967777 - DNA, 25 bp, Mus musculus
tcagttctcccacgttgttcctcaa

SEQ ID NO: 967778 - DNA, 25 bp, Mus musculus
tcagttctcccaggttgttcctcaa

SEQ ID NO: 967779 - DNA, 25 bp, Mus musculus
tcagttctgggaagtctccaggctt

SEQ ID NO: 967780 - DNA, 25 bp, Mus musculus
tcagttctgggatgtctccaggctt

SEQ ID NO: 967781 - DNA, 25 bp, Mus musculus
tcagttcttgctgaaagcagccctc

SEQ ID NO: 967782 - DNA, 25 bp, Mus musculus
tcagttcttggtgaaagcagccctc

SEQ ID NO: 967783 - DNA, 25 bp, Mus musculus
tcagttgcataaatgctgtgaggag

SEQ ID NO: 967784 - DNA, 25 bp, Mus musculus
tcagttgcataattgctgtgaggag

SEQ ID NO: 967785 - DNA, 25 bp, Mus musculus
tcagttgcatagacgtggatgagtg

SEQ ID NO: 967786 - DNA, 25 bp, Mus musculus
tcagttgcatagtcgtggatgagtg

SEQ ID NO: 967787 - DNA, 25 bp, Mus musculus
tcagttgcctgactcgctcggaagc

SEQ ID NO: 967788 - DNA, 25 bp, Mus musculus
tcagttgcctgactggctcggaagc

SEQ ID NO: 967789 - DNA, 25 bp, Mus musculus
tcagttgtcaaacataatactaaat

SEQ ID NO: 967790 - DNA, 25 bp, Mus musculus
tcagttgtcaaagataatactaaat

SEQ ID NO: 967791 - DNA, 25 bp, Mus musculus
tcagtttataagctcccctttgctg

SEQ ID NO: 967792 - DNA, 25 bp, Mus musculus
tcagtttataaggtcccctttgctg

SEQ ID NO: 967793 - DNA, 25 bp, Mus musculus
tcagtttatcaaagtcatgtaggaa

SEQ ID NO: 967794 - DNA, 25 bp, Mus musculus
tcagtttatcaatgtcatgtaggaa

SEQ ID NO: 967795 - DNA, 25 bp, Mus musculus
tcagtttccacacaatggactcgct

SEQ ID NO: 967796 - DNA, 25 bp, Mus musculus
tcagtttccacagaatggactcgct

SEQ ID NO: 967797 - DNA, 25 bp, Mus musculus
tcataaaactctaaagggtcaggct

SEQ ID NO: 967798 - DNA, 25 bp, Mus musculus
tcataaaactctaatgggtcaggct

SEQ ID NO: 967799 - DNA, 25 bp, Mus musculus
tcataaacagatcatggaaaatgct

SEQ ID NO: 967800 - DNA, 25 bp, Mus musculus
tcataaacagttcatggaaaatgct

SEQ ID NO: 967801 - DNA, 25 bp, Mus musculus
tcataaaccacaagactggggacaa

SEQ ID NO: 967802 - DNA, 25 bp, Mus musculus
tcataaaccacatgactggggacaa

SEQ ID NO: 967803 - DNA, 25 bp, Mus musculus
tcataaatgatgaatgtcgcactgg

SEQ ID NO: 967804 - DNA, 25 bp, Mus musculus
tcataaatgatgtatgtcgcactgg

SEQ ID NO: 967805 - DNA, 25 bp, Mus musculus
tcataactcatcaaccttatgaact

SEQ ID NO: 967806 - DNA, 25 bp, Mus musculus
tcataactcatcaagcttatgaact

SEQ ID NO: 967807 - DNA, 25 bp, Mus musculus
tcataacttccacagaatctcagta

SEQ ID NO: 967808 - DNA, 25 bp, Mus musculus
tcataacttccacatccaggccttc

SEQ ID NO: 967809 - DNA, 25 bp, Mus musculus
tcataacttccagagaatctcagta

SEQ ID NO: 967810 - DNA, 25 bp, Mus musculus
tcataacttccagatccaggccttc

SEQ ID NO: 967811 - DNA, 25 bp, Mus musculus
tcataagaagtgattccacgatgat

SEQ ID NO: 967812 - DNA, 25 bp, Mus musculus
tcataagaagtgtttccacgatgat

SEQ ID NO: 967813 - DNA, 25 bp, Mus musculus
tcataagtaaagcagaggagccaaa

SEQ ID NO: 967814 - DNA, 25 bp, Mus musculus
tcataagtaaaggagaggagccaaa

SEQ ID NO: 967815 - DNA, 25 bp, Mus musculus
tcataagttgccatatgtctggaag

SEQ ID NO: 967816 - DNA, 25 bp, Mus musculus
tcataagttggcatatgtctggaag

SEQ ID NO: 967817 - DNA, 25 bp, Mus musculus
tcatacaagtatgtgtggccatcat

SEQ ID NO: 967818 - DNA, 25 bp, Mus musculus
tcatacaagtttgtgtggccatcat

SEQ ID NO: 967819 - DNA, 25 bp, Mus musculus
tcatacaccctgcaggcgtaagacc

SEQ ID NO: 967820 - DNA, 25 bp, Mus musculus
tcatacaccctggaggcgtaagacc

SEQ ID NO: 967821 - DNA, 25 bp, Mus musculus
tcatacagacagaacgacagaacca

SEQ ID NO: 967822 - DNA, 25 bp, Mus musculus
tcatacagacagtacgacagaacca

SEQ ID NO: 967823 - DNA, 25 bp, Mus musculus
tcatacattgcaacctccaactggt

SEQ ID NO: 967824 - DNA, 25 bp, Mus musculus
tcatacattggaacctccaactggt

SEQ ID NO: 967825 - DNA, 25 bp, Mus musculus
tcatagacacagaaacagctatgaa

SEQ ID NO: 967826 - DNA, 25 bp, Mus musculus
tcatagacacagtaacagctatgaa

SEQ ID NO: 967827 - DNA, 25 bp, Mus musculus
tcatagagaagtatcagtcaactgt

SEQ ID NO: 967828 - DNA, 25 bp, Mus musculus
tcatagagaagtatgagtcaactgt

SEQ ID NO: 967829 - DNA, 25 bp, Mus musculus
tcatagcagccattaagctgcagga

SEQ ID NO: 967830 - DNA, 25 bp, Mus musculus
tcatagcagccatttagctgcagga

SEQ ID NO: 967831 - DNA, 25 bp, Mus musculus
tcatagcatcagccactgttgtagg

SEQ ID NO: 967832 - DNA, 25 bp, Mus musculus
tcatagcatcaggcactgttgtagg

SEQ ID NO: 967833 - DNA, 25 bp, Mus musculus
tcatagccagcttgcaaaggcagtg

SEQ ID NO: 967834 - DNA, 25 bp, Mus musculus
tcatagccagctttagtccctatga

SEQ ID NO: 967835 - DNA, 25 bp, Mus musculus
tcatagccaggttgcaaaggcagtg

SEQ ID NO: 967836 - DNA, 25 bp, Mus musculus
tcatagccaggtttagtccctatga

SEQ ID NO: 967837 - DNA, 25 bp, Mus musculus
tcatagctgtctcgtttgtggacag

SEQ ID NO: 967838 - DNA, 25 bp, Mus musculus
tcatagctgtctggtttgtggacag

SEQ ID NO: 967839 - DNA, 25 bp, Mus musculus
tcataggaaaagacatcaccaactt

SEQ ID NO: 967840 - DNA, 25 bp, Mus musculus
tcataggaaaagtcatcaccaactt

SEQ ID NO: 967841 - DNA, 25 bp, Mus musculus
tcatatacaaagccagtttgaggaa

SEQ ID NO: 967842 - DNA, 25 bp, Mus musculus
tcatatacaaaggcagtttgaggaa

SEQ ID NO: 967843 - DNA, 25 bp, Mus musculus
tcatatacagcagcagtacagtggg

SEQ ID NO: 967844 - DNA, 25 bp, Mus musculus
tcatatacaggagcagtacagtggg

SEQ ID NO: 967845 - DNA, 25 bp, Mus musculus
tcatatcagcaccgacgattccgga

SEQ ID NO: 967846 - DNA, 25 bp, Mus musculus
tcatatcagcaccggtcacccagaa

SEQ ID NO: 967847 - DNA, 25 bp, Mus musculus
tcatatcagcacggacgattccgga

SEQ ID NO: 967848 - DNA, 25 bp, Mus musculus
tcatatcagcacgggtcacccagaa

SEQ ID NO: 967849 - DNA, 25 bp, Mus musculus
tcatatctttcacaggagcctatca

SEQ ID NO: 967850 - DNA, 25 bp, Mus musculus
tcatatctttcagaggagcctatca

SEQ ID NO: 967851 - DNA, 25 bp, Mus musculus
tcatatgatatgcacattgacaaca

SEQ ID NO: 967852 - DNA, 25 bp, Mus musculus
tcatatgatatgcagattgacaaca

SEQ ID NO: 967853 - DNA, 25 bp, Mus musculus
tcatatgattcacatgctgtattat

SEQ ID NO: 967854 - DNA, 25 bp, Mus musculus
tcatatgattcagatgctgtattat

SEQ ID NO: 967855 - DNA, 25 bp, Mus musculus
tcatatggagagaatgctattaaga

SEQ ID NO: 967856 - DNA, 25 bp, Mus musculus
tcatatggagagacgtgtcctgggc

SEQ ID NO: 967857 - DNA, 25 bp, Mus musculus
tcatatggagagtatgctattaaga

SEQ ID NO: 967858 - DNA, 25 bp, Mus musculus
tcatatggagagtcgtgtcctgggc

SEQ ID NO: 967859 - DNA, 25 bp, Mus musculus
tcatatggcaacgaccctgatattg

SEQ ID NO: 967860 - DNA, 25 bp, Mus musculus
tcatatggcaacgagcctgatattg

SEQ ID NO: 967861 - DNA, 25 bp, Mus musculus
tcatattgtcagctctgtgttccat

SEQ ID NO: 967862 - DNA, 25 bp, Mus musculus
tcatattgtcaggtctgtgttccat

SEQ ID NO: 967863 - DNA, 25 bp, Mus musculus
tcatatttaaggcaaaatctctgaa

SEQ ID NO: 967864 - DNA, 25 bp, Mus musculus
tcatatttaagggaaaatctctgaa

SEQ ID NO: 967865 - DNA, 25 bp, Mus musculus
tcatcaaaactgcaagtttggtgag

SEQ ID NO: 967866 - DNA, 25 bp, Mus musculus
tcatcaaaactggaagtttggtgag

SEQ ID NO: 967867 - DNA, 25 bp, Mus musculus
tcatcaaattgactattattttgga

SEQ ID NO: 967868 - DNA, 25 bp, Mus musculus
tcatcaaattgagtattattttgga

SEQ ID NO: 967869 - DNA, 25 bp, Mus musculus
tcatcaacacagactttcctgcccc

SEQ ID NO: 967870 - DNA, 25 bp, Mus musculus
tcatcaacacagtctttcctgcccc

SEQ ID NO: 967871 - DNA, 25 bp, Mus musculus
tcatcaacccagcacgttctgtccc

SEQ ID NO: 967872 - DNA, 25 bp, Mus musculus
tcatcaacccagcaggttctgtccc

SEQ ID NO: 967873 - DNA, 25 bp, Mus musculus
tcatcaactaacatgcttcggatgt

SEQ ID NO: 967874 - DNA, 25 bp, Mus musculus
tcatcaactatcatgcttcggatgt

SEQ ID NO: 967875 - DNA, 25 bp, Mus musculus
tcatcaagaacacgctggagtatga

SEQ ID NO: 967876 - DNA, 25 bp, Mus musculus
tcatcaagaacaggctggagtatga

SEQ ID NO: 967877 - DNA, 25 bp, Mus musculus
tcatcaagaccaccaattcagtgaa

SEQ ID NO: 967878 - DNA, 25 bp, Mus musculus
tcatcaagaccagcaattcagtgaa

SEQ ID NO: 967879 - DNA, 25 bp, Mus musculus
tcatcaagcatgcaggaaggggagg

SEQ ID NO: 967880 - DNA, 25 bp, Mus musculus
tcatcaagcatggaggaaggggagg

SEQ ID NO: 967881 - DNA, 25 bp, Mus musculus
tcatcaagccagctaagcagcctct

SEQ ID NO: 967882 - DNA, 25 bp, Mus musculus
tcatcaagccaggtaagcagcctct

SEQ ID NO: 967883 - DNA, 25 bp, Mus musculus
tcatcaagctagcgatggagaacga

SEQ ID NO: 967884 - DNA, 25 bp, Mus musculus
tcatcaagctagggatggagaacga

SEQ ID NO: 967885 - DNA, 25 bp, Mus musculus
tcatcaagtgagcaatctgaggaag

SEQ ID NO: 967886 - DNA, 25 bp, Mus musculus
tcatcaagtgaggaatctgaggaag

SEQ ID NO: 967887 - DNA, 25 bp, Mus musculus
tcatcaatgagcctacagcagctgc

SEQ ID NO: 967888 - DNA, 25 bp, Mus musculus
tcatcaatgagcgtacagcagctgc

SEQ ID NO: 967889 - DNA, 25 bp, Mus musculus
tcatcaatgcagcaaaggaaacagt

SEQ ID NO: 967890 - DNA, 25 bp, Mus musculus
tcatcaatgcaggaaaggaaacagt

SEQ ID NO: 967891 - DNA, 25 bp, Mus musculus
tcatcacaccagcctcagctcacaa

SEQ ID NO: 967892 - DNA, 25 bp, Mus musculus
tcatcacaccaggctcagctcacaa

SEQ ID NO: 967893 - DNA, 25 bp, Mus musculus
tcatcacactgtagaagagaaggag

SEQ ID NO: 967894 - DNA, 25 bp, Mus musculus
tcatcacactgttgaagagaaggag

SEQ ID NO: 967895 - DNA, 25 bp, Mus musculus
tcatcacagccacgaagtcacctgg

SEQ ID NO: 967896 - DNA, 25 bp, Mus musculus
tcatcacagccaggaagtcacctgg

SEQ ID NO: 967897 - DNA, 25 bp, Mus musculus
tcatcaccacaccgcctgcgacccc

SEQ ID NO: 967898 - DNA, 25 bp, Mus musculus
tcatcaccacacggcctgcgacccc

SEQ ID NO: 967899 - DNA, 25 bp, Mus musculus
tcatcaccagaataagcctgcacga

SEQ ID NO: 967900 - DNA, 25 bp, Mus musculus
tcatcaccagctatcacgtatggac

SEQ ID NO: 967901 - DNA, 25 bp, Mus musculus
tcatcaccaggtatcacgtatggac

SEQ ID NO: 967902 - DNA, 25 bp, Mus musculus
tcatcaccagtataagcctgcacga

SEQ ID NO: 967903 - DNA, 25 bp, Mus musculus
tcatcacggaactccctaagccggg

SEQ ID NO: 967904 - DNA, 25 bp, Mus musculus
tcatcacggaactcctgaatgatac

SEQ ID NO: 967905 - DNA, 25 bp, Mus musculus
tcatcacggaactcgctaagccggg

SEQ ID NO: 967906 - DNA, 25 bp, Mus musculus
tcatcacggaactcgtgaatgatac

SEQ ID NO: 967907 - DNA, 25 bp, Mus musculus
tcatcacggcagatggcagtgaaat

SEQ ID NO: 967908 - DNA, 25 bp, Mus musculus
tcatcacggcagttggcagtgaaat

SEQ ID NO: 967909 - DNA, 25 bp, Mus musculus
tcatcactgcacctccagtgaccaa

SEQ ID NO: 967910 - DNA, 25 bp, Mus musculus
tcatcactgcacgtccagtgaccaa

SEQ ID NO: 967911 - DNA, 25 bp, Mus musculus
tcatcactttcaagggtgtttgcac

SEQ ID NO: 967912 - DNA, 25 bp, Mus musculus
tcatcactttcatgggtgtttgcac

SEQ ID NO: 967913 - DNA, 25 bp, Mus musculus
tcatcagaagagtacaactggactg

SEQ ID NO: 967914 - DNA, 25 bp, Mus musculus
tcatcagaagtgtacaactggactg

SEQ ID NO: 967915 - DNA, 25 bp, Mus musculus
tcatcagagcgatgactggtccttc

SEQ ID NO: 967916 - DNA, 25 bp, Mus musculus
tcatcagagcgatgtctggtccttc

SEQ ID NO: 967917 - DNA, 25 bp, Mus musculus
tcatcagatgcccaccaccccttgg

SEQ ID NO: 967918 - DNA, 25 bp, Mus musculus
tcatcagatgcccagcaccccttgg

SEQ ID NO: 967919 - DNA, 25 bp, Mus musculus
tcatcagcaggccaactctacaatg

SEQ ID NO: 967920 - DNA, 25 bp, Mus musculus
tcatcagcaggccatctctacaatg

SEQ ID NO: 967921 - DNA, 25 bp, Mus musculus
tcatcagcattgacctcatcgttct

SEQ ID NO: 967922 - DNA, 25 bp, Mus musculus
tcatcagcattgtcctcatcgttct

SEQ ID NO: 967923 - DNA, 25 bp, Mus musculus
tcatcagcttagactccttcgccct

SEQ ID NO: 967924 - DNA, 25 bp, Mus musculus
tcatcagcttagtctccttcgccct

SEQ ID NO: 967925 - DNA, 25 bp, Mus musculus
tcatcagtacaacattgtcggcttg

SEQ ID NO: 967926 - DNA, 25 bp, Mus musculus
tcatcagtacaagattgtcggcttg

SEQ ID NO: 967927 - DNA, 25 bp, Mus musculus
tcatcagtgagccaatggctgcagt

SEQ ID NO: 967928 - DNA, 25 bp, Mus musculus
tcatcagtgagcgaatggctgcagt

SEQ ID NO: 967929 - DNA, 25 bp, Mus musculus
tcatcataacagctcactgccaggg

SEQ ID NO: 967930 - DNA, 25 bp, Mus musculus
tcatcataacaggtcactgccaggg

SEQ ID NO: 967931 - DNA, 25 bp, Mus musculus
tcatcatcctgctgacaggactatg

SEQ ID NO: 967932 - DNA, 25 bp, Mus musculus
tcatcatcctgctgacctacattca

SEQ ID NO: 967933 - DNA, 25 bp, Mus musculus
tcatcatcctgctgtcaggactatg

SEQ ID NO: 967934 - DNA, 25 bp, Mus musculus
tcatcatcctgctgtcctacattca

SEQ ID NO: 967935 - DNA, 25 bp, Mus musculus
tcatcatctgcattcctccccagca

SEQ ID NO: 967936 - DNA, 25 bp, Mus musculus
tcatcatctggattcctccccagca

SEQ ID NO: 967937 - DNA, 25 bp, Mus musculus
tcatccaaagctgcagctagtgata

SEQ ID NO: 967938 - DNA, 25 bp, Mus musculus
tcatccaaaggtgcagctagtgata

SEQ ID NO: 967939 - DNA, 25 bp, Mus musculus
tcatccacaatgcacggatcagctc

SEQ ID NO: 967940 - DNA, 25 bp, Mus musculus
tcatccacaatgcagggatcagctc

SEQ ID NO: 967941 - DNA, 25 bp, Mus musculus
tcatccacgcagcttctggccagcg

SEQ ID NO: 967942 - DNA, 25 bp, Mus musculus
tcatccacgcaggttctggccagcg

SEQ ID NO: 967943 - DNA, 25 bp, Mus musculus
tcatccagaaacgacaagaagcaga

SEQ ID NO: 967944 - DNA, 25 bp, Mus musculus
tcatccagaaacgagaagaagcaga

SEQ ID NO: 967945 - DNA, 25 bp, Mus musculus
tcatccagactgagttcatctccag

SEQ ID NO: 967946 - DNA, 25 bp, Mus musculus
tcatccagactgtgttcatctccag

SEQ ID NO: 967947 - DNA, 25 bp, Mus musculus
tcatccagtctccaaagaactgtgc

SEQ ID NO: 967948 - DNA, 25 bp, Mus musculus
tcatccagtctcgaaagaactgtgc

SEQ ID NO: 967949 - DNA, 25 bp, Mus musculus
tcatccatgacgtacgtctgcgcag

SEQ ID NO: 967950 - DNA, 25 bp, Mus musculus
tcatccatgacgtaggtctgcgcag

SEQ ID NO: 967951 - DNA, 25 bp, Mus musculus
tcatcccaccagcggcttgctgtcc

SEQ ID NO: 967952 - DNA, 25 bp, Mus musculus
tcatcccaccaggggcttgctgtcc

SEQ ID NO: 967953 - DNA, 25 bp, Mus musculus
tcatcccaggagatcttcccacggt

SEQ ID NO: 967954 - DNA, 25 bp, Mus musculus
tcatcccaggagttcttcccacggt

SEQ ID NO: 967955 - DNA, 25 bp, Mus musculus
tcatcccaggctttactcctggctt

SEQ ID NO: 967956 - DNA, 25 bp, Mus musculus
tcatcccagggtttactcctggctt

SEQ ID NO: 967957 - DNA, 25 bp, Mus musculus
tcatccccgacatccacgtggaggt

SEQ ID NO: 967958 - DNA, 25 bp, Mus musculus
tcatccccgacatcgacgtggaggt

SEQ ID NO: 967959 - DNA, 25 bp, Mus musculus
tcatccccgatgatcatcccctctg

SEQ ID NO: 967960 - DNA, 25 bp, Mus musculus
tcatccccgatgttcatcccctctg

SEQ ID NO: 967961 - DNA, 25 bp, Mus musculus
tcatcccgagctgactccactgcgc

SEQ ID NO: 967962 - DNA, 25 bp, Mus musculus
tcatcccgaggtgactccactgcgc

SEQ ID NO: 967963 - DNA, 25 bp, Mus musculus
tcatccctaaagcgaacatctgtgt

SEQ ID NO: 967964 - DNA, 25 bp, Mus musculus
tcatccctaaagctgtcataagccg

SEQ ID NO: 967965 - DNA, 25 bp, Mus musculus
tcatccctaaagggaacatctgtgt

SEQ ID NO: 967966 - DNA, 25 bp, Mus musculus
tcatccctaaaggtgtcataagccg

SEQ ID NO: 967967 - DNA, 25 bp, Mus musculus
tcatccgacacaagcgccgtggggc

SEQ ID NO: 967968 - DNA, 25 bp, Mus musculus
tcatccgacagaagcgccgtggggc

SEQ ID NO: 967969 - DNA, 25 bp, Mus musculus
tcatccggaaggagcttcgtccacc

SEQ ID NO: 967970 - DNA, 25 bp, Mus musculus
tcatccggaaggtgcttcgtccacc

SEQ ID NO: 967971 - DNA, 25 bp, Mus musculus
tcatcctacacgccatcgacggtcc

SEQ ID NO: 967972 - DNA, 25 bp, Mus musculus
tcatcctacacggcatcgacggtcc

SEQ ID NO: 967973 - DNA, 25 bp, Mus musculus
tcatcctagcggattgcctgagaat

SEQ ID NO: 967974 - DNA, 25 bp, Mus musculus
tcatcctagcggtttgcctgagaat

SEQ ID NO: 967975 - DNA, 25 bp, Mus musculus
tcatcctcaatacttgaactttcta

SEQ ID NO: 967976 - DNA, 25 bp, Mus musculus
tcatcctcaatagttgaactttcta

SEQ ID NO: 967977 - DNA, 25 bp, Mus musculus
tcatcctcagaaacaaaggaagaac

SEQ ID NO: 967978 - DNA, 25 bp, Mus musculus
tcatcctcagacaacattgtgcact

SEQ ID NO: 967979 - DNA, 25 bp, Mus musculus
tcatcctcagatatcagcctgatca

SEQ ID NO: 967980 - DNA, 25 bp, Mus musculus
tcatcctcagccacaccaagatgaa

SEQ ID NO: 967981 - DNA, 25 bp, Mus musculus
tcatcctcagccagtgccctgaaaa

SEQ ID NO: 967982 - DNA, 25 bp, Mus musculus
tcatcctcaggcacaccaagatgaa

SEQ ID NO: 967983 - DNA, 25 bp, Mus musculus
tcatcctcaggcagtgccctgaaaa

SEQ ID NO: 967984 - DNA, 25 bp, Mus musculus
tcatcctcagtaacaaaggaagaac

SEQ ID NO: 967985 - DNA, 25 bp, Mus musculus
tcatcctcagtcaacattgtgcact

SEQ ID NO: 967986 - DNA, 25 bp, Mus musculus
tcatcctcagttatcagcctgatca

SEQ ID NO: 967987 - DNA, 25 bp, Mus musculus
tcatcctctctccacacagacaata

SEQ ID NO: 967988 - DNA, 25 bp, Mus musculus
tcatcctctctccagacagacaata

SEQ ID NO: 967989 - DNA, 25 bp, Mus musculus
tcatcctcttctatgcggcaggcca

SEQ ID NO: 967990 - DNA, 25 bp, Mus musculus
tcatcctcttctcagcattccggct

SEQ ID NO: 967991 - DNA, 25 bp, Mus musculus
tcatcctcttctgagcattccggct

SEQ ID NO: 967992 - DNA, 25 bp, Mus musculus
tcatcctcttctttgcggcaggcca

SEQ ID NO: 967993 - DNA, 25 bp, Mus musculus
tcatcctgaaccaactgaccgggtt

SEQ ID NO: 967994 - DNA, 25 bp, Mus musculus
tcatcctgaaccaagtgaccgggtt

SEQ ID NO: 967995 - DNA, 25 bp, Mus musculus
tcatcctgaccagacagcttctgtg

SEQ ID NO: 967996 - DNA, 25 bp, Mus musculus
tcatcctgaccagagagcttctgtg

SEQ ID NO: 967997 - DNA, 25 bp, Mus musculus
tcatcctgctgacaggactatgact

SEQ ID NO: 967998 - DNA, 25 bp, Mus musculus
tcatcctgctgacctacattcagcc

SEQ ID NO: 967999 - DNA, 25 bp, Mus musculus
tcatcctgctgagaggactatgact

SEQ ID NO: 968000 - DNA, 25 bp, Mus musculus
tcatcctgctgagctacattcagcc

SEQ ID NO: 968001 - DNA, 25 bp, Mus musculus
tcatcctgtcatgccggctagtggt

SEQ ID NO: 968002 - DNA, 25 bp, Mus musculus
tcatcctgtcatgcgggctagtggt

SEQ ID NO: 968003 - DNA, 25 bp, Mus musculus
tcatcctgtgagatgggtgcaaagc

SEQ ID NO: 968004 - DNA, 25 bp, Mus musculus
tcatcctgtgagttgggtgcaaagc

SEQ ID NO: 968005 - DNA, 25 bp, Mus musculus
tcatccttatagcagaaaccatcaa

SEQ ID NO: 968006 - DNA, 25 bp, Mus musculus
tcatccttataggagaaaccatcaa

SEQ ID NO: 968007 - DNA, 25 bp, Mus musculus
tcatccttcagaagtacatgatggt

SEQ ID NO: 968008 - DNA, 25 bp, Mus musculus
tcatccttcagatgtacatgatggt

SEQ ID NO: 968009 - DNA, 25 bp, Mus musculus
tcatccttcgagcatgtctcggaac

SEQ ID NO: 968010 - DNA, 25 bp, Mus musculus
tcatccttcgagccttgctttgctt

SEQ ID NO: 968011 - DNA, 25 bp, Mus musculus
tcatccttcgaggatgtctcggaac

SEQ ID NO: 968012 - DNA, 25 bp, Mus musculus
tcatccttcgaggcttgctttgctt

SEQ ID NO: 968013 - DNA, 25 bp, Mus musculus
tcatccttgtcaaacatcgactgtg

SEQ ID NO: 968014 - DNA, 25 bp, Mus musculus
tcatccttgtcaaactctacaaaat

SEQ ID NO: 968015 - DNA, 25 bp, Mus musculus
tcatccttgtcaaagatcgactgtg

SEQ ID NO: 968016 - DNA, 25 bp, Mus musculus
tcatccttgtcaaagtctacaaaat

SEQ ID NO: 968017 - DNA, 25 bp, Mus musculus
tcatcgacaaagacaacactgctta

SEQ ID NO: 968018 - DNA, 25 bp, Mus musculus
tcatcgacaaagtcaacactgctta

SEQ ID NO: 968019 - DNA, 25 bp, Mus musculus
tcatcgacataaagattacagatgc

SEQ ID NO: 968020 - DNA, 25 bp, Mus musculus
tcatcgacataatgattacagatgc

SEQ ID NO: 968021 - DNA, 25 bp, Mus musculus
tcatcgacggccacaacgacttgcc

SEQ ID NO: 968022 - DNA, 25 bp, Mus musculus
tcatcgacgggcacaacgacttgcc

SEQ ID NO: 968023 - DNA, 25 bp, Mus musculus
tcatcgactcaacgatggatcaaca

SEQ ID NO: 968024 - DNA, 25 bp, Mus musculus
tcatcgactcaaggatggatcaaca

SEQ ID NO: 968025 - DNA, 25 bp, Mus musculus
tcatcgagatccagagcaaacactg

SEQ ID NO: 968026 - DNA, 25 bp, Mus musculus
tcatcgagatccagtgcaaacactg

SEQ ID NO: 968027 - DNA, 25 bp, Mus musculus
tcatcgagtgtcaacactgtgattt

SEQ ID NO: 968028 - DNA, 25 bp, Mus musculus
tcatcgagtgtcaagactgtgattt

SEQ ID NO: 968029 - DNA, 25 bp, Mus musculus
tcatcgataccgagatgcaattgct

SEQ ID NO: 968030 - DNA, 25 bp, Mus musculus
tcatcgataccgtgatgcaattgct

SEQ ID NO: 968031 - DNA, 25 bp, Mus musculus
tcatcgccctggtgcggttggtggc

SEQ ID NO: 968032 - DNA, 25 bp, Mus musculus
tcatcgccctggtgcgtccaagtac

SEQ ID NO: 968033 - DNA, 25 bp, Mus musculus
tcatcgccctggtggggttggtggc

SEQ ID NO: 968034 - DNA, 25 bp, Mus musculus
tcatcgccctggtgggtccaagtac

SEQ ID NO: 968035 - DNA, 25 bp, Mus musculus
tcatcggaacagcgaaatgggaaga

SEQ ID NO: 968036 - DNA, 25 bp, Mus musculus
tcatcggaacagggaaatgggaaga

SEQ ID NO: 968037 - DNA, 25 bp, Mus musculus
tcatcgggaaagccgctgcctattc

SEQ ID NO: 968038 - DNA, 25 bp, Mus musculus
tcatcgggaaaggcgctgcctattc

SEQ ID NO: 968039 - DNA, 25 bp, Mus musculus
tcatcgggacaggacgcgtccagag

SEQ ID NO: 968040 - DNA, 25 bp, Mus musculus
tcatcgggacaggaggcgtccagag

SEQ ID NO: 968041 - DNA, 25 bp, Mus musculus
tcatcggtaaatcgcaccggcacct

SEQ ID NO: 968042 - DNA, 25 bp, Mus musculus
tcatcggtaattcgcaccggcacct

SEQ ID NO: 968043 - DNA, 25 bp, Mus musculus
tcatcgtcagagcgtggctgcataa

SEQ ID NO: 968044 - DNA, 25 bp, Mus musculus
tcatcgtcagagggtggctgcataa

SEQ ID NO: 968045 - DNA, 25 bp, Mus musculus
tcatcgtgagccatatgactaggac

SEQ ID NO: 968046 - DNA, 25 bp, Mus musculus
tcatcgtgagccatttgactaggac

SEQ ID NO: 968047 - DNA, 25 bp, Mus musculus
tcatcgtgttcagccttccagtggc

SEQ ID NO: 968048 - DNA, 25 bp, Mus musculus
tcatcgtgttgagccttccagtggc

SEQ ID NO: 968049 - DNA, 25 bp, Mus musculus
tcatctacaactcgcagggtgccca

SEQ ID NO: 968050 - DNA, 25 bp, Mus musculus
tcatctacaactggcagggtgccca

SEQ ID NO: 968051 - DNA, 25 bp, Mus musculus
tcatctacagagacctgaagccaga

SEQ ID NO: 968052 - DNA, 25 bp, Mus musculus
tcatctacagtgacctgaagccaga

SEQ ID NO: 968053 - DNA, 25 bp, Mus musculus
tcatctactcttcgttcttcattga

SEQ ID NO: 968054 - DNA, 25 bp, Mus musculus
tcatctactcttggttcttcattga

SEQ ID NO: 968055 - DNA, 25 bp, Mus musculus
tcatctagattccgcaaatacatgg

SEQ ID NO: 968056 - DNA, 25 bp, Mus musculus
tcatctagattcggcaaatacatgg

SEQ ID NO: 968057 - DNA, 25 bp, Mus musculus
tcatctataaagacatccgcgggga

SEQ ID NO: 968058 - DNA, 25 bp, Mus musculus
tcatctataaagacttccgcgggga

SEQ ID NO: 968059 - DNA, 25 bp, Mus musculus
tcatctcaagagtttcacatgttct

SEQ ID NO: 968060 - DNA, 25 bp, Mus musculus
tcatctcaagtgtttcacatgttct

SEQ ID NO: 968061 - DNA, 25 bp, Mus musculus
tcatctcactgacaatttagagaca

SEQ ID NO: 968062 - DNA, 25 bp, Mus musculus
tcatctcactgagaatttagagaca

SEQ ID NO: 968063 - DNA, 25 bp, Mus musculus
tcatctccttcactgaggatgcccc

SEQ ID NO: 968064 - DNA, 25 bp, Mus musculus
tcatctccttcagtgaggatgcccc

SEQ ID NO: 968065 - DNA, 25 bp, Mus musculus
tcatctctgaaacttctcctgtcta

SEQ ID NO: 968066 - DNA, 25 bp, Mus musculus
tcatctctgaaagttctcctgtcta

SEQ ID NO: 968067 - DNA, 25 bp, Mus musculus
tcatctgcaagaacacctaggctgg

SEQ ID NO: 968068 - DNA, 25 bp, Mus musculus
tcatctgcaagaactcctaggctgg

SEQ ID NO: 968069 - DNA, 25 bp, Mus musculus
tcatctgctagacaagggcaagtct

SEQ ID NO: 968070 - DNA, 25 bp, Mus musculus
tcatctgctagacactggctctcca

SEQ ID NO: 968071 - DNA, 25 bp, Mus musculus
tcatctgctagacctctggtgttct

SEQ ID NO: 968072 - DNA, 25 bp, Mus musculus
tcatctgctagacgttcacaacaaa

SEQ ID NO: 968073 - DNA, 25 bp, Mus musculus
tcatctgctagactaggtgcttccc

SEQ ID NO: 968074 - DNA, 25 bp, Mus musculus
tcatctgctagagaagggcaagtct

SEQ ID NO: 968075 - DNA, 25 bp, Mus musculus
tcatctgctagagactggctctcca

SEQ ID NO: 968076 - DNA, 25 bp, Mus musculus
tcatctgctagagctctggtgttct

SEQ ID NO: 968077 - DNA, 25 bp, Mus musculus
tcatctgctagaggttcacaacaaa

SEQ ID NO: 968078 - DNA, 25 bp, Mus musculus
tcatctgctagagtaggtgcttccc

SEQ ID NO: 968079 - DNA, 25 bp, Mus musculus
tcatctggtgtggcagtagaaacag

SEQ ID NO: 968080 - DNA, 25 bp, Mus musculus
tcatctggtgtggcattttttggac

SEQ ID NO: 968081 - DNA, 25 bp, Mus musculus
tcatctggtgtggctgtagaaacag

SEQ ID NO: 968082 - DNA, 25 bp, Mus musculus
tcatctggtgtggctttttttggac

SEQ ID NO: 968083 - DNA, 25 bp, Mus musculus
tcatctgtaccccgttcatcagcaa

SEQ ID NO: 968084 - DNA, 25 bp, Mus musculus
tcatctgtacccggttcatcagcaa

SEQ ID NO: 968085 - DNA, 25 bp, Mus musculus
tcatctgttctgaaactgcttcaga

SEQ ID NO: 968086 - DNA, 25 bp, Mus musculus
tcatctgttctgaatctgcttcaga

SEQ ID NO: 968087 - DNA, 25 bp, Mus musculus
tcatctgtttcaaatcccagaaacc

SEQ ID NO: 968088 - DNA, 25 bp, Mus musculus
tcatctgtttcaaatcccagaaact

SEQ ID NO: 968089 - DNA, 25 bp, Mus musculus
tcatctgtttcaagaagatctgcct

SEQ ID NO: 968090 - DNA, 25 bp, Mus musculus
tcatctgtttcatatcccagaaacc

SEQ ID NO: 968091 - DNA, 25 bp, Mus musculus
tcatctgtttcatatcccagaaact

SEQ ID NO: 968092 - DNA, 25 bp, Mus musculus
tcatctgtttcatgaagatctgcct

SEQ ID NO: 968093 - DNA, 25 bp, Mus musculus
tcatcttagcagaggagcagttcat

SEQ ID NO: 968094 - DNA, 25 bp, Mus musculus
tcatcttagcagtggagcagttcat

SEQ ID NO: 968095 - DNA, 25 bp, Mus musculus
tcatcttatcagcagcacggcatcc

SEQ ID NO: 968096 - DNA, 25 bp, Mus musculus
tcatcttatcaggagcacggcatcc

SEQ ID NO: 968097 - DNA, 25 bp, Mus musculus
tcatcttccagccgaagcgccgtgg

SEQ ID NO: 968098 - DNA, 25 bp, Mus musculus
tcatcttccagcggaagcgccgtgg

SEQ ID NO: 968099 - DNA, 25 bp, Mus musculus
tcatcttgagaacccagcagtgatg

SEQ ID NO: 968100 - DNA, 25 bp, Mus musculus
tcatcttgagtacccagcagtgatg

SEQ ID NO: 968101 - DNA, 25 bp, Mus musculus
tcatctttcaaaattcgcagaaaag

SEQ ID NO: 968102 - DNA, 25 bp, Mus musculus
tcatctttcaaatttcgcagaaaag

SEQ ID NO: 968103 - DNA, 25 bp, Mus musculus
tcatctttgtcgacagtgcggcctg

SEQ ID NO: 968104 - DNA, 25 bp, Mus musculus
tcatctttgtggacagtgcggcctg

SEQ ID NO: 968105 - DNA, 25 bp, Mus musculus
tcatctttgtggtgcgcggacctgg

SEQ ID NO: 968106 - DNA, 25 bp, Mus musculus
tcatctttgtggtgggcggacctgg

SEQ ID NO: 968107 - DNA, 25 bp, Mus musculus
tcatgaaatgatagcatcgacatcc

SEQ ID NO: 968108 - DNA, 25 bp, Mus musculus
tcatgaaatgattgcatcgacatcc

SEQ ID NO: 968109 - DNA, 25 bp, Mus musculus
tcatgaacatagccccttctgagtt

SEQ ID NO: 968110 - DNA, 25 bp, Mus musculus
tcatgaacataggcccttctgagtt

SEQ ID NO: 968111 - DNA, 25 bp, Mus musculus
tcatgaactcagcctcagcatctat

SEQ ID NO: 968112 - DNA, 25 bp, Mus musculus
tcatgaactctgcctcagcatctat

SEQ ID NO: 968113 - DNA, 25 bp, Mus musculus
tcatgaagaccccgcgtcttgttgc

SEQ ID NO: 968114 - DNA, 25 bp, Mus musculus
tcatgaagaccccgggtcttgttgc

SEQ ID NO: 968115 - DNA, 25 bp, Mus musculus
tcatgaaggtagaacgacatgtctt

SEQ ID NO: 968116 - DNA, 25 bp, Mus musculus
tcatgaaggtagaaggacatgtctt

SEQ ID NO: 968117 - DNA, 25 bp, Mus musculus
tcatgaaggtgccgcttttggcacg

SEQ ID NO: 968118 - DNA, 25 bp, Mus musculus
tcatgaaggtgccggttttggcacg

SEQ ID NO: 968119 - DNA, 25 bp, Mus musculus
tcatgaatcagcacatcctcatatt

SEQ ID NO: 968120 - DNA, 25 bp, Mus musculus
tcatgaatcagcacttcctcatatt

SEQ ID NO: 968121 - DNA, 25 bp, Mus musculus
tcatgacaagacaccctgttgaaga

SEQ ID NO: 968122 - DNA, 25 bp, Mus musculus
tcatgacaagagggccaatccgagc

SEQ ID NO: 968123 - DNA, 25 bp, Mus musculus
tcatgacaagtcaccctgttgaaga

SEQ ID NO: 968124 - DNA, 25 bp, Mus musculus
tcatgacaagtgggccaatccgagc

SEQ ID NO: 968125 - DNA, 25 bp, Mus musculus
tcatgacaccagcacttcctccatc

SEQ ID NO: 968126 - DNA, 25 bp, Mus musculus
tcatgacaccaggacttcctccatc

SEQ ID NO: 968127 - DNA, 25 bp, Mus musculus
tcatgaccaaagccttggacaccaa

SEQ ID NO: 968128 - DNA, 25 bp, Mus musculus
tcatgaccaaaggcttggacaccaa

SEQ ID NO: 968129 - DNA, 25 bp, Mus musculus
tcatgaccagctacacacttacctg

SEQ ID NO: 968130 - DNA, 25 bp, Mus musculus
tcatgaccaggtacacacttacctg

SEQ ID NO: 968131 - DNA, 25 bp, Mus musculus
tcatgagaaaagctattgttgggga

SEQ ID NO: 968132 - DNA, 25 bp, Mus musculus
tcatgagaaaaggtattgttgggga

SEQ ID NO: 968133 - DNA, 25 bp, Mus musculus
tcatgagaaagagtccctcgcccac

SEQ ID NO: 968134 - DNA, 25 bp, Mus musculus
tcatgagaaagagtgcctcgcccac

SEQ ID NO: 968135 - DNA, 25 bp, Mus musculus
tcatgagaagctacacactgaatat

SEQ ID NO: 968136 - DNA, 25 bp, Mus musculus
tcatgagaaggtacacactgaatat

SEQ ID NO: 968137 - DNA, 25 bp, Mus musculus
tcatgagatgcaaattcaacaccca

SEQ ID NO: 968138 - DNA, 25 bp, Mus musculus
tcatgagatggaaattcaacaccca

SEQ ID NO: 968139 - DNA, 25 bp, Mus musculus
tcatgatccccaatctggaaaccat

SEQ ID NO: 968140 - DNA, 25 bp, Mus musculus
tcatgatccccaatgtggaaaccat

SEQ ID NO: 968141 - DNA, 25 bp, Mus musculus
tcatgatgaccacgattacttacac

SEQ ID NO: 968142 - DNA, 25 bp, Mus musculus
tcatgatgaccaggattacttacac

SEQ ID NO: 968143 - DNA, 25 bp, Mus musculus
tcatgatgatgccttcctctccatc

SEQ ID NO: 968144 - DNA, 25 bp, Mus musculus
tcatgatgatgcgttcctctccatc

SEQ ID NO: 968145 - DNA, 25 bp, Mus musculus
tcatgatttccacagagaagacctg

SEQ ID NO: 968146 - DNA, 25 bp, Mus musculus
tcatgatttccaccctcatgtcata

SEQ ID NO: 968147 - DNA, 25 bp, Mus musculus
tcatgatttccagagagaagacctg

SEQ ID NO: 968148 - DNA, 25 bp, Mus musculus
tcatgatttccagcctcatgtcata

SEQ ID NO: 968149 - DNA, 25 bp, Mus musculus
tcatgcactctgatcgtactggaaa

SEQ ID NO: 968150 - DNA, 25 bp, Mus musculus
tcatgcactctgatggtactggaaa

SEQ ID NO: 968151 - DNA, 25 bp, Mus musculus
tcatgcagaagcggcgcactccagt

SEQ ID NO: 968152 - DNA, 25 bp, Mus musculus
tcatgcagaagcggggcactccagt

SEQ ID NO: 968153 - DNA, 25 bp, Mus musculus
tcatgcagcaagcttctgagctcat

SEQ ID NO: 968154 - DNA, 25 bp, Mus musculus
tcatgcagcaaggttctgagctcat

SEQ ID NO: 968155 - DNA, 25 bp, Mus musculus
tcatgcatgggcagacacagccctg

SEQ ID NO: 968156 - DNA, 25 bp, Mus musculus
tcatgcatgggcagtcacagccctg

SEQ ID NO: 968157 - DNA, 25 bp, Mus musculus
tcatgcattaagtcttgtgatatgc

SEQ ID NO: 968158 - DNA, 25 bp, Mus musculus
tcatgcattatgtcttgtgatatgc

SEQ ID NO: 968159 - DNA, 25 bp, Mus musculus
tcatgccacaggactacctgtgctc

SEQ ID NO: 968160 - DNA, 25 bp, Mus musculus
tcatgccacaggtctacctgtgctc

SEQ ID NO: 968161 - DNA, 25 bp, Mus musculus
tcatgcccaatgctctgcgcggact

SEQ ID NO: 968162 - DNA, 25 bp, Mus musculus
tcatgcccaatggtctgcgcggact

SEQ ID NO: 968163 - DNA, 25 bp, Mus musculus
tcatgcccttgacatccagaagaca

SEQ ID NO: 968164 - DNA, 25 bp, Mus musculus
tcatgcccttgagatccagaagaca

SEQ ID NO: 968165 - DNA, 25 bp, Mus musculus
tcatgcctgattccaatgattcgcc

SEQ ID NO: 968166 - DNA, 25 bp, Mus musculus
tcatgcctgattcctatgattcgcc

SEQ ID NO: 968167 - DNA, 25 bp, Mus musculus
tcatgcgaagatatgagttgtattt

SEQ ID NO: 968168 - DNA, 25 bp, Mus musculus
tcatgcgaagatttgagttgtattt

SEQ ID NO: 968169 - DNA, 25 bp, Mus musculus
tcatgctaacaggacgttggtggtt

SEQ ID NO: 968170 - DNA, 25 bp, Mus musculus
tcatgctaacaggaggttggtggtt

SEQ ID NO: 968171 - DNA, 25 bp, Mus musculus
tcatgctcatgacggattcatgatg

SEQ ID NO: 968172 - DNA, 25 bp, Mus musculus
tcatgctcatgagggattcatgatg

SEQ ID NO: 968173 - DNA, 25 bp, Mus musculus
tcatgctggatgatactatcgtgga

SEQ ID NO: 968174 - DNA, 25 bp, Mus musculus
tcatgctggatgttactatcgtgga

SEQ ID NO: 968175 - DNA, 25 bp, Mus musculus
tcatgcttgtgaccatactctcctc

SEQ ID NO: 968176 - DNA, 25 bp, Mus musculus
tcatgcttgtgagcatactctcctc

SEQ ID NO: 968177 - DNA, 25 bp, Mus musculus
tcatggaaatatgggcttaggtcat

SEQ ID NO: 968178 - DNA, 25 bp, Mus musculus
tcatggaaatttgggcttaggtcat

SEQ ID NO: 968179 - DNA, 25 bp, Mus musculus
tcatggaatcagctgccaacaggct

SEQ ID NO: 968180 - DNA, 25 bp, Mus musculus
tcatggaatcagctgctctgccctg

SEQ ID NO: 968181 - DNA, 25 bp, Mus musculus
tcatggaatcaggtgccaacaggct

SEQ ID NO: 968182 - DNA, 25 bp, Mus musculus
tcatggaatcaggtgctctgccctg

SEQ ID NO: 968183 - DNA, 25 bp, Mus musculus
tcatggacctcccacagtttactga

SEQ ID NO: 968184 - DNA, 25 bp, Mus musculus
tcatggacctcccactttactgact

SEQ ID NO: 968185 - DNA, 25 bp, Mus musculus
tcatggacctcccagagtttactga

SEQ ID NO: 968186 - DNA, 25 bp, Mus musculus
tcatggacctcccagtttactgact

SEQ ID NO: 968187 - DNA, 25 bp, Mus musculus
tcatggacgtattaaagcctctgtg

SEQ ID NO: 968188 - DNA, 25 bp, Mus musculus
tcatggacgttttaaagcctctgtg

SEQ ID NO: 968189 - DNA, 25 bp, Mus musculus
tcatggactagccgcctggtctcag

SEQ ID NO: 968190 - DNA, 25 bp, Mus musculus
tcatggactagcctttcaggcctgg

SEQ ID NO: 968191 - DNA, 25 bp, Mus musculus
tcatggactagcggcctggtctcag

SEQ ID NO: 968192 - DNA, 25 bp, Mus musculus
tcatggactagcgtttcaggcctgg

SEQ ID NO: 968193 - DNA, 25 bp, Mus musculus
tcatggagagacgtgacactcactg

SEQ ID NO: 968194 - DNA, 25 bp, Mus musculus
tcatggagagcgaggggcggaagaa

SEQ ID NO: 968195 - DNA, 25 bp, Mus musculus
tcatggagagggaggggcggaagaa

SEQ ID NO: 968196 - DNA, 25 bp, Mus musculus
tcatggagagtcgtgacactcactg

SEQ ID NO: 968197 - DNA, 25 bp, Mus musculus
tcatggaggccggacaggagccgct

SEQ ID NO: 968198 - DNA, 25 bp, Mus musculus
tcatggaggccggagaggagccgct

SEQ ID NO: 968199 - DNA, 25 bp, Mus musculus
tcatggaggctgcacacagcagctt

SEQ ID NO: 968200 - DNA, 25 bp, Mus musculus
tcatggaggctgcagacagcagctt

SEQ ID NO: 968201 - DNA, 25 bp, Mus musculus
tcatggagtctaagctctaaaagct

SEQ ID NO: 968202 - DNA, 25 bp, Mus musculus
tcatggagtctatgctctaaaagct

SEQ ID NO: 968203 - DNA, 25 bp, Mus musculus
tcatggatgaatagaagccccacag

SEQ ID NO: 968204 - DNA, 25 bp, Mus musculus
tcatggatgaatatgctggactctt

SEQ ID NO: 968205 - DNA, 25 bp, Mus musculus
tcatggatgaattgaagccccacag

SEQ ID NO: 968206 - DNA, 25 bp, Mus musculus
tcatggatgaatttgctggactctt

SEQ ID NO: 968207 - DNA, 25 bp, Mus musculus
tcatggatgatgccaacatgtgcat

SEQ ID NO: 968208 - DNA, 25 bp, Mus musculus
tcatggatgatgcctacatgtgcat

SEQ ID NO: 968209 - DNA, 25 bp, Mus musculus
tcatggcatccacggaccagagcac

SEQ ID NO: 968210 - DNA, 25 bp, Mus musculus
tcatggcatccagggaccagagcac

SEQ ID NO: 968211 - DNA, 25 bp, Mus musculus
tcatggccctgttgcatggagaaca

SEQ ID NO: 968212 - DNA, 25 bp, Mus musculus
tcatggccctgttggatggagaaca

SEQ ID NO: 968213 - DNA, 25 bp, Mus musculus
tcatggctgtgtcattgatcctgtt

SEQ ID NO: 968214 - DNA, 25 bp, Mus musculus
tcatggctgtgtgattgatcctgtt

SEQ ID NO: 968215 - DNA, 25 bp, Mus musculus
tcatggtggatttacgagaggatga

SEQ ID NO: 968216 - DNA, 25 bp, Mus musculus
tcatggtggatttaggagaggatga

SEQ ID NO: 968217 - DNA, 25 bp, Mus musculus
tcatggtgtgagcggtcccacagag

SEQ ID NO: 968218 - DNA, 25 bp, Mus musculus
tcatggtgtgaggggtcccacagag

SEQ ID NO: 968219 - DNA, 25 bp, Mus musculus
tcatgtacagaacatgatgagtgtc

SEQ ID NO: 968220 - DNA, 25 bp, Mus musculus
tcatgtacagtacatgatgagtgtc

SEQ ID NO: 968221 - DNA, 25 bp, Mus musculus
tcatgtacctccaccacgtcgggtg

SEQ ID NO: 968222 - DNA, 25 bp, Mus musculus
tcatgtacctgcaccacgtcgggtg

SEQ ID NO: 968223 - DNA, 25 bp, Mus musculus
tcatgtatgcgggacgtcccatcag

SEQ ID NO: 968224 - DNA, 25 bp, Mus musculus
tcatgtatgcgggaggtcccatcag

SEQ ID NO: 968225 - DNA, 25 bp, Mus musculus
tcatgtatgtagcactcacagattt

SEQ ID NO: 968226 - DNA, 25 bp, Mus musculus
tcatgtatgtaggactcacagattt

SEQ ID NO: 968227 - DNA, 25 bp, Mus musculus
tcatgtcaagaccaaacggccccct

SEQ ID NO: 968228 - DNA, 25 bp, Mus musculus
tcatgtcaagaccatacggccccct

SEQ ID NO: 968229 - DNA, 25 bp, Mus musculus
tcatgtcaatcacctggtcaccttc

SEQ ID NO: 968230 - DNA, 25 bp, Mus musculus
tcatgtcaatgacctggtcaccttc

SEQ ID NO: 968231 - DNA, 25 bp, Mus musculus
tcatgtcagcagcaaatgatggatg

SEQ ID NO: 968232 - DNA, 25 bp, Mus musculus
tcatgtcagcagcctggcgcattgg

SEQ ID NO: 968233 - DNA, 25 bp, Mus musculus
tcatgtcagcaggaaatgatggatg

SEQ ID NO: 968234 - DNA, 25 bp, Mus musculus
tcatgtcagcaggctggcgcattgg

SEQ ID NO: 968235 - DNA, 25 bp, Mus musculus
tcatgtcatcagccagcctgatctc

SEQ ID NO: 968236 - DNA, 25 bp, Mus musculus
tcatgtcatcaggcagcctgatctc

SEQ ID NO: 968237 - DNA, 25 bp, Mus musculus
tcatgtcttcaactaaaggatctcc

SEQ ID NO: 968238 - DNA, 25 bp, Mus musculus
tcatgtcttcaagtaaaggatctcc

SEQ ID NO: 968239 - DNA, 25 bp, Mus musculus
tcatgtgcagagacaggctttgata

SEQ ID NO: 968240 - DNA, 25 bp, Mus musculus
tcatgtgcagcctttgatatgtcaa

SEQ ID NO: 968241 - DNA, 25 bp, Mus musculus
tcatgtgcaggctttgatatgtcaa

SEQ ID NO: 968242 - DNA, 25 bp, Mus musculus
tcatgtgcagtgacaggctttgata

SEQ ID NO: 968243 - DNA, 25 bp, Mus musculus
tcatgtgctaagagagggagagtag

SEQ ID NO: 968244 - DNA, 25 bp, Mus musculus
tcatgtgctaagtgagggagagtag

SEQ ID NO: 968245 - DNA, 25 bp, Mus musculus
tcatgtgtagcacgtttcaaagctg

SEQ ID NO: 968246 - DNA, 25 bp, Mus musculus
tcatgtgtagcaggtttcaaagctg

SEQ ID NO: 968247 - DNA, 25 bp, Mus musculus
tcatgttatatcatgtctccgacac

SEQ ID NO: 968248 - DNA, 25 bp, Mus musculus
tcatgttatatcttgtctccgacac

SEQ ID NO: 968249 - DNA, 25 bp, Mus musculus
tcatgttatgactcaacaaggacat

SEQ ID NO: 968250 - DNA, 25 bp, Mus musculus
tcatgttatgtctcaacaaggacat

SEQ ID NO: 968251 - DNA, 25 bp, Mus musculus
tcatgttggtgacactgaactcaaa

SEQ ID NO: 968252 - DNA, 25 bp, Mus musculus
tcatgttggtgagactgaactcaaa

SEQ ID NO: 968253 - DNA, 25 bp, Mus musculus
tcatgtttaattcttcctgctgctg

SEQ ID NO: 968254 - DNA, 25 bp, Mus musculus
tcatgtttaattgttcctgctgctg

SEQ ID NO: 968255 - DNA, 25 bp, Mus musculus
tcatgtttccagatggcctctatta

SEQ ID NO: 968256 - DNA, 25 bp, Mus musculus
tcatgtttccagttggcctctatta

SEQ ID NO: 968257 - DNA, 25 bp, Mus musculus
tcatgtttggagcccatgacaccac

SEQ ID NO: 968258 - DNA, 25 bp, Mus musculus
tcatgtttggaggccatgacaccac

SEQ ID NO: 968259 - DNA, 25 bp, Mus musculus
tcattaatccagcatccacagggtc

SEQ ID NO: 968260 - DNA, 25 bp, Mus musculus
tcattaatccaggatccacagggtc

SEQ ID NO: 968261 - DNA, 25 bp, Mus musculus
tcattacaaccacagggcatgaaga

SEQ ID NO: 968262 - DNA, 25 bp, Mus musculus
tcattacaaccacagttttcctccc

SEQ ID NO: 968263 - DNA, 25 bp, Mus musculus
tcattacaaccagagggcatgaaga

SEQ ID NO: 968264 - DNA, 25 bp, Mus musculus
tcattacaaccagagttttcctccc

SEQ ID NO: 968265 - DNA, 25 bp, Mus musculus
tcattacgtaatcaagtacttaagc

SEQ ID NO: 968266 - DNA, 25 bp, Mus musculus
tcattacgtaatgaagtacttaagc

SEQ ID NO: 968267 - DNA, 25 bp, Mus musculus
tcattactgatcgaattgaaagaat

SEQ ID NO: 968268 - DNA, 25 bp, Mus musculus
tcattactgatcgatttgaaagaat

SEQ ID NO: 968269 - DNA, 25 bp, Mus musculus
tcattagcaacgctgttcctgggcg

SEQ ID NO: 968270 - DNA, 25 bp, Mus musculus
tcattagcaaggctgttcctgggcg

SEQ ID NO: 968271 - DNA, 25 bp, Mus musculus
tcattatatgatgcagaaacattaa

SEQ ID NO: 968272 - DNA, 25 bp, Mus musculus
tcattatatgatgctgaaacattaa

SEQ ID NO: 968273 - DNA, 25 bp, Mus musculus
tcattatgcatgctcgtatggaaaa

SEQ ID NO: 968274 - DNA, 25 bp, Mus musculus
tcattatgcatgctggtatggaaaa

SEQ ID NO: 968275 - DNA, 25 bp, Mus musculus
tcattattctatcgctagaaaatgc

SEQ ID NO: 968276 - DNA, 25 bp, Mus musculus
tcattattctatggctagaaaatgc

SEQ ID NO: 968277 - DNA, 25 bp, Mus musculus
tcattcaaagaacttaaggccaccg

SEQ ID NO: 968278 - DNA, 25 bp, Mus musculus
tcattcaaagtacttaaggccaccg

SEQ ID NO: 968279 - DNA, 25 bp, Mus musculus
tcattcactcagataacagtgcacc

SEQ ID NO: 968280 - DNA, 25 bp, Mus musculus
tcattcactcagttaacagtgcacc

SEQ ID NO: 968281 - DNA, 25 bp, Mus musculus
tcattcataaagattgaggaagaca

SEQ ID NO: 968282 - DNA, 25 bp, Mus musculus
tcattcataaagtttgaggaagaca

SEQ ID NO: 968283 - DNA, 25 bp, Mus musculus
tcattcattgccaatggcgtggtca

SEQ ID NO: 968284 - DNA, 25 bp, Mus musculus
tcattcattggcaatggcgtggtca

SEQ ID NO: 968285 - DNA, 25 bp, Mus musculus
tcattccaccaccacgtattccaat

SEQ ID NO: 968286 - DNA, 25 bp, Mus musculus
tcattccaccaccaggtattccaat

SEQ ID NO: 968287 - DNA, 25 bp, Mus musculus
tcattcccagctttctgtccagcct

SEQ ID NO: 968288 - DNA, 25 bp, Mus musculus
tcattcccaggtttctgtccagcct

SEQ ID NO: 968289 - DNA, 25 bp, Mus musculus
tcattcctatcaccttgcgtgtgaa

SEQ ID NO: 968290 - DNA, 25 bp, Mus musculus
tcattcctatcagcttgcgtgtgaa

SEQ ID NO: 968291 - DNA, 25 bp, Mus musculus
tcattcgaaacaaggatcgggtgac

SEQ ID NO: 968292 - DNA, 25 bp, Mus musculus
tcattcgaaagaaggatcgggtgac

SEQ ID NO: 968293 - DNA, 25 bp, Mus musculus
tcattcgaattgcgcggcggccagc

SEQ ID NO: 968294 - DNA, 25 bp, Mus musculus
tcattcgaattgggcggcggccagc

SEQ ID NO: 968295 - DNA, 25 bp, Mus musculus
tcattcgagagaaacgtgtggactg

SEQ ID NO: 968296 - DNA, 25 bp, Mus musculus
tcattcgagagaaaggtgtggactg

SEQ ID NO: 968297 - DNA, 25 bp, Mus musculus
tcattcgcaaagcacccatttcgat

SEQ ID NO: 968298 - DNA, 25 bp, Mus musculus
tcattcgcaaaggacccatttcgat

SEQ ID NO: 968299 - DNA, 25 bp, Mus musculus
tcattctcactactgggaagtgtag

SEQ ID NO: 968300 - DNA, 25 bp, Mus musculus
tcattctcactagtgggaagtgtag

SEQ ID NO: 968301 - DNA, 25 bp, Mus musculus
tcattctcatcgccgagctgaatgt

SEQ ID NO: 968302 - DNA, 25 bp, Mus musculus
tcattctcatcggcgagctgaatgt

SEQ ID NO: 968303 - DNA, 25 bp, Mus musculus
tcattctgagcgatggcctggaaga

SEQ ID NO: 968304 - DNA, 25 bp, Mus musculus
tcattctgagggatggcctggaaga

SEQ ID NO: 968305 - DNA, 25 bp, Mus musculus
tcattctgatcctactgtcaaaggt

SEQ ID NO: 968306 - DNA, 25 bp, Mus musculus
tcattctgatcctagtgtcaaaggt

SEQ ID NO: 968307 - DNA, 25 bp, Mus musculus
tcattctgccgaatcgtccaagatg

SEQ ID NO: 968308 - DNA, 25 bp, Mus musculus
tcattctgccgaatggtccaagatg

SEQ ID NO: 968309 - DNA, 25 bp, Mus musculus
tcattcttctggacatcgttgtgct

SEQ ID NO: 968310 - DNA, 25 bp, Mus musculus
tcattcttctggtcatcgttgtgct

SEQ ID NO: 968311 - DNA, 25 bp, Mus musculus
tcattgaaaagaaaatcaaagatga

SEQ ID NO: 968312 - DNA, 25 bp, Mus musculus
tcattgaaaagaaattcaaagatga

SEQ ID NO: 968313 - DNA, 25 bp, Mus musculus
tcattgactgcacgtccctggaaac

SEQ ID NO: 968314 - DNA, 25 bp, Mus musculus
tcattgactgcaggtccctggaaac

SEQ ID NO: 968315 - DNA, 25 bp, Mus musculus
tcattgagggcaccctggacactgc

SEQ ID NO: 968316 - DNA, 25 bp, Mus musculus
tcattgagggcagcctggacactgc

SEQ ID NO: 968317 - DNA, 25 bp, Mus musculus
tcattgatggccagacacgcacccc

SEQ ID NO: 968318 - DNA, 25 bp, Mus musculus
tcattgatgggcagacacgcacccc

SEQ ID NO: 968319 - DNA, 25 bp, Mus musculus
tcattgcagaaacacattagtactg

SEQ ID NO: 968320 - DNA, 25 bp, Mus musculus
tcattgcagaaagacattagtactg

SEQ ID NO: 968321 - DNA, 25 bp, Mus musculus
tcattgccaaaaaccgaagtttgca

SEQ ID NO: 968322 - DNA, 25 bp, Mus musculus
tcattgccaaaaacggaagtttgca

SEQ ID NO: 968323 - DNA, 25 bp, Mus musculus
tcattgctaacacgatgcccatccc

SEQ ID NO: 968324 - DNA, 25 bp, Mus musculus
tcattgctaacacgggatcatgagg

SEQ ID NO: 968325 - DNA, 25 bp, Mus musculus
tcattgctaacaggatgcccatccc

SEQ ID NO: 968326 - DNA, 25 bp, Mus musculus
tcattgctaacaggggatcatgagg

SEQ ID NO: 968327 - DNA, 25 bp, Mus musculus
tcattggagccacgcaggtgcagtc

SEQ ID NO: 968328 - DNA, 25 bp, Mus musculus
tcattggagccacgtacgtacagac

SEQ ID NO: 968329 - DNA, 25 bp, Mus musculus
tcattggagccaggcaggtgcagtc

SEQ ID NO: 968330 - DNA, 25 bp, Mus musculus
tcattggagccaggtacgtacagac

SEQ ID NO: 968331 - DNA, 25 bp, Mus musculus
tcattggattcacgtacagaagcct

SEQ ID NO: 968332 - DNA, 25 bp, Mus musculus
tcattggattcaggtacagaagcct

SEQ ID NO: 968333 - DNA, 25 bp, Mus musculus
tcattggcagctgtaagtgcaacct

SEQ ID NO: 968334 - DNA, 25 bp, Mus musculus
tcattggcaggtgtaagtgcaacct

SEQ ID NO: 968335 - DNA, 25 bp, Mus musculus
tcattggctgggcgacacctactgt

SEQ ID NO: 968336 - DNA, 25 bp, Mus musculus
tcattggctgggggacacctactgt

SEQ ID NO: 968337 - DNA, 25 bp, Mus musculus
tcattggggcagcttcctttggaga

SEQ ID NO: 968338 - DNA, 25 bp, Mus musculus
tcattggggcaggttcctttggaga

SEQ ID NO: 968339 - DNA, 25 bp, Mus musculus
tcattggtacagatgtgggcacagt

SEQ ID NO: 968340 - DNA, 25 bp, Mus musculus
tcattggtacagttgtgggcacagt

SEQ ID NO: 968341 - DNA, 25 bp, Mus musculus
tcattggtgtgaccttccatgtggg

SEQ ID NO: 968342 - DNA, 25 bp, Mus musculus
tcattggtgtgagcttccatgtggg

SEQ ID NO: 968343 - DNA, 25 bp, Mus musculus
tcattgtgcttgatgttcaaataga

SEQ ID NO: 968344 - DNA, 25 bp, Mus musculus
tcattgtgcttgctgcctttattgt

SEQ ID NO: 968345 - DNA, 25 bp, Mus musculus
tcattgtgcttggtgcctttattgt

SEQ ID NO: 968346 - DNA, 25 bp, Mus musculus
tcattgtgcttgttgttcaaataga

SEQ ID NO: 968347 - DNA, 25 bp, Mus musculus
tcattgtgtgaacttgtataaaagc

SEQ ID NO: 968348 - DNA, 25 bp, Mus musculus
tcattgtgtgtacttgtataaaagc

SEQ ID NO: 968349 - DNA, 25 bp, Mus musculus
tcattgtgttttcacatgtccctgg

SEQ ID NO: 968350 - DNA, 25 bp, Mus musculus
tcattgtgttttcagatgtccctgg

SEQ ID NO: 968351 - DNA, 25 bp, Mus musculus
tcattgttggaggacggaacctagc

SEQ ID NO: 968352 - DNA, 25 bp, Mus musculus
tcattgttggaggagggaacctagc

SEQ ID NO: 968353 - DNA, 25 bp, Mus musculus
tcatttaaaatgcatgtgaaatgat

SEQ ID NO: 968354 - DNA, 25 bp, Mus musculus
tcatttaaaatggatgtgaaatgat

SEQ ID NO: 968355 - DNA, 25 bp, Mus musculus
tcatttaatgctcaggggagtacag

SEQ ID NO: 968356 - DNA, 25 bp, Mus musculus
tcatttaatggtcaggggagtacag

SEQ ID NO: 968357 - DNA, 25 bp, Mus musculus
tcatttcactgtcgtggaagggact

SEQ ID NO: 968358 - DNA, 25 bp, Mus musculus
tcatttcactgtggtggaagggact

SEQ ID NO: 968359 - DNA, 25 bp, Mus musculus
tcatttcccacacacctggatttgg

SEQ ID NO: 968360 - DNA, 25 bp, Mus musculus
tcatttcccacagacctggatttgg

SEQ ID NO: 968361 - DNA, 25 bp, Mus musculus
tcatttccgtcctacaaacctcatc

SEQ ID NO: 968362 - DNA, 25 bp, Mus musculus
tcatttccgtcctagaaacctcatc

SEQ ID NO: 968363 - DNA, 25 bp, Mus musculus
tcatttgagctaaacatcttgcgtc

SEQ ID NO: 968364 - DNA, 25 bp, Mus musculus
tcatttgagctaaagatcttgcgtc

SEQ ID NO: 968365 - DNA, 25 bp, Mus musculus
tcatttgaggggctcaggacaaaga

SEQ ID NO: 968366 - DNA, 25 bp, Mus musculus
tcatttgagggggtcaggacaaaga

SEQ ID NO: 968367 - DNA, 25 bp, Mus musculus
tcatttgcagatcactctggaacga

SEQ ID NO: 968368 - DNA, 25 bp, Mus musculus
tcatttgcagttcactctggaacga

SEQ ID NO: 968369 - DNA, 25 bp, Mus musculus
tcatttgctcaacgacgtgggctct

SEQ ID NO: 968370 - DNA, 25 bp, Mus musculus
tcatttgctcaaggacgtgggctct

SEQ ID NO: 968371 - DNA, 25 bp, Mus musculus
tcatttgtcctacatgtaacgtgac

SEQ ID NO: 968372 - DNA, 25 bp, Mus musculus
tcatttgtcctagatgtaacgtgac

SEQ ID NO: 968373 - DNA, 25 bp, Mus musculus
tcattttccaatatcgctttatcct

SEQ ID NO: 968374 - DNA, 25 bp, Mus musculus
tcattttccaatatggctttatcct

SEQ ID NO: 968375 - DNA, 25 bp, Mus musculus
tcattttgaaagatgtccttcaaga

SEQ ID NO: 968376 - DNA, 25 bp, Mus musculus
tcattttgaaagttgtccttcaaga

SEQ ID NO: 968377 - DNA, 25 bp, Mus musculus
tcattttgtgcaccttacctgtggt

SEQ ID NO: 968378 - DNA, 25 bp, Mus musculus
tcattttgtgcacgatctgctgatg

SEQ ID NO: 968379 - DNA, 25 bp, Mus musculus
tcattttgtgcagcttacctgtggt

SEQ ID NO: 968380 - DNA, 25 bp, Mus musculus
tcattttgtgcaggatctgctgatg

SEQ ID NO: 968381 - DNA, 25 bp, Mus musculus
tcatttttaatcagtctgttatctc

SEQ ID NO: 968382 - DNA, 25 bp, Mus musculus
tcatttttaatctgtctgttatctc

SEQ ID NO: 968383 - DNA, 25 bp, Mus musculus
tccaaaaacacgccatcttgagtag

SEQ ID NO: 968384 - DNA, 25 bp, Mus musculus
tccaaaaacacggcatcttgagtag

SEQ ID NO: 968385 - DNA, 25 bp, Mus musculus
tccaaaaacttgaccctcatcaaaa

SEQ ID NO: 968386 - DNA, 25 bp, Mus musculus
tccaaaaacttgtccctcatcaaaa

SEQ ID NO: 968387 - DNA, 25 bp, Mus musculus
tccaaaaagccgaactgctttgagc

SEQ ID NO: 968388 - DNA, 25 bp, Mus musculus
tccaaaaagccgtactgctttgagc

SEQ ID NO: 968389 - DNA, 25 bp, Mus musculus
tccaaaaccattaacgtgtcatatg

SEQ ID NO: 968390 - DNA, 25 bp, Mus musculus
tccaaaaccattaaggtgtcatatg

SEQ ID NO: 968391 - DNA, 25 bp, Mus musculus
tccaaaagagagtcctgccatagat

SEQ ID NO: 968392 - DNA, 25 bp, Mus musculus
tccaaaagagtgtcctgccatagat

SEQ ID NO: 968393 - DNA, 25 bp, Mus musculus
tccaaaatcaacaacacccacgccc

SEQ ID NO: 968394 - DNA, 25 bp, Mus musculus
tccaaaatcaactacacccacgccc

SEQ ID NO: 968395 - DNA, 25 bp, Mus musculus
tccaaacaagagcaagatttggagg

SEQ ID NO: 968396 - DNA, 25 bp, Mus musculus
tccaaacaagagcatgatttggagg

SEQ ID NO: 968397 - DNA, 25 bp, Mus musculus
tccaaacactgacacggatcaagtt

SEQ ID NO: 968398 - DNA, 25 bp, Mus musculus
tccaaacactgacagggatcaagtt

SEQ ID NO: 968399 - DNA, 25 bp, Mus musculus
tccaaacttgagcaaatctacgctc

SEQ ID NO: 968400 - DNA, 25 bp, Mus musculus
tccaaacttgaggaaatctacgctc

SEQ ID NO: 968401 - DNA, 25 bp, Mus musculus
tccaaagagaagcaaaagtgatagt

SEQ ID NO: 968402 - DNA, 25 bp, Mus musculus
tccaaagagaaggaaaagtgatagt

SEQ ID NO: 968403 - DNA, 25 bp, Mus musculus
tccaaagccctgcatttcatcaaga

SEQ ID NO: 968404 - DNA, 25 bp, Mus musculus
tccaaagccctggatttcatcaaga

SEQ ID NO: 968405 - DNA, 25 bp, Mus musculus
tccaaaggaaacagctgtcgagagc

SEQ ID NO: 968406 - DNA, 25 bp, Mus musculus
tccaaaggaaactgctgtcgagagc

SEQ ID NO: 968407 - DNA, 25 bp, Mus musculus
tccaaaggattgcaacttctggaga

SEQ ID NO: 968408 - DNA, 25 bp, Mus musculus
tccaaaggattggaacttctggaga

SEQ ID NO: 968409 - DNA, 25 bp, Mus musculus
tccaaaggcaaacttggttctacgg

SEQ ID NO: 968410 - DNA, 25 bp, Mus musculus
tccaaaggcaaagttggttctacgg

SEQ ID NO: 968411 - DNA, 25 bp, Mus musculus
tccaaaggcagcaccttcctgcctc

SEQ ID NO: 968412 - DNA, 25 bp, Mus musculus
tccaaaggcagctccttcctgcctc

SEQ ID NO: 968413 - DNA, 25 bp, Mus musculus
tccaaagtcgctttctgtatgcaaa

SEQ ID NO: 968414 - DNA, 25 bp, Mus musculus
tccaaagtcggtttctgtatgcaaa

SEQ ID NO: 968415 - DNA, 25 bp, Mus musculus
tccaaataacacagacacgctttcc

SEQ ID NO: 968416 - DNA, 25 bp, Mus musculus
tccaaataacactgacacgctttcc

SEQ ID NO: 968417 - DNA, 25 bp, Mus musculus
tccaaatccttgctcgtctgtgcgt

SEQ ID NO: 968418 - DNA, 25 bp, Mus musculus
tccaaatccttgctggtctgtgcgt

SEQ ID NO: 968419 - DNA, 25 bp, Mus musculus
tccaaattatctgccaccaaaagcc

SEQ ID NO: 968420 - DNA, 25 bp, Mus musculus
tccaaattatgtgccaccaaaagcc

SEQ ID NO: 968421 - DNA, 25 bp, Mus musculus
tccaacaaacaactttgcacggata

SEQ ID NO: 968422 - DNA, 25 bp, Mus musculus
tccaacaaacaagtttgcacggata

SEQ ID NO: 968423 - DNA, 25 bp, Mus musculus
tccaacaaatgtcgtccgtgcttct

SEQ ID NO: 968424 - DNA, 25 bp, Mus musculus
tccaacaaatgtggtccgtgcttct

SEQ ID NO: 968425 - DNA, 25 bp, Mus musculus
tccaacaacaatgacagtgctgcaa

SEQ ID NO: 968426 - DNA, 25 bp, Mus musculus
tccaacaacaatgagagtgctgcaa

SEQ ID NO: 968427 - DNA, 25 bp, Mus musculus
tccaacaacatcaaagaaaaattca

SEQ ID NO: 968428 - DNA, 25 bp, Mus musculus
tccaacaacatctaagaaaaattca

SEQ ID NO: 968429 - DNA, 25 bp, Mus musculus
tccaacaaggatgcagctctaatgg

SEQ ID NO: 968430 - DNA, 25 bp, Mus musculus
tccaacaaggttgcagctctaatgg

SEQ ID NO: 968431 - DNA, 25 bp, Mus musculus
tccaacacagccctgttgaccactg

SEQ ID NO: 968432 - DNA, 25 bp, Mus musculus
tccaacacagccgtgttgaccactg

SEQ ID NO: 968433 - DNA, 25 bp, Mus musculus
tccaacaccccgctgctgccttcct

SEQ ID NO: 968434 - DNA, 25 bp, Mus musculus
tccaacaccccgcttctcttgcctc

SEQ ID NO: 968435 - DNA, 25 bp, Mus musculus
tccaacaccccggtgctgccttcct

SEQ ID NO: 968436 - DNA, 25 bp, Mus musculus
tccaacaccccggttctcttgcctc

SEQ ID NO: 968437 - DNA, 25 bp, Mus musculus
tccaacatcatgcaagttaaaatct

SEQ ID NO: 968438 - DNA, 25 bp, Mus musculus
tccaacatcatggaagttaaaatct

SEQ ID NO: 968439 - DNA, 25 bp, Mus musculus
tccaacatggtgcatgtattcatgt

SEQ ID NO: 968440 - DNA, 25 bp, Mus musculus
tccaacatggtggatgtattcatgt

SEQ ID NO: 968441 - DNA, 25 bp, Mus musculus
tccaaccaagccatcctcggagatg

SEQ ID NO: 968442 - DNA, 25 bp, Mus musculus
tccaaccaagctatcatgtttgtac

SEQ ID NO: 968443 - DNA, 25 bp, Mus musculus
tccaaccaaggcatcctcggagatg

SEQ ID NO: 968444 - DNA, 25 bp, Mus musculus
tccaaccaaggtatcatgtttgtac

SEQ ID NO: 968445 - DNA, 25 bp, Mus musculus
tccaaccaccagatttggttcatct

SEQ ID NO: 968446 - DNA, 25 bp, Mus musculus
tccaaccaccagttttggttcatct

SEQ ID NO: 968447 - DNA, 25 bp, Mus musculus
tccaaccagaaacagtccaaagctg

SEQ ID NO: 968448 - DNA, 25 bp, Mus musculus
tccaaccagaaagagtccaaagctg

SEQ ID NO: 968449 - DNA, 25 bp, Mus musculus
tccaaccagctgcctgaagccatca

SEQ ID NO: 968450 - DNA, 25 bp, Mus musculus
tccaaccagctggctgaagccatca

SEQ ID NO: 968451 - DNA, 25 bp, Mus musculus
tccaaccgcagagacgaactggccc

SEQ ID NO: 968452 - DNA, 25 bp, Mus musculus
tccaaccgcagagaggaactggccc

SEQ ID NO: 968453 - DNA, 25 bp, Mus musculus
tccaacctacaacggcaagatgaag

SEQ ID NO: 968454 - DNA, 25 bp, Mus musculus
tccaacctacaagggcaagatgaag

SEQ ID NO: 968455 - DNA, 25 bp, Mus musculus
tccaacgacaatcagcgccttgctc

SEQ ID NO: 968456 - DNA, 25 bp, Mus musculus
tccaacgacaatgatacactaaaga

SEQ ID NO: 968457 - DNA, 25 bp, Mus musculus
tccaacgacattcagcgccttgctc

SEQ ID NO: 968458 - DNA, 25 bp, Mus musculus
tccaacgacattgatacactaaaga

SEQ ID NO: 968459 - DNA, 25 bp, Mus musculus
tccaacgagctacatgatcccgatg

SEQ ID NO: 968460 - DNA, 25 bp, Mus musculus
tccaacgagctagatgatcccgatg

SEQ ID NO: 968461 - DNA, 25 bp, Mus musculus
tccaacgatgagaaagagttcctag

SEQ ID NO: 968462 - DNA, 25 bp, Mus musculus
tccaacgatgtgaaagagttcctag

SEQ ID NO: 968463 - DNA, 25 bp, Mus musculus
tccaacgtcattgacgtggagcatc

SEQ ID NO: 968464 - DNA, 25 bp, Mus musculus
tccaacgtcattgaggtggagcatc

SEQ ID NO: 968465 - DNA, 25 bp, Mus musculus
tccaacgtggaaccagcctgtgatt

SEQ ID NO: 968466 - DNA, 25 bp, Mus musculus
tccaacgtggaacccctctgctcat

SEQ ID NO: 968467 - DNA, 25 bp, Mus musculus
tccaacgtggaagcagcctgtgatt

SEQ ID NO: 968468 - DNA, 25 bp, Mus musculus
tccaacgtggaagccctctgctcat

SEQ ID NO: 968469 - DNA, 25 bp, Mus musculus
tccaactaccaccactacatagtga

SEQ ID NO: 968470 - DNA, 25 bp, Mus musculus
tccaactaccaccagtacatagtga

SEQ ID NO: 968471 - DNA, 25 bp, Mus musculus
tccaactaccagctgtggcacgagc

SEQ ID NO: 968472 - DNA, 25 bp, Mus musculus
tccaactaccaggtgtggcacgagc

SEQ ID NO: 968473 - DNA, 25 bp, Mus musculus
tccaactcagcttctcggtaaatcc

SEQ ID NO: 968474 - DNA, 25 bp, Mus musculus
tccaactcaggttctcggtaaatcc

SEQ ID NO: 968475 - DNA, 25 bp, Mus musculus
tccaactcttggcattgaccttggc

SEQ ID NO: 968476 - DNA, 25 bp, Mus musculus
tccaactcttgggattgaccttggc

SEQ ID NO: 968477 - DNA, 25 bp, Mus musculus
tccaactgtctaaattgatcaggga

SEQ ID NO: 968478 - DNA, 25 bp, Mus musculus
tccaactgtctatattgatcaggga

SEQ ID NO: 968479 - DNA, 25 bp, Mus musculus
tccaactttcctcctgagactggac

SEQ ID NO: 968480 - DNA, 25 bp, Mus musculus
tccaactttcgtcctgagactggac

SEQ ID NO: 968481 - DNA, 25 bp, Mus musculus
tccaagaaagctgcttacagacaca

SEQ ID NO: 968482 - DNA, 25 bp, Mus musculus
tccaagaaaggtgcttacagacaca

SEQ ID NO: 968483 - DNA, 25 bp, Mus musculus
tccaagaactgcagaattgagctcc

SEQ ID NO: 968484 - DNA, 25 bp, Mus musculus
tccaagaactgcagtattgagctcc

SEQ ID NO: 968485 - DNA, 25 bp, Mus musculus
tccaagaagaggaactttgtagctg

SEQ ID NO: 968486 - DNA, 25 bp, Mus musculus
tccaagaagaggaagtttgtagctg

SEQ ID NO: 968487 - DNA, 25 bp, Mus musculus
tccaagaatgctcctggcactgtag

SEQ ID NO: 968488 - DNA, 25 bp, Mus musculus
tccaagaatggtcctggcactgtag

SEQ ID NO: 968489 - DNA, 25 bp, Mus musculus
tccaagagaaagatctcctgggctc

SEQ ID NO: 968490 - DNA, 25 bp, Mus musculus
tccaagagaaagttctcctgggctc

SEQ ID NO: 968491 - DNA, 25 bp, Mus musculus
tccaagagataagaagtccatcatg

SEQ ID NO: 968492 - DNA, 25 bp, Mus musculus
tccaagagataagatgtccatcatg

SEQ ID NO: 968493 - DNA, 25 bp, Mus musculus
tccaagaggaaacacaaagtcagca

SEQ ID NO: 968494 - DNA, 25 bp, Mus musculus
tccaagaggaaacacagctacaacc

SEQ ID NO: 968495 - DNA, 25 bp, Mus musculus
tccaagaggaaacgtaccagcagtg

SEQ ID NO: 968496 - DNA, 25 bp, Mus musculus
tccaagaggaaagacaaagtcagca

SEQ ID NO: 968497 - DNA, 25 bp, Mus musculus
tccaagaggaaagacagctacaacc

SEQ ID NO: 968498 - DNA, 25 bp, Mus musculus
tccaagaggaaaggtaccagcagtg

SEQ ID NO: 968499 - DNA, 25 bp, Mus musculus
tccaagagtcagatccaggctttta

SEQ ID NO: 968500 - DNA, 25 bp, Mus musculus
tccaagagtcagttccaggctttta

SEQ ID NO: 968501 - DNA, 25 bp, Mus musculus
tccaagagtgagcccaggcccgagt

SEQ ID NO: 968502 - DNA, 25 bp, Mus musculus
tccaagagtgaggccaggcccgagt

SEQ ID NO: 968503 - DNA, 25 bp, Mus musculus
tccaagatgagacacgagacaatca

SEQ ID NO: 968504 - DNA, 25 bp, Mus musculus
tccaagatgagacaggagacaatca

SEQ ID NO: 968505 - DNA, 25 bp, Mus musculus
tccaagatgatgcccacaccagtta

SEQ ID NO: 968506 - DNA, 25 bp, Mus musculus
tccaagatgatggccacaccagtta

SEQ ID NO: 968507 - DNA, 25 bp, Mus musculus
tccaagatgtctacttagtgatgga

SEQ ID NO: 968508 - DNA, 25 bp, Mus musculus
tccaagatgtgtacttagtgatgga

SEQ ID NO: 968509 - DNA, 25 bp, Mus musculus
tccaagcaagcgcccctggcttgct

SEQ ID NO: 968510 - DNA, 25 bp, Mus musculus
tccaagcaagggcccctggcttgct

SEQ ID NO: 968511 - DNA, 25 bp, Mus musculus
tccaagcacatgaatgaaacaagcc

SEQ ID NO: 968512 - DNA, 25 bp, Mus musculus
tccaagcacatgtatgaaacaagcc

SEQ ID NO: 968513 - DNA, 25 bp, Mus musculus
tccaagcacgccgcagcagcctgca

SEQ ID NO: 968514 - DNA, 25 bp, Mus musculus
tccaagcacgcggacagcttcgtgg

SEQ ID NO: 968515 - DNA, 25 bp, Mus musculus
tccaagcacggcgcagcagcctgca

SEQ ID NO: 968516 - DNA, 25 bp, Mus musculus
tccaagcacggggacagcttcgtgg

SEQ ID NO: 968517 - DNA, 25 bp, Mus musculus
tccaagccagagcccgccactaagc

SEQ ID NO: 968518 - DNA, 25 bp, Mus musculus
tccaagccagtgcccgccactaagc

SEQ ID NO: 968519 - DNA, 25 bp, Mus musculus
tccaagcccactcgcgctgacctgt

SEQ ID NO: 968520 - DNA, 25 bp, Mus musculus
tccaagcccactggcgctgacctgt

SEQ ID NO: 968521 - DNA, 25 bp, Mus musculus
tccaagcctgagcactgggacaagc

SEQ ID NO: 968522 - DNA, 25 bp, Mus musculus
tccaagcctgagcactgggatgaag

SEQ ID NO: 968523 - DNA, 25 bp, Mus musculus
tccaagcctgaggactgggacaagc

SEQ ID NO: 968524 - DNA, 25 bp, Mus musculus
tccaagcctgaggactgggatgaag

SEQ ID NO: 968525 - DNA, 25 bp, Mus musculus
tccaagctgtaacgtgctcgtcctc

SEQ ID NO: 968526 - DNA, 25 bp, Mus musculus
tccaagctgtaaggtgctcgtcctc

SEQ ID NO: 968527 - DNA, 25 bp, Mus musculus
tccaaggaagacttactggacataa

SEQ ID NO: 968528 - DNA, 25 bp, Mus musculus
tccaaggaagactttctggacataa

SEQ ID NO: 968529 - DNA, 25 bp, Mus musculus
tccaaggcaaagctgttgaacgagg

SEQ ID NO: 968530 - DNA, 25 bp, Mus musculus
tccaaggcaaaggtgttgaacgagg

SEQ ID NO: 968531 - DNA, 25 bp, Mus musculus
tccaaggcccagctggtgaccatag

SEQ ID NO: 968532 - DNA, 25 bp, Mus musculus
tccaaggcccaggtggtgaccatag

SEQ ID NO: 968533 - DNA, 25 bp, Mus musculus
tccaaggctaagctgatttacgtgg

SEQ ID NO: 968534 - DNA, 25 bp, Mus musculus
tccaaggctaaggtgatttacgtgg

SEQ ID NO: 968535 - DNA, 25 bp, Mus musculus
tccaagggcctgcacggccggctcc

SEQ ID NO: 968536 - DNA, 25 bp, Mus musculus
tccaagggcctgcagggccggctcc

SEQ ID NO: 968537 - DNA, 25 bp, Mus musculus
tccaagggggtgcctgtgggccgaa

SEQ ID NO: 968538 - DNA, 25 bp, Mus musculus
tccaagggggtggctgtgggccgaa

SEQ ID NO: 968539 - DNA, 25 bp, Mus musculus
tccaagtaccaacaagaccaggtgg

SEQ ID NO: 968540 - DNA, 25 bp, Mus musculus
tccaagtaccaacatgaccaggtgg

SEQ ID NO: 968541 - DNA, 25 bp, Mus musculus
tccaagtataagctggctctcgagg

SEQ ID NO: 968542 - DNA, 25 bp, Mus musculus
tccaagtataaggtggctctcgagg

SEQ ID NO: 968543 - DNA, 25 bp, Mus musculus
tccaagtatgaaggaggagtaaaaa

SEQ ID NO: 968544 - DNA, 25 bp, Mus musculus
tccaagtatgaaggaggagtagaaa

SEQ ID NO: 968545 - DNA, 25 bp, Mus musculus
tccaagtatgtaggaggagtaaaaa

SEQ ID NO: 968546 - DNA, 25 bp, Mus musculus
tccaagtatgtaggaggagtagaaa

SEQ ID NO: 968547 - DNA, 25 bp, Mus musculus
tccaagtcgcttcaccctttaccct

SEQ ID NO: 968548 - DNA, 25 bp, Mus musculus
tccaagtcgcttcagcctttaccct

SEQ ID NO: 968549 - DNA, 25 bp, Mus musculus
tccaagtcgtcgccaaccagcccca

SEQ ID NO: 968550 - DNA, 25 bp, Mus musculus
tccaagtcgtcggcaaccagcccca

SEQ ID NO: 968551 - DNA, 25 bp, Mus musculus
tccaagtctcagctggaggaccccc

SEQ ID NO: 968552 - DNA, 25 bp, Mus musculus
tccaagtctcaggtggaggaccccc

SEQ ID NO: 968553 - DNA, 25 bp, Mus musculus
tccaagtgggagaacgtgcagcagc

SEQ ID NO: 968554 - DNA, 25 bp, Mus musculus
tccaagtgggagaaggtgcagcagc

SEQ ID NO: 968555 - DNA, 25 bp, Mus musculus
tccaataaagccatctacatccgag

SEQ ID NO: 968556 - DNA, 25 bp, Mus musculus
tccaataaagccatgtacatccgag

SEQ ID NO: 968557 - DNA, 25 bp, Mus musculus
tccaatatcatgcggggatatccct

SEQ ID NO: 968558 - DNA, 25 bp, Mus musculus
tccaatatcatggggggatatccct

SEQ ID NO: 968559 - DNA, 25 bp, Mus musculus
tccaatctgtcttgtcaaaacgcag

SEQ ID NO: 968560 - DNA, 25 bp, Mus musculus
tccaatctgtgttgtcaaaacgcag

SEQ ID NO: 968561 - DNA, 25 bp, Mus musculus
tccaatgaggccaatattcatgatt

SEQ ID NO: 968562 - DNA, 25 bp, Mus musculus
tccaatgagggcaatattcatgatt

SEQ ID NO: 968563 - DNA, 25 bp, Mus musculus
tccaatgcagcctgtggcatctcta

SEQ ID NO: 968564 - DNA, 25 bp, Mus musculus
tccaatgcaggctgtggcatctcta

SEQ ID NO: 968565 - DNA, 25 bp, Mus musculus
tccaatgccgagaacaaggaacttt

SEQ ID NO: 968566 - DNA, 25 bp, Mus musculus
tccaatgccgagaagaaggaacttt

SEQ ID NO: 968567 - DNA, 25 bp, Mus musculus
tccaatgcctttttctgataggttg

SEQ ID NO: 968568 - DNA, 25 bp, Mus musculus
tccaatgcctttttgtgataggttg

SEQ ID NO: 968569 - DNA, 25 bp, Mus musculus
tccaatgctagcaaaggccgagaag

SEQ ID NO: 968570 - DNA, 25 bp, Mus musculus
tccaatgctagcaatggccgagaag

SEQ ID NO: 968571 - DNA, 25 bp, Mus musculus
tccaatgctgctgtctctgtcaatg

SEQ ID NO: 968572 - DNA, 25 bp, Mus musculus
tccaatgctggtgtctctgtcaatg

SEQ ID NO: 968573 - DNA, 25 bp, Mus musculus
tccaatgtcatcgacttgctggacg

SEQ ID NO: 968574 - DNA, 25 bp, Mus musculus
tccaatgtcatcgagttgctggacg

SEQ ID NO: 968575 - DNA, 25 bp, Mus musculus
tccaatgtggcaacatcagttatcc

SEQ ID NO: 968576 - DNA, 25 bp, Mus musculus
tccaatgtgggaacatcagttatcc

SEQ ID NO: 968577 - DNA, 25 bp, Mus musculus
tccaatttgcagctagctatccgag

SEQ ID NO: 968578 - DNA, 25 bp, Mus musculus
tccaatttgcaggtagctatccgag

SEQ ID NO: 968579 - DNA, 25 bp, Mus musculus
tccacaaagacgcggttacagggat

SEQ ID NO: 968580 - DNA, 25 bp, Mus musculus
tccacaaagaggcggttacagggat

SEQ ID NO: 968581 - DNA, 25 bp, Mus musculus
tccacaacagcaaacacactgggga

SEQ ID NO: 968582 - DNA, 25 bp, Mus musculus
tccacaacaggaaacacactgggga

SEQ ID NO: 968583 - DNA, 25 bp, Mus musculus
tccacaactgcacgctgtttggtct

SEQ ID NO: 968584 - DNA, 25 bp, Mus musculus
tccacaactgcaggctgtttggtct

SEQ ID NO: 968585 - DNA, 25 bp, Mus musculus
tccacaagatagcagtaggtgccat

SEQ ID NO: 968586 - DNA, 25 bp, Mus musculus
tccacaagataggagtaggtgccat

SEQ ID NO: 968587 - DNA, 25 bp, Mus musculus
tccacaatgcagcgatcagctcctg

SEQ ID NO: 968588 - DNA, 25 bp, Mus musculus
tccacaatgcagggatcagctcctg

SEQ ID NO: 968589 - DNA, 25 bp, Mus musculus
tccacaccccagcttttatgtatga

SEQ ID NO: 968590 - DNA, 25 bp, Mus musculus
tccacaccccaggttttatgtatga

SEQ ID NO: 968591 - DNA, 25 bp, Mus musculus
tccacacgagaggctcacaatattg

SEQ ID NO: 968592 - DNA, 25 bp, Mus musculus
tccacacgagcagccagatgttaaa

SEQ ID NO: 968593 - DNA, 25 bp, Mus musculus
tccacacgaggagccagatgttaaa

SEQ ID NO: 968594 - DNA, 25 bp, Mus musculus
tccacacgagtggctcacaatattg

SEQ ID NO: 968595 - DNA, 25 bp, Mus musculus
tccacactacagcctccttcctgac

SEQ ID NO: 968596 - DNA, 25 bp, Mus musculus
tccacactacagctctgtaactggt

SEQ ID NO: 968597 - DNA, 25 bp, Mus musculus
tccacactacaggctccttcctgac

SEQ ID NO: 968598 - DNA, 25 bp, Mus musculus
tccacactacaggtctgtaactggt

SEQ ID NO: 968599 - DNA, 25 bp, Mus musculus
tccacactcaagatcaattctctcc

SEQ ID NO: 968600 - DNA, 25 bp, Mus musculus
tccacactcaagttcaattctctcc

SEQ ID NO: 968601 - DNA, 25 bp, Mus musculus
tccacactgctgagcgccatcacgt

SEQ ID NO: 968602 - DNA, 25 bp, Mus musculus
tccacactgctgtgcgccatcacgt

SEQ ID NO: 968603 - DNA, 25 bp, Mus musculus
tccacagaaacacgctttgctctgc

SEQ ID NO: 968604 - DNA, 25 bp, Mus musculus
tccacagaaacaggctttgctctgc

SEQ ID NO: 968605 - DNA, 25 bp, Mus musculus
tccacagatgtgcggaacagtgctg

SEQ ID NO: 968606 - DNA, 25 bp, Mus musculus
tccacagatgtggggaacagtgctg

SEQ ID NO: 968607 - DNA, 25 bp, Mus musculus
tccacagcacatatggtcagaaaac

SEQ ID NO: 968608 - DNA, 25 bp, Mus musculus
tccacagcacatttggtcagaaaac

SEQ ID NO: 968609 - DNA, 25 bp, Mus musculus
tccacagcagcattccccctctgtg

SEQ ID NO: 968610 - DNA, 25 bp, Mus musculus
tccacagcaggattccccctctgtg

SEQ ID NO: 968611 - DNA, 25 bp, Mus musculus
tccacagccgcagagtcaaacacaa

SEQ ID NO: 968612 - DNA, 25 bp, Mus musculus
tccacagccggagagtcaaacacaa

SEQ ID NO: 968613 - DNA, 25 bp, Mus musculus
tccacaggagtgctcccgtaggcct

SEQ ID NO: 968614 - DNA, 25 bp, Mus musculus
tccacaggagtggtcccgtaggcct

SEQ ID NO: 968615 - DNA, 25 bp, Mus musculus
tccacaggatggctcccagcctgca

SEQ ID NO: 968616 - DNA, 25 bp, Mus musculus
tccacaggatgggtcccagcctgca

SEQ ID NO: 968617 - DNA, 25 bp, Mus musculus
tccacaggcaagcttgtctacttca

SEQ ID NO: 968618 - DNA, 25 bp, Mus musculus
tccacaggcaaggttgtctacttca

SEQ ID NO: 968619 - DNA, 25 bp, Mus musculus
tccacaggtgtgaacatattgacga

SEQ ID NO: 968620 - DNA, 25 bp, Mus musculus
tccacaggtgtgaagatattgacga

SEQ ID NO: 968621 - DNA, 25 bp, Mus musculus
tccacagtcactggagagtcaggct

SEQ ID NO: 968622 - DNA, 25 bp, Mus musculus
tccacagtcagtggagagtcaggct

SEQ ID NO: 968623 - DNA, 25 bp, Mus musculus
tccacataccctaaccagggagtgg

SEQ ID NO: 968624 - DNA, 25 bp, Mus musculus
tccacataccctaacgagtggaaga

SEQ ID NO: 968625 - DNA, 25 bp, Mus musculus
tccacataccctaacggagtggaga

SEQ ID NO: 968626 - DNA, 25 bp, Mus musculus
tccacataccctaactaggagtgga

SEQ ID NO: 968627 - DNA, 25 bp, Mus musculus
tccacataccctaagcagggagtgg

SEQ ID NO: 968628 - DNA, 25 bp, Mus musculus
tccacataccctaaggagtggaaga

SEQ ID NO: 968629 - DNA, 25 bp, Mus musculus
tccacataccctaagggagtggaga

SEQ ID NO: 968630 - DNA, 25 bp, Mus musculus
tccacataccctaagtaggagtgga

SEQ ID NO: 968631 - DNA, 25 bp, Mus musculus
tccacatatgcaacagccttacaga

SEQ ID NO: 968632 - DNA, 25 bp, Mus musculus
tccacatatggaacagccttacaga

SEQ ID NO: 968633 - DNA, 25 bp, Mus musculus
tccacatatggtaacagccttacag

SEQ ID NO: 968634 - DNA, 25 bp, Mus musculus
tccacatatggtaagagccttacag

SEQ ID NO: 968635 - DNA, 25 bp, Mus musculus
tccacatctgccacagcggacagtt

SEQ ID NO: 968636 - DNA, 25 bp, Mus musculus
tccacatctggcacagcggacagtt

SEQ ID NO: 968637 - DNA, 25 bp, Mus musculus
tccacatgccagcggatgccccttt

SEQ ID NO: 968638 - DNA, 25 bp, Mus musculus
tccacatgccaggggatgccccttt

SEQ ID NO: 968639 - DNA, 25 bp, Mus musculus
tccacattagagactggctctgaat

SEQ ID NO: 968640 - DNA, 25 bp, Mus musculus
tccacattagtgactggctctgaat

SEQ ID NO: 968641 - DNA, 25 bp, Mus musculus
tccacatttgagaacggccggtttg

SEQ ID NO: 968642 - DNA, 25 bp, Mus musculus
tccacatttgagagtgaagtgaggg

SEQ ID NO: 968643 - DNA, 25 bp, Mus musculus
tccacatttgagtacggccggtttg

SEQ ID NO: 968644 - DNA, 25 bp, Mus musculus
tccacatttgagtgtgaagtgaggg

SEQ ID NO: 968645 - DNA, 25 bp, Mus musculus
tccaccaaccagcagatcatacatt

SEQ ID NO: 968646 - DNA, 25 bp, Mus musculus
tccaccaaccagcttagcagatcat

SEQ ID NO: 968647 - DNA, 25 bp, Mus musculus
tccaccaaccaggagatcatacatt

SEQ ID NO: 968648 - DNA, 25 bp, Mus musculus
tccaccaaccaggttagcagatcat

SEQ ID NO: 968649 - DNA, 25 bp, Mus musculus
tccaccaagcagccatctcggaaac

SEQ ID NO: 968650 - DNA, 25 bp, Mus musculus
tccaccaagcaggcatctcggaaac

SEQ ID NO: 968651 - DNA, 25 bp, Mus musculus
tccaccacacttcccggtctgtatg

SEQ ID NO: 968652 - DNA, 25 bp, Mus musculus
tccaccacacttccgggtctgtatg

SEQ ID NO: 968653 - DNA, 25 bp, Mus musculus
tccaccacagataactctcttcact

SEQ ID NO: 968654 - DNA, 25 bp, Mus musculus
tccaccacagttaactctcttcact

SEQ ID NO: 968655 - DNA, 25 bp, Mus musculus
tccaccacctggatcgagaactcgc

SEQ ID NO: 968656 - DNA, 25 bp, Mus musculus
tccaccacctggttcgagaactcgc

SEQ ID NO: 968657 - DNA, 25 bp, Mus musculus
tccaccatcgtcagccaatggctcg

SEQ ID NO: 968658 - DNA, 25 bp, Mus musculus
tccaccatcgtcaggcaatggctcg

SEQ ID NO: 968659 - DNA, 25 bp, Mus musculus
tccaccatttcacagtcagcttgcg

SEQ ID NO: 968660 - DNA, 25 bp, Mus musculus
tccaccatttcagagtcagcttgcg

SEQ ID NO: 968661 - DNA, 25 bp, Mus musculus
tccaccccagactctgcagaggacg

SEQ ID NO: 968662 - DNA, 25 bp, Mus musculus
tccaccccagtctctgcagaggacg

SEQ ID NO: 968663 - DNA, 25 bp, Mus musculus
tccacccttgagacaagtccatcat

SEQ ID NO: 968664 - DNA, 25 bp, Mus musculus
tccacccttgagtcaagtccatcat

SEQ ID NO: 968665 - DNA, 25 bp, Mus musculus
tccaccgcccgacactgtgtttcct

SEQ ID NO: 968666 - DNA, 25 bp, Mus musculus
tccaccgcccgagactgtgtttcct

SEQ ID NO: 968667 - DNA, 25 bp, Mus musculus
tccacctactcacacagaattgaag

SEQ ID NO: 968668 - DNA, 25 bp, Mus musculus
tccacctactcacagagaattgaag

SEQ ID NO: 968669 - DNA, 25 bp, Mus musculus
tccacctaggcactgccgcttcgct

SEQ ID NO: 968670 - DNA, 25 bp, Mus musculus
tccacctagggactgccgcttcgct

SEQ ID NO: 968671 - DNA, 25 bp, Mus musculus
tccacctatgaggacgccttaagat

SEQ ID NO: 968672 - DNA, 25 bp, Mus musculus
tccacctatgaggaggccttaagat

SEQ ID NO: 968673 - DNA, 25 bp, Mus musculus
tccacctccacaccacaagagcaag

SEQ ID NO: 968674 - DNA, 25 bp, Mus musculus
tccacctccacagcacaagagcaag

SEQ ID NO: 968675 - DNA, 25 bp, Mus musculus
tccacctccgaacccgcaacagacg

SEQ ID NO: 968676 - DNA, 25 bp, Mus musculus
tccacctccgaagccgcaacagacg

SEQ ID NO: 968677 - DNA, 25 bp, Mus musculus
tccacctgctcactcaaccctctgc

SEQ ID NO: 968678 - DNA, 25 bp, Mus musculus
tccacctgctcactgaaccctctgc

SEQ ID NO: 968679 - DNA, 25 bp, Mus musculus
tccaccttcaacagcctgggcggtc

SEQ ID NO: 968680 - DNA, 25 bp, Mus musculus
tccaccttcaacaggctgggcggtc

SEQ ID NO: 968681 - DNA, 25 bp, Mus musculus
tccaccttcaatcgctacaaactgg

SEQ ID NO: 968682 - DNA, 25 bp, Mus musculus
tccaccttcaatggctacaaactgg

SEQ ID NO: 968683 - DNA, 25 bp, Mus musculus
tccaccttctctctcttcctcctgg

SEQ ID NO: 968684 - DNA, 25 bp, Mus musculus
tccaccttctctgtcttcctcctgg

SEQ ID NO: 968685 - DNA, 25 bp, Mus musculus
tccaccttgtcaaagtggccctgct

SEQ ID NO: 968686 - DNA, 25 bp, Mus musculus
tccaccttgtcatagtggccctgct

SEQ ID NO: 968687 - DNA, 25 bp, Mus musculus
tccacgccacttctcggcagctctg

SEQ ID NO: 968688 - DNA, 25 bp, Mus musculus
tccacgccacttgtcggcagctctg

SEQ ID NO: 968689 - DNA, 25 bp, Mus musculus
tccacgccatcaaaaatgaagcaca

SEQ ID NO: 968690 - DNA, 25 bp, Mus musculus
tccacgccatcaaatatgaagcaca

SEQ ID NO: 968691 - DNA, 25 bp, Mus musculus
tccacgcgccagcgaatggacctgt

SEQ ID NO: 968692 - DNA, 25 bp, Mus musculus
tccacgcgccagggaatggacctgt

SEQ ID NO: 968693 - DNA, 25 bp, Mus musculus
tccacgggaatgaccctgactacat

SEQ ID NO: 968694 - DNA, 25 bp, Mus musculus
tccacgggaatgacgctgactacat

SEQ ID NO: 968695 - DNA, 25 bp, Mus musculus
tccacgtgcaggctctgttgcatga

SEQ ID NO: 968696 - DNA, 25 bp, Mus musculus
tccacgtgcagggtctgttgcatga

SEQ ID NO: 968697 - DNA, 25 bp, Mus musculus
tccactactgctttgtggagtcgca

SEQ ID NO: 968698 - DNA, 25 bp, Mus musculus
tccactactggtttgtggagtcgca

SEQ ID NO: 968699 - DNA, 25 bp, Mus musculus
tccactattggctgcgcaatgaatg

SEQ ID NO: 968700 - DNA, 25 bp, Mus musculus
tccactattggctgggcaatgaatg

SEQ ID NO: 968701 - DNA, 25 bp, Mus musculus
tccactcaaagcaacccaaagccac

SEQ ID NO: 968702 - DNA, 25 bp, Mus musculus
tccactcaaagcaagccaaagccac

SEQ ID NO: 968703 - DNA, 25 bp, Mus musculus
tccactcatcttcgaaaggacttgg

SEQ ID NO: 968704 - DNA, 25 bp, Mus musculus
tccactcatcttggaaaggacttgg

SEQ ID NO: 968705 - DNA, 25 bp, Mus musculus
tccactccagaaagtggagtggcct

SEQ ID NO: 968706 - DNA, 25 bp, Mus musculus
tccactccagaatgtggagtggcct

SEQ ID NO: 968707 - DNA, 25 bp, Mus musculus
tccactccagatcatgtcatcaggc

SEQ ID NO: 968708 - DNA, 25 bp, Mus musculus
tccactccagttcatgtcatcaggc

SEQ ID NO: 968709 - DNA, 25 bp, Mus musculus
tccactgcaacgaccgctactcccc

SEQ ID NO: 968710 - DNA, 25 bp, Mus musculus
tccactgcaaggaccgctactcccc

SEQ ID NO: 968711 - DNA, 25 bp, Mus musculus
tccactgctctgcctcgacttcgga

SEQ ID NO: 968712 - DNA, 25 bp, Mus musculus
tccactgctctggctcgacttcgga

SEQ ID NO: 968713 - DNA, 25 bp, Mus musculus
tccactggagaacaagtggccatgc

SEQ ID NO: 968714 - DNA, 25 bp, Mus musculus
tccactggagaagaagtggccatgc

SEQ ID NO: 968715 - DNA, 25 bp, Mus musculus
tccactgtccacctcattgaattcg

SEQ ID NO: 968716 - DNA, 25 bp, Mus musculus
tccactgtccacctgattgaattcg

SEQ ID NO: 968717 - DNA, 25 bp, Mus musculus
tccacttataaaatcctgtgactat

SEQ ID NO: 968718 - DNA, 25 bp, Mus musculus
tccacttataaaatgctgtgactat

SEQ ID NO: 968719 - DNA, 25 bp, Mus musculus
tccacttcagcctgtttgacgtcgg

SEQ ID NO: 968720 - DNA, 25 bp, Mus musculus
tccacttcaggctgtttgacgtcgg

SEQ ID NO: 968721 - DNA, 25 bp, Mus musculus
tccacttccactgcttctgctttga

SEQ ID NO: 968722 - DNA, 25 bp, Mus musculus
tccacttccaggctcgagatgcaga

SEQ ID NO: 968723 - DNA, 25 bp, Mus musculus
tccacttccagggtcgagatgcaga

SEQ ID NO: 968724 - DNA, 25 bp, Mus musculus
tccacttccagtgcttctgctttga

SEQ ID NO: 968725 - DNA, 25 bp, Mus musculus
tccacttccgccctggaggtgtacc

SEQ ID NO: 968726 - DNA, 25 bp, Mus musculus
tccacttccggcctggaggtgtacc

SEQ ID NO: 968727 - DNA, 25 bp, Mus musculus
tccactttggacagagttgcaatgt

SEQ ID NO: 968728 - DNA, 25 bp, Mus musculus
tccactttggacagtgttgcaatgt

SEQ ID NO: 968729 - DNA, 25 bp, Mus musculus
tccagaaaacagatctttgtaccat

SEQ ID NO: 968730 - DNA, 25 bp, Mus musculus
tccagaaaacagttctttgtaccat

SEQ ID NO: 968731 - DNA, 25 bp, Mus musculus
tccagaaacccgctcttgcccctcg

SEQ ID NO: 968732 - DNA, 25 bp, Mus musculus
tccagaaacccgctgttgcccctcg

SEQ ID NO: 968733 - DNA, 25 bp, Mus musculus
tccagaaacgagaagaagcagacca

SEQ ID NO: 968734 - DNA, 25 bp, Mus musculus
tccagaaacgagtagaagcagacca

SEQ ID NO: 968735 - DNA, 25 bp, Mus musculus
tccagaacacccaacgcttgatatt

SEQ ID NO: 968736 - DNA, 25 bp, Mus musculus
tccagaacacccaacgcttgatctt

SEQ ID NO: 968737 - DNA, 25 bp, Mus musculus
tccagaacacccaaggcttgatatt

SEQ ID NO: 968738 - DNA, 25 bp, Mus musculus
tccagaacacccaaggcttgatctt

SEQ ID NO: 968739 - DNA, 25 bp, Mus musculus
tccagaacactcaacgtctgatttt

SEQ ID NO: 968740 - DNA, 25 bp, Mus musculus
tccagaacactcaaggtctgatttt

SEQ ID NO: 968741 - DNA, 25 bp, Mus musculus
tccagaacagctatggatttgccag

SEQ ID NO: 968742 - DNA, 25 bp, Mus musculus
tccagaacagctcttcctaaggctt

SEQ ID NO: 968743 - DNA, 25 bp, Mus musculus
tccagaacagctgttcctaaggctt

SEQ ID NO: 968744 - DNA, 25 bp, Mus musculus
tccagaacagctttggatttgccag

SEQ ID NO: 968745 - DNA, 25 bp, Mus musculus
tccagaacgacaagaataatgcaag

SEQ ID NO: 968746 - DNA, 25 bp, Mus musculus
tccagaacgacatgaataatgcaag

SEQ ID NO: 968747 - DNA, 25 bp, Mus musculus
tccagaactatcccctggtctccat

SEQ ID NO: 968748 - DNA, 25 bp, Mus musculus
tccagaactatcccgtggtctccat

SEQ ID NO: 968749 - DNA, 25 bp, Mus musculus
tccagaagaaagattatgtgcggac

SEQ ID NO: 968750 - DNA, 25 bp, Mus musculus
tccagaagaaagtttatgtgcggac

SEQ ID NO: 968751 - DNA, 25 bp, Mus musculus
tccagaagaccataccaggcgcaat

SEQ ID NO: 968752 - DNA, 25 bp, Mus musculus
tccagaagaccatacgcgcaattca

SEQ ID NO: 968753 - DNA, 25 bp, Mus musculus
tccagaagaccatagcaggcgcaat

SEQ ID NO: 968754 - DNA, 25 bp, Mus musculus
tccagaagaccataggcgcaattca

SEQ ID NO: 968755 - DNA, 25 bp, Mus musculus
tccagaagagccccaacccagctgc

SEQ ID NO: 968756 - DNA, 25 bp, Mus musculus
tccagaagaggcccaacccagctgc

SEQ ID NO: 968757 - DNA, 25 bp, Mus musculus
tccagaagtgatccagactctcaga

SEQ ID NO: 968758 - DNA, 25 bp, Mus musculus
tccagaagtgttaacgtccaaaaat

SEQ ID NO: 968759 - DNA, 25 bp, Mus musculus
tccagaagtgttaaggtccaaaaat

SEQ ID NO: 968760 - DNA, 25 bp, Mus musculus
tccagaagtgttccagactctcaga

SEQ ID NO: 968761 - DNA, 25 bp, Mus musculus
tccagaagttcctgcgtttgatgaa

SEQ ID NO: 968762 - DNA, 25 bp, Mus musculus
tccagaagttcctgggtttgatgaa

SEQ ID NO: 968763 - DNA, 25 bp, Mus musculus
tccagaatacatcgtttacatgttc

SEQ ID NO: 968764 - DNA, 25 bp, Mus musculus
tccagaatacatggtttacatgttc

SEQ ID NO: 968765 - DNA, 25 bp, Mus musculus
tccagaatcagacacgaatctgctt

SEQ ID NO: 968766 - DNA, 25 bp, Mus musculus
tccagaatcagacacgtgatttgaa

SEQ ID NO: 968767 - DNA, 25 bp, Mus musculus
tccagaatcagacaggaatctgctt

SEQ ID NO: 968768 - DNA, 25 bp, Mus musculus
tccagaatcagacaggtgatttgaa

SEQ ID NO: 968769 - DNA, 25 bp, Mus musculus
tccagacaccatcccagcccactca

SEQ ID NO: 968770 - DNA, 25 bp, Mus musculus
tccagacaccatgccagcccactca

SEQ ID NO: 968771 - DNA, 25 bp, Mus musculus
tccagacatgcagacaacagcttcc

SEQ ID NO: 968772 - DNA, 25 bp, Mus musculus
tccagacatggagacaacagcttcc

SEQ ID NO: 968773 - DNA, 25 bp, Mus musculus
tccagacattcagacccacaggcac

SEQ ID NO: 968774 - DNA, 25 bp, Mus musculus
tccagacattcagagccacaggcac

SEQ ID NO: 968775 - DNA, 25 bp, Mus musculus
tccagaccagcctgcagtgttgacc

SEQ ID NO: 968776 - DNA, 25 bp, Mus musculus
tccagaccagctggactctgactca

SEQ ID NO: 968777 - DNA, 25 bp, Mus musculus
tccagaccaggctgcagtgttgacc

SEQ ID NO: 968778 - DNA, 25 bp, Mus musculus
tccagaccaggtggactctgactca

SEQ ID NO: 968779 - DNA, 25 bp, Mus musculus
tccagacccacacacttccaaattg

SEQ ID NO: 968780 - DNA, 25 bp, Mus musculus
tccagacccacacaggctcccaaac

SEQ ID NO: 968781 - DNA, 25 bp, Mus musculus
tccagacccacagacttccaaattg

SEQ ID NO: 968782 - DNA, 25 bp, Mus musculus
tccagacccacagaggctcccaaac

SEQ ID NO: 968783 - DNA, 25 bp, Mus musculus
tccagactagcgaacgacacagagg

SEQ ID NO: 968784 - DNA, 25 bp, Mus musculus
tccagactagggaacgacacagagg

SEQ ID NO: 968785 - DNA, 25 bp, Mus musculus
tccagactctgccactcacagcaga

SEQ ID NO: 968786 - DNA, 25 bp, Mus musculus
tccagactctgccagtcacagcaga

SEQ ID NO: 968787 - DNA, 25 bp, Mus musculus
tccagactgcatccctctgagggta

SEQ ID NO: 968788 - DNA, 25 bp, Mus musculus
tccagactgcatcgaactacatgaa

SEQ ID NO: 968789 - DNA, 25 bp, Mus musculus
tccagactgcatcggtagcctctga

SEQ ID NO: 968790 - DNA, 25 bp, Mus musculus
tccagactgcatgcctctgagggta

SEQ ID NO: 968791 - DNA, 25 bp, Mus musculus
tccagactgcatggaactacatgaa

SEQ ID NO: 968792 - DNA, 25 bp, Mus musculus
tccagactgcatgggtagcctctga

SEQ ID NO: 968793 - DNA, 25 bp, Mus musculus
tccagagaaactcaagtatcttcag

SEQ ID NO: 968794 - DNA, 25 bp, Mus musculus
tccagagaaactctatcttcaggac

SEQ ID NO: 968795 - DNA, 25 bp, Mus musculus
tccagagaaactgaagtatcttcag

SEQ ID NO: 968796 - DNA, 25 bp, Mus musculus
tccagagaaactgtatcttcaggac

SEQ ID NO: 968797 - DNA, 25 bp, Mus musculus
tccagagaagctctgtgcaagtaac

SEQ ID NO: 968798 - DNA, 25 bp, Mus musculus
tccagagaaggtctgtgcaagtaac

SEQ ID NO: 968799 - DNA, 25 bp, Mus musculus
tccagagaatctaataggatttaaa

SEQ ID NO: 968800 - DNA, 25 bp, Mus musculus
tccagagaatcttataggatttaaa

SEQ ID NO: 968801 - DNA, 25 bp, Mus musculus
tccagagacaagcgagagcctggac

SEQ ID NO: 968802 - DNA, 25 bp, Mus musculus
tccagagacaagggagagcctggac

SEQ ID NO: 968803 - DNA, 25 bp, Mus musculus
tccagagaggcccacgtctgctctg

SEQ ID NO: 968804 - DNA, 25 bp, Mus musculus
tccagagaggcccaggtctgctctg

SEQ ID NO: 968805 - DNA, 25 bp, Mus musculus
tccagagcacccagctgctgaataa

SEQ ID NO: 968806 - DNA, 25 bp, Mus musculus
tccagagcaccctgctgctgaataa

SEQ ID NO: 968807 - DNA, 25 bp, Mus musculus
tccagagcctctagcccctaggacc

SEQ ID NO: 968808 - DNA, 25 bp, Mus musculus
tccagagcctctaggccctaggacc

SEQ ID NO: 968809 - DNA, 25 bp, Mus musculus
tccagagcctctgcttgaggcgagc

SEQ ID NO: 968810 - DNA, 25 bp, Mus musculus
tccagagcctgtgcttgaggcgagc

SEQ ID NO: 968811 - DNA, 25 bp, Mus musculus
tccagagctcctctttattcatgga

SEQ ID NO: 968812 - DNA, 25 bp, Mus musculus
tccagagctcctgtttattcatgga

SEQ ID NO: 968813 - DNA, 25 bp, Mus musculus
tccagaggagaacatcaagactctg

SEQ ID NO: 968814 - DNA, 25 bp, Mus musculus
tccagaggagaagatcaagactctg

SEQ ID NO: 968815 - DNA, 25 bp, Mus musculus
tccagaggagctactacaagcctgg

SEQ ID NO: 968816 - DNA, 25 bp, Mus musculus
tccagaggaggtactacaagcctgg

SEQ ID NO: 968817 - DNA, 25 bp, Mus musculus
tccagaggcgcccagcaggtggcca

SEQ ID NO: 968818 - DNA, 25 bp, Mus musculus
tccagaggcggccagcaggtggcca

SEQ ID NO: 968819 - DNA, 25 bp, Mus musculus
tccagagtatatcgagctgtgtgac

SEQ ID NO: 968820 - DNA, 25 bp, Mus musculus
tccagagtatatggagctgtgtgac

SEQ ID NO: 968821 - DNA, 25 bp, Mus musculus
tccagatatcctcagcagaggggca

SEQ ID NO: 968822 - DNA, 25 bp, Mus musculus
tccagatatcctgagcagaggggca

SEQ ID NO: 968823 - DNA, 25 bp, Mus musculus
tccagatgcaagcagtggggaataa

SEQ ID NO: 968824 - DNA, 25 bp, Mus musculus
tccagatgcaaggagtggggaataa

SEQ ID NO: 968825 - DNA, 25 bp, Mus musculus
tccagcaatgatgttcgtgtcacgg

SEQ ID NO: 968826 - DNA, 25 bp, Mus musculus
tccagcaatgttgttcgtgtcacgg

SEQ ID NO: 968827 - DNA, 25 bp, Mus musculus
tccagcacagaaggcagggagtgtg

SEQ ID NO: 968828 - DNA, 25 bp, Mus musculus
tccagcacagcatgcgggctcctgg

SEQ ID NO: 968829 - DNA, 25 bp, Mus musculus
tccagcacagccagggagtgtgtga

SEQ ID NO: 968830 - DNA, 25 bp, Mus musculus
tccagcacagcctcggctgaccaaa

SEQ ID NO: 968831 - DNA, 25 bp, Mus musculus
tccagcacaggatgcgggctcctgg

SEQ ID NO: 968832 - DNA, 25 bp, Mus musculus
tccagcacaggcagggagtgtgtga

SEQ ID NO: 968833 - DNA, 25 bp, Mus musculus
tccagcacaggctcggctgaccaaa

SEQ ID NO: 968834 - DNA, 25 bp, Mus musculus
tccagcacagtaggcagggagtgtg

SEQ ID NO: 968835 - DNA, 25 bp, Mus musculus
tccagcaccagctcaaattcagacc

SEQ ID NO: 968836 - DNA, 25 bp, Mus musculus
tccagcaccagctctaattcagacc

SEQ ID NO: 968837 - DNA, 25 bp, Mus musculus
tccagcactaccaacttcacagctg

SEQ ID NO: 968838 - DNA, 25 bp, Mus musculus
tccagcactaccaagttcacagctg

SEQ ID NO: 968839 - DNA, 25 bp, Mus musculus
tccagcagaactaaagaacgcttct

SEQ ID NO: 968840 - DNA, 25 bp, Mus musculus
tccagcagaagtaaagaacgcttct

SEQ ID NO: 968841 - DNA, 25 bp, Mus musculus
tccagcagagatgttcagcctgtcg

SEQ ID NO: 968842 - DNA, 25 bp, Mus musculus
tccagcagagttgttcagcctgtcg

SEQ ID NO: 968843 - DNA, 25 bp, Mus musculus
tccagcagctcaatgagacatgtct

SEQ ID NO: 968844 - DNA, 25 bp, Mus musculus
tccagcagctcattgagacatgtct

SEQ ID NO: 968845 - DNA, 25 bp, Mus musculus
tccagcagtgagcgacttgaaagtg

SEQ ID NO: 968846 - DNA, 25 bp, Mus musculus
tccagcagtgagggacttgaaagtg

SEQ ID NO: 968847 - DNA, 25 bp, Mus musculus
tccagcatagccccacggcctgcta

SEQ ID NO: 968848 - DNA, 25 bp, Mus musculus
tccagcataggcccacggcctgcta

SEQ ID NO: 968849 - DNA, 25 bp, Mus musculus
tccagccaccagcccctgcccggat

SEQ ID NO: 968850 - DNA, 25 bp, Mus musculus
tccagccaccagctgactctactgg

SEQ ID NO: 968851 - DNA, 25 bp, Mus musculus
tccagccaccaggccctgcccggat

SEQ ID NO: 968852 - DNA, 25 bp, Mus musculus
tccagccaccaggtgactctactgg

SEQ ID NO: 968853 - DNA, 25 bp, Mus musculus
tccagccagaagcatcggaatggaa

SEQ ID NO: 968854 - DNA, 25 bp, Mus musculus
tccagccagaaggatcggaatggaa

SEQ ID NO: 968855 - DNA, 25 bp, Mus musculus
tccagccagagactttatggtctcg

SEQ ID NO: 968856 - DNA, 25 bp, Mus musculus
tccagccagagagtttatggtctcg

SEQ ID NO: 968857 - DNA, 25 bp, Mus musculus
tccagccaggtaccagatgtgatgg

SEQ ID NO: 968858 - DNA, 25 bp, Mus musculus
tccagccaggtacctgatgtgatgg

SEQ ID NO: 968859 - DNA, 25 bp, Mus musculus
tccagccatcattccgtgtatgatg

SEQ ID NO: 968860 - DNA, 25 bp, Mus musculus
tccagccatcattcggtgtatgatg

SEQ ID NO: 968861 - DNA, 25 bp, Mus musculus
tccagcccagaattaaccctgaatc

SEQ ID NO: 968862 - DNA, 25 bp, Mus musculus
tccagcccagatggaggatgaggac

SEQ ID NO: 968863 - DNA, 25 bp, Mus musculus
tccagcccagcagacaggaggatca

SEQ ID NO: 968864 - DNA, 25 bp, Mus musculus
tccagcccagctggagatggaggat

SEQ ID NO: 968865 - DNA, 25 bp, Mus musculus
tccagcccaggagacaggaggatca

SEQ ID NO: 968866 - DNA, 25 bp, Mus musculus
tccagcccaggtggagatggaggat

SEQ ID NO: 968867 - DNA, 25 bp, Mus musculus
tccagcccagtattaaccctgaatc

SEQ ID NO: 968868 - DNA, 25 bp, Mus musculus
tccagcccagttggaggatgaggac

SEQ ID NO: 968869 - DNA, 25 bp, Mus musculus
tccagccccagctccccaacgagtc

SEQ ID NO: 968870 - DNA, 25 bp, Mus musculus
tccagccccagctcgccaacgagtc

SEQ ID NO: 968871 - DNA, 25 bp, Mus musculus
tccagcccggatgacgtggctctgg

SEQ ID NO: 968872 - DNA, 25 bp, Mus musculus
tccagcccggatgaggtggctctgg

SEQ ID NO: 968873 - DNA, 25 bp, Mus musculus
tccagccgtcagctaaaaactggtg

SEQ ID NO: 968874 - DNA, 25 bp, Mus musculus
tccagccgtcaggtaaaaactggtg

SEQ ID NO: 968875 - DNA, 25 bp, Mus musculus
tccagcctacagaaactgttccgag

SEQ ID NO: 968876 - DNA, 25 bp, Mus musculus
tccagcctacagaatctgttccgag

SEQ ID NO: 968877 - DNA, 25 bp, Mus musculus
tccagcctgaaaagttcctagacaa

SEQ ID NO: 968878 - DNA, 25 bp, Mus musculus
tccagcctgaaatgttcctagacaa

SEQ ID NO: 968879 - DNA, 25 bp, Mus musculus
tccagcctggagaacgtcccacctg

SEQ ID NO: 968880 - DNA, 25 bp, Mus musculus
tccagcctggagaaggtcccacctg

SEQ ID NO: 968881 - DNA, 25 bp, Mus musculus
tccagcgaacaaagctcattcattg

SEQ ID NO: 968882 - DNA, 25 bp, Mus musculus
tccagcgaacaatgctcattcattg

SEQ ID NO: 968883 - DNA, 25 bp, Mus musculus
tccagcgcagctttgaaccagaaga

SEQ ID NO: 968884 - DNA, 25 bp, Mus musculus
tccagcgcaggtttgaaccagaaga

SEQ ID NO: 968885 - DNA, 25 bp, Mus musculus
tccagcggcccacgggcttgactta

SEQ ID NO: 968886 - DNA, 25 bp, Mus musculus
tccagcggcccaggggcttgactta

SEQ ID NO: 968887 - DNA, 25 bp, Mus musculus
tccagcggctgaaactgaatcactg

SEQ ID NO: 968888 - DNA, 25 bp, Mus musculus
tccagcggctgatactgaatcactg

SEQ ID NO: 968889 - DNA, 25 bp, Mus musculus
tccagctactaggcagcaaaatggc

SEQ ID NO: 968890 - DNA, 25 bp, Mus musculus
tccagctactaggctgcaaaatggc

SEQ ID NO: 968891 - DNA, 25 bp, Mus musculus
tccagctagggaatcaaggtgaaga

SEQ ID NO: 968892 - DNA, 25 bp, Mus musculus
tccagctagggaatgaaggtgaaga

SEQ ID NO: 968893 - DNA, 25 bp, Mus musculus
tccagctatgagaagcaacaggcca

SEQ ID NO: 968894 - DNA, 25 bp, Mus musculus
tccagctatgagcctggagtactcg

SEQ ID NO: 968895 - DNA, 25 bp, Mus musculus
tccagctatgaggctggagtactcg

SEQ ID NO: 968896 - DNA, 25 bp, Mus musculus
tccagctatgagtagcaacaggcca

SEQ ID NO: 968897 - DNA, 25 bp, Mus musculus
tccagctcatttcacattgccctct

SEQ ID NO: 968898 - DNA, 25 bp, Mus musculus
tccagctcatttcagattgccctct

SEQ ID NO: 968899 - DNA, 25 bp, Mus musculus
tccagctccctgacagaggatggtt

SEQ ID NO: 968900 - DNA, 25 bp, Mus musculus
tccagctccctgacagctatattgt

SEQ ID NO: 968901 - DNA, 25 bp, Mus musculus
tccagctccctgactgaggatggtt

SEQ ID NO: 968902 - DNA, 25 bp, Mus musculus
tccagctccctgactgctatattgt

SEQ ID NO: 968903 - DNA, 25 bp, Mus musculus
tccagctccgagcatccaaggagtg

SEQ ID NO: 968904 - DNA, 25 bp, Mus musculus
tccagctccgtgcatccaaggagtg

SEQ ID NO: 968905 - DNA, 25 bp, Mus musculus
tccagctgtgcacccacacgttctc

SEQ ID NO: 968906 - DNA, 25 bp, Mus musculus
tccagctgtgcaccgacacgttctc

SEQ ID NO: 968907 - DNA, 25 bp, Mus musculus
tccagctttaatcccaccaccacct

SEQ ID NO: 968908 - DNA, 25 bp, Mus musculus
tccagctttaatgccaccaccacct

SEQ ID NO: 968909 - DNA, 25 bp, Mus musculus
tccagctttgagatggctatgaacg

SEQ ID NO: 968910 - DNA, 25 bp, Mus musculus
tccagctttgagttggctatgaacg

SEQ ID NO: 968911 - DNA, 25 bp, Mus musculus
tccaggaaagatattctgaaagact

SEQ ID NO: 968912 - DNA, 25 bp, Mus musculus
tccaggaaagttattctgaaagact

SEQ ID NO: 968913 - DNA, 25 bp, Mus musculus
tccaggaacctgctcacacacctgt

SEQ ID NO: 968914 - DNA, 25 bp, Mus musculus
tccaggaacctggtcacacacctgt

SEQ ID NO: 968915 - DNA, 25 bp, Mus musculus
tccaggaactcacaaccaagttgtg

SEQ ID NO: 968916 - DNA, 25 bp, Mus musculus
tccaggaactcacacagaaccaagt

SEQ ID NO: 968917 - DNA, 25 bp, Mus musculus
tccaggaactcacacctccattact

SEQ ID NO: 968918 - DNA, 25 bp, Mus musculus
tccaggaactcacagctccattact

SEQ ID NO: 968919 - DNA, 25 bp, Mus musculus
tccaggaactcagaaccaagttgtg

SEQ ID NO: 968920 - DNA, 25 bp, Mus musculus
tccaggaactcagacagaaccaagt

SEQ ID NO: 968921 - DNA, 25 bp, Mus musculus
tccaggaagccacgtctttggccag

SEQ ID NO: 968922 - DNA, 25 bp, Mus musculus
tccaggaagccaggtctttggccag

SEQ ID NO: 968923 - DNA, 25 bp, Mus musculus
tccaggacaagacgtgcccagctgt

SEQ ID NO: 968924 - DNA, 25 bp, Mus musculus
tccaggacaagaggtgcccagctgt

SEQ ID NO: 968925 - DNA, 25 bp, Mus musculus
tccaggaccaagacgtcttgttatt

SEQ ID NO: 968926 - DNA, 25 bp, Mus musculus
tccaggaccaagtcgtcttgttatt

SEQ ID NO: 968927 - DNA, 25 bp, Mus musculus
tccaggaccacgatgtccctggtag

SEQ ID NO: 968928 - DNA, 25 bp, Mus musculus
tccaggaccacgttgtccctggtag

SEQ ID NO: 968929 - DNA, 25 bp, Mus musculus
tccaggacccagaggaacaattgga

SEQ ID NO: 968930 - DNA, 25 bp, Mus musculus
tccaggacccagtggaacaattgga

SEQ ID NO: 968931 - DNA, 25 bp, Mus musculus
tccaggaccctggcacacctcagca

SEQ ID NO: 968932 - DNA, 25 bp, Mus musculus
tccaggaccctggctcacctcagca

SEQ ID NO: 968933 - DNA, 25 bp, Mus musculus
tccaggacggcgtctgcctggacct

SEQ ID NO: 968934 - DNA, 25 bp, Mus musculus
tccaggacggggtctgcctggacct

SEQ ID NO: 968935 - DNA, 25 bp, Mus musculus
tccaggagaccacggagagaaatac

SEQ ID NO: 968936 - DNA, 25 bp, Mus musculus
tccaggagaccacggcctattttct

SEQ ID NO: 968937 - DNA, 25 bp, Mus musculus
tccaggagaccagggagagaaatac

SEQ ID NO: 968938 - DNA, 25 bp, Mus musculus
tccaggagaccagggcctattttct

SEQ ID NO: 968939 - DNA, 25 bp, Mus musculus
tccaggagcattttaataagaagat

SEQ ID NO: 968940 - DNA, 25 bp, Mus musculus
tccaggagcatttttataagaagat

SEQ ID NO: 968941 - DNA, 25 bp, Mus musculus
tccaggagctcacacgagagaagga

SEQ ID NO: 968942 - DNA, 25 bp, Mus musculus
tccaggagctcacaggagagaagga

SEQ ID NO: 968943 - DNA, 25 bp, Mus musculus
tccaggaggaactacacacagtgat

SEQ ID NO: 968944 - DNA, 25 bp, Mus musculus
tccaggaggaactagacacagtgat

SEQ ID NO: 968945 - DNA, 25 bp, Mus musculus
tccaggaggctgctggcattatgac

SEQ ID NO: 968946 - DNA, 25 bp, Mus musculus
tccaggaggctggtggcattatgac

SEQ ID NO: 968947 - DNA, 25 bp, Mus musculus
tccaggatatactcttcgtaccacc

SEQ ID NO: 968948 - DNA, 25 bp, Mus musculus
tccaggatatgtactcttcgtacca

SEQ ID NO: 968949 - DNA, 25 bp, Mus musculus
tccaggatatgttctcttcgtacca

SEQ ID NO: 968950 - DNA, 25 bp, Mus musculus
tccaggatattctcttcgtaccacc

SEQ ID NO: 968951 - DNA, 25 bp, Mus musculus
tccaggatccagccgccaggcagca

SEQ ID NO: 968952 - DNA, 25 bp, Mus musculus
tccaggatccagcttttatccagag

SEQ ID NO: 968953 - DNA, 25 bp, Mus musculus
tccaggatccaggcgccaggcagca

SEQ ID NO: 968954 - DNA, 25 bp, Mus musculus
tccaggatccaggttttatccagag

SEQ ID NO: 968955 - DNA, 25 bp, Mus musculus
tccaggatggaacccggcgcagcgc

SEQ ID NO: 968956 - DNA, 25 bp, Mus musculus
tccaggatggaaccgggcgcagcgc

SEQ ID NO: 968957 - DNA, 25 bp, Mus musculus
tccaggatttcacattcttcccacg

SEQ ID NO: 968958 - DNA, 25 bp, Mus musculus
tccaggatttcagattcttcccacg

SEQ ID NO: 968959 - DNA, 25 bp, Mus musculus
tccaggcaaggacggcctcatcggc

SEQ ID NO: 968960 - DNA, 25 bp, Mus musculus
tccaggcaaggagggcctcatcggc

SEQ ID NO: 968961 - DNA, 25 bp, Mus musculus
tccaggcagaagagtggtactttgg

SEQ ID NO: 968962 - DNA, 25 bp, Mus musculus
tccaggcagaagtgtggtactttgg

SEQ ID NO: 968963 - DNA, 25 bp, Mus musculus
tccaggcaggctggagtgtcatctt

SEQ ID NO: 968964 - DNA, 25 bp, Mus musculus
tccaggcagggtggagtgtcatctt

SEQ ID NO: 968965 - DNA, 25 bp, Mus musculus
tccaggccaaattagaaaaagtcta

SEQ ID NO: 968966 - DNA, 25 bp, Mus musculus
tccaggccaatttagaaaaagtcta

SEQ ID NO: 968967 - DNA, 25 bp, Mus musculus
tccaggccagagccgacagagttct

SEQ ID NO: 968968 - DNA, 25 bp, Mus musculus
tccaggccagaggcgacagagttct

SEQ ID NO: 968969 - DNA, 25 bp, Mus musculus
tccaggccagcctgggcagcatcgc

SEQ ID NO: 968970 - DNA, 25 bp, Mus musculus
tccaggccaggctgggcagcatcgc

SEQ ID NO: 968971 - DNA, 25 bp, Mus musculus
tccaggccccagctttggtggcccc

SEQ ID NO: 968972 - DNA, 25 bp, Mus musculus
tccaggccccaggtttggtggcccc

SEQ ID NO: 968973 - DNA, 25 bp, Mus musculus
tccaggcccgaacgacatacacaga

SEQ ID NO: 968974 - DNA, 25 bp, Mus musculus
tccaggcccgaaggacatacacaga

SEQ ID NO: 968975 - DNA, 25 bp, Mus musculus
tccaggcctcagccatctgttgcac

SEQ ID NO: 968976 - DNA, 25 bp, Mus musculus
tccaggcctcaggcatctgttgcac

SEQ ID NO: 968977 - DNA, 25 bp, Mus musculus
tccaggccttgccgcagttcctgtg

SEQ ID NO: 968978 - DNA, 25 bp, Mus musculus
tccaggccttgcggcagttcctgtg

SEQ ID NO: 968979 - DNA, 25 bp, Mus musculus
tccaggctctacttctgttcatatg

SEQ ID NO: 968980 - DNA, 25 bp, Mus musculus
tccaggctctcggaccctgaaagcc

SEQ ID NO: 968981 - DNA, 25 bp, Mus musculus
tccaggctctgggaccctgaaagcc

SEQ ID NO: 968982 - DNA, 25 bp, Mus musculus
tccaggctcttcttctgttcatatg

SEQ ID NO: 968983 - DNA, 25 bp, Mus musculus
tccaggctggccgcccggatggcga

SEQ ID NO: 968984 - DNA, 25 bp, Mus musculus
tccaggctgggcgcccggatggcga

SEQ ID NO: 968985 - DNA, 25 bp, Mus musculus
tccagggacgagattgaagaagaag

SEQ ID NO: 968986 - DNA, 25 bp, Mus musculus
tccagggacgagtttgaagaagaag

SEQ ID NO: 968987 - DNA, 25 bp, Mus musculus
tccagggagaagcaacttacaaaga

SEQ ID NO: 968988 - DNA, 25 bp, Mus musculus
tccagggagaaggaacttacaaaga

SEQ ID NO: 968989 - DNA, 25 bp, Mus musculus
tccagggagacacacacagacagca

SEQ ID NO: 968990 - DNA, 25 bp, Mus musculus
tccagggagacagacacagacagca

SEQ ID NO: 968991 - DNA, 25 bp, Mus musculus
tccagggagacgaaggaggcgttct

SEQ ID NO: 968992 - DNA, 25 bp, Mus musculus
tccagggagacgtaggaggcgttct

SEQ ID NO: 968993 - DNA, 25 bp, Mus musculus
tccagggtcagaagtactacgcatc

SEQ ID NO: 968994 - DNA, 25 bp, Mus musculus
tccagggtcagatgtactacgcatc

SEQ ID NO: 968995 - DNA, 25 bp, Mus musculus
tccagggtcttgcgctcgaaatgtg

SEQ ID NO: 968996 - DNA, 25 bp, Mus musculus
tccagggtcttgggctcgaaatgtg

SEQ ID NO: 968997 - DNA, 25 bp, Mus musculus
tccaggtacaagacgaactggagaa

SEQ ID NO: 968998 - DNA, 25 bp, Mus musculus
tccaggtacaagtcgaactggagaa

SEQ ID NO: 968999 - DNA, 25 bp, Mus musculus
tccaggtgatgacacaggacaaagg

SEQ ID NO: 969000 - DNA, 25 bp, Mus musculus
tccaggtgatgacactcacctctcc

SEQ ID NO: 969001 - DNA, 25 bp, Mus musculus
tccaggtgatgacagaggacaaagg

SEQ ID NO: 969002 - DNA, 25 bp, Mus musculus
tccaggtgatgacagtcacctctcc

SEQ ID NO: 969003 - DNA, 25 bp, Mus musculus
tccaggtgcagcaggtgatcaagga

SEQ ID NO: 969004 - DNA, 25 bp, Mus musculus
tccaggtgcagctggtgatcaagga

SEQ ID NO: 969005 - DNA, 25 bp, Mus musculus
tccagtaaacagagtccactgcaag

SEQ ID NO: 969006 - DNA, 25 bp, Mus musculus
tccagtaaacagtgtccactgcaag

SEQ ID NO: 969007 - DNA, 25 bp, Mus musculus
tccagtaaacccagtgatcaggtgt

SEQ ID NO: 969008 - DNA, 25 bp, Mus musculus
tccagtaaaccctgtgatcaggtgt

SEQ ID NO: 969009 - DNA, 25 bp, Mus musculus
tccagtaaagactccttgttgcaat

SEQ ID NO: 969010 - DNA, 25 bp, Mus musculus
tccagtaaagtctccttgttgcaat

SEQ ID NO: 969011 - DNA, 25 bp, Mus musculus
tccagtaccaagacaaagcctattt

SEQ ID NO: 969012 - DNA, 25 bp, Mus musculus
tccagtaccaagtcaaagcctattt

SEQ ID NO: 969013 - DNA, 25 bp, Mus musculus
tccagtacttcacactgaaccccca

SEQ ID NO: 969014 - DNA, 25 bp, Mus musculus
tccagtacttcagactgaaccccca

SEQ ID NO: 969015 - DNA, 25 bp, Mus musculus
tccagtagcctactggtgacaggaa

SEQ ID NO: 969016 - DNA, 25 bp, Mus musculus
tccagtagcctagtggtgacaggaa

SEQ ID NO: 969017 - DNA, 25 bp, Mus musculus
tccagtagtggtcacagtccagcta

SEQ ID NO: 969018 - DNA, 25 bp, Mus musculus
tccagtagtggtcagagtccagcta

SEQ ID NO: 969019 - DNA, 25 bp, Mus musculus
tccagtatagcgagaagctgggcac

SEQ ID NO: 969020 - DNA, 25 bp, Mus musculus
tccagtatagggagaagctgggcac

SEQ ID NO: 969021 - DNA, 25 bp, Mus musculus
tccagtatctgtatcgtcgtggctc

SEQ ID NO: 969022 - DNA, 25 bp, Mus musculus
tccagtatctgtatggtcgtggctc

SEQ ID NO: 969023 - DNA, 25 bp, Mus musculus
tccagtcaagcgcctttgataccat

SEQ ID NO: 969024 - DNA, 25 bp, Mus musculus
tccagtcaagggcctttgataccat

SEQ ID NO: 969025 - DNA, 25 bp, Mus musculus
tccagtcagagacgtcgcagtggtt

SEQ ID NO: 969026 - DNA, 25 bp, Mus musculus
tccagtcagagaggtcgcagtggtt

SEQ ID NO: 969027 - DNA, 25 bp, Mus musculus
tccagtccagcaatcccaggatcca

SEQ ID NO: 969028 - DNA, 25 bp, Mus musculus
tccagtccaggaatcccaggatcca

SEQ ID NO: 969029 - DNA, 25 bp, Mus musculus
tccagtctacagacacctgctatgt

SEQ ID NO: 969030 - DNA, 25 bp, Mus musculus
tccagtctacagtcacctgctatgt

SEQ ID NO: 969031 - DNA, 25 bp, Mus musculus
tccagtctccaacgaagaactagag

SEQ ID NO: 969032 - DNA, 25 bp, Mus musculus
tccagtctccaaggaagaactagag

SEQ ID NO: 969033 - DNA, 25 bp, Mus musculus
tccagtctcgaaagaactgtgcgaa

SEQ ID NO: 969034 - DNA, 25 bp, Mus musculus
tccagtctcgtaagaactgtgcgaa

SEQ ID NO: 969035 - DNA, 25 bp, Mus musculus
tccagtctgcagctcctaggtgcta

SEQ ID NO: 969036 - DNA, 25 bp, Mus musculus
tccagtctgcaggtcctaggtgcta

SEQ ID NO: 969037 - DNA, 25 bp, Mus musculus
tccagtctggccagcatgtgatggt

SEQ ID NO: 969038 - DNA, 25 bp, Mus musculus
tccagtctggcctgcatgtgatggt

SEQ ID NO: 969039 - DNA, 25 bp, Mus musculus
tccagtgaaaataacagccattctg

SEQ ID NO: 969040 - DNA, 25 bp, Mus musculus
tccagtgaaaataagagccattctg

SEQ ID NO: 969041 - DNA, 25 bp, Mus musculus
tccagtgaagcaattgacttgataa

SEQ ID NO: 969042 - DNA, 25 bp, Mus musculus
tccagtgaagctcattcagctggga

SEQ ID NO: 969043 - DNA, 25 bp, Mus musculus
tccagtgaaggaattgacttgataa

SEQ ID NO: 969044 - DNA, 25 bp, Mus musculus
tccagtgaaggtcattcagctggga

SEQ ID NO: 969045 - DNA, 25 bp, Mus musculus
tccagtgaccagcccgtccctgcca

SEQ ID NO: 969046 - DNA, 25 bp, Mus musculus
tccagtgaccaggccgtccctgcca

SEQ ID NO: 969047 - DNA, 25 bp, Mus musculus
tccagtgcagaacctgtagctatct

SEQ ID NO: 969048 - DNA, 25 bp, Mus musculus
tccagtgcagaagctgtagctatct

SEQ ID NO: 969049 - DNA, 25 bp, Mus musculus
tccagtggatcgcaaaaggcctact

SEQ ID NO: 969050 - DNA, 25 bp, Mus musculus
tccagtggatcggaaaaggcctact

SEQ ID NO: 969051 - DNA, 25 bp, Mus musculus
tccagttatgcttctccagggcaaa

SEQ ID NO: 969052 - DNA, 25 bp, Mus musculus
tccagttatggttctccagggcaaa

SEQ ID NO: 969053 - DNA, 25 bp, Mus musculus
tccagttattggagtccatgtcaga

SEQ ID NO: 969054 - DNA, 25 bp, Mus musculus
tccagttattggtgtccatgtcaga

SEQ ID NO: 969055 - DNA, 25 bp, Mus musculus
tccagttcagcaccctgcagcaggg

SEQ ID NO: 969056 - DNA, 25 bp, Mus musculus
tccagttcagcacggcacctacgcc

SEQ ID NO: 969057 - DNA, 25 bp, Mus musculus
tccagttcagcagcctgcagcaggg

SEQ ID NO: 969058 - DNA, 25 bp, Mus musculus
tccagttcagcagggcacctacgcc

SEQ ID NO: 969059 - DNA, 25 bp, Mus musculus
tccagttcttcccgatgatgccacc

SEQ ID NO: 969060 - DNA, 25 bp, Mus musculus
tccagttcttcccgttgatgccacc

SEQ ID NO: 969061 - DNA, 25 bp, Mus musculus
tccagttggctggacggaaggtggc

SEQ ID NO: 969062 - DNA, 25 bp, Mus musculus
tccagttggctggagggaaggtggc

SEQ ID NO: 969063 - DNA, 25 bp, Mus musculus
tccagtttgcaaagaagtttgtggt

SEQ ID NO: 969064 - DNA, 25 bp, Mus musculus
tccagtttgcaatgaagtttgtggt

SEQ ID NO: 969065 - DNA, 25 bp, Mus musculus
tccagttttacacgaatctgggcaa

SEQ ID NO: 969066 - DNA, 25 bp, Mus musculus
tccagttttacaggaatctgggcaa

SEQ ID NO: 969067 - DNA, 25 bp, Mus musculus
tccataaacacgccttttttcacag

SEQ ID NO: 969068 - DNA, 25 bp, Mus musculus
tccataaacacggcttttttcacag

SEQ ID NO: 969069 - DNA, 25 bp, Mus musculus
tccataagttcaaacctctaggact

SEQ ID NO: 969070 - DNA, 25 bp, Mus musculus
tccataagttcaaacggcaacaggt

SEQ ID NO: 969071 - DNA, 25 bp, Mus musculus
tccataagttcaaagctctaggact

SEQ ID NO: 969072 - DNA, 25 bp, Mus musculus
tccataagttcaaagggcaacaggt

SEQ ID NO: 969073 - DNA, 25 bp, Mus musculus
tccataagtttgcatgatttacctt

SEQ ID NO: 969074 - DNA, 25 bp, Mus musculus
tccataagtttggatgatttacctt

SEQ ID NO: 969075 - DNA, 25 bp, Mus musculus
tccatacccaaacgcaggagctgtg

SEQ ID NO: 969076 - DNA, 25 bp, Mus musculus
tccatacccaaaggcaggagctgtg

SEQ ID NO: 969077 - DNA, 25 bp, Mus musculus
tccatagtcacacgcccgacctgtt

SEQ ID NO: 969078 - DNA, 25 bp, Mus musculus
tccatagtcacaggcccgacctgtt

SEQ ID NO: 969079 - DNA, 25 bp, Mus musculus
tccatatcagccgcttacagtctcg

SEQ ID NO: 969080 - DNA, 25 bp, Mus musculus
tccatatcagctggaaggacgggct

SEQ ID NO: 969081 - DNA, 25 bp, Mus musculus
tccatatcaggcgcttacagtctcg

SEQ ID NO: 969082 - DNA, 25 bp, Mus musculus
tccatatcaggtggaaggacgggct

SEQ ID NO: 969083 - DNA, 25 bp, Mus musculus
tccatattgcctcgtacaccattaa

SEQ ID NO: 969084 - DNA, 25 bp, Mus musculus
tccatattgcctggtacaccattaa

SEQ ID NO: 969085 - DNA, 25 bp, Mus musculus
tccatcaacaagcactggtggaagg

SEQ ID NO: 969086 - DNA, 25 bp, Mus musculus
tccatcaacaaggactggtggaagg

SEQ ID NO: 969087 - DNA, 25 bp, Mus musculus
tccatcaactaaccaatactggagt

SEQ ID NO: 969088 - DNA, 25 bp, Mus musculus
tccatcaactaagcaatactggagt

SEQ ID NO: 969089 - DNA, 25 bp, Mus musculus
tccatcaatacacgtccaaaaggtg

SEQ ID NO: 969090 - DNA, 25 bp, Mus musculus
tccatcaatacaggtccaaaaggtg

SEQ ID NO: 969091 - DNA, 25 bp, Mus musculus
tccatcacaagccacgaggtggcca

SEQ ID NO: 969092 - DNA, 25 bp, Mus musculus
tccatcacaagccaggaggtggcca

SEQ ID NO: 969093 - DNA, 25 bp, Mus musculus
tccatcaccccagacgtgtggccaa

SEQ ID NO: 969094 - DNA, 25 bp, Mus musculus
tccatcaccccagaggtgtggccaa

SEQ ID NO: 969095 - DNA, 25 bp, Mus musculus
tccatcacgaagaacatctggagaa

SEQ ID NO: 969096 - DNA, 25 bp, Mus musculus
tccatcacgaagtacatctggagaa

SEQ ID NO: 969097 - DNA, 25 bp, Mus musculus
tccatcagtacacggagcagatcaa

SEQ ID NO: 969098 - DNA, 25 bp, Mus musculus
tccatcagtacactcatgcctgcag

SEQ ID NO: 969099 - DNA, 25 bp, Mus musculus
tccatcagtacagggagcagatcaa

SEQ ID NO: 969100 - DNA, 25 bp, Mus musculus
tccatcagtacagtcatgcctgcag

SEQ ID NO: 969101 - DNA, 25 bp, Mus musculus
tccatcagttctctgctcaaagatc

SEQ ID NO: 969102 - DNA, 25 bp, Mus musculus
tccatcagttctgtgctcaaagatc

SEQ ID NO: 969103 - DNA, 25 bp, Mus musculus
tccatcatccgacagcagctccagg

SEQ ID NO: 969104 - DNA, 25 bp, Mus musculus
tccatcatccgacagctccaggctc

SEQ ID NO: 969105 - DNA, 25 bp, Mus musculus
tccatcatccgagagcagctccagg

SEQ ID NO: 969106 - DNA, 25 bp, Mus musculus
tccatcatccgagagctccaggctc

SEQ ID NO: 969107 - DNA, 25 bp, Mus musculus
tccatcatggcgcagaaagtgaaca

SEQ ID NO: 969108 - DNA, 25 bp, Mus musculus
tccatcatggcggagaaagtgaaca

SEQ ID NO: 969109 - DNA, 25 bp, Mus musculus
tccatcccaacaactatcctgatgg

SEQ ID NO: 969110 - DNA, 25 bp, Mus musculus
tccatcccaacatctatcctgatgg

SEQ ID NO: 969111 - DNA, 25 bp, Mus musculus
tccatccgccctctgtcatcccgca

SEQ ID NO: 969112 - DNA, 25 bp, Mus musculus
tccatccgccgtctgtcatcccgca

SEQ ID NO: 969113 - DNA, 25 bp, Mus musculus
tccatcctatatagtctacatgggc

SEQ ID NO: 969114 - DNA, 25 bp, Mus musculus
tccatcctatttagtctacatgggc

SEQ ID NO: 969115 - DNA, 25 bp, Mus musculus
tccatcctgaagaccctgctatgtg

SEQ ID NO: 969116 - DNA, 25 bp, Mus musculus
tccatcctgaagtccctgctatgtg

SEQ ID NO: 969117 - DNA, 25 bp, Mus musculus
tccatcgaccagcgtgcagaggacg

SEQ ID NO: 969118 - DNA, 25 bp, Mus musculus
tccatcgaccagggtgcagaggacg

SEQ ID NO: 969119 - DNA, 25 bp, Mus musculus
tccatcgctacacatactttatgca

SEQ ID NO: 969120 - DNA, 25 bp, Mus musculus
tccatcgctacagatactttatgca

SEQ ID NO: 969121 - DNA, 25 bp, Mus musculus
tccatcggcgggcaagtttggtgag

SEQ ID NO: 969122 - DNA, 25 bp, Mus musculus
tccatcggcggggaagtttggtgag

SEQ ID NO: 969123 - DNA, 25 bp, Mus musculus
tccatcggctatcgaggtagaagag

SEQ ID NO: 969124 - DNA, 25 bp, Mus musculus
tccatcggctatggaggtagaagag

SEQ ID NO: 969125 - DNA, 25 bp, Mus musculus
tccatcgtgatccgcaagaagccag

SEQ ID NO: 969126 - DNA, 25 bp, Mus musculus
tccatcgtgatccgtgagaaggacc

SEQ ID NO: 969127 - DNA, 25 bp, Mus musculus
tccatcgtgatcggcaagaagccag

SEQ ID NO: 969128 - DNA, 25 bp, Mus musculus
tccatcgtgatcggtgagaaggacc

SEQ ID NO: 969129 - DNA, 25 bp, Mus musculus
tccatctccacagcagcggtgctct

SEQ ID NO: 969130 - DNA, 25 bp, Mus musculus
tccatctccacagctgcggtgctct

SEQ ID NO: 969131 - DNA, 25 bp, Mus musculus
tccatcttagaacatcctttactgt

SEQ ID NO: 969132 - DNA, 25 bp, Mus musculus
tccatcttagaagatcctttactgt

SEQ ID NO: 969133 - DNA, 25 bp, Mus musculus
tccatcttcaagccctgggcagttt

SEQ ID NO: 969134 - DNA, 25 bp, Mus musculus
tccatcttcaaggcctgggcagttt

SEQ ID NO: 969135 - DNA, 25 bp, Mus musculus
tccatcttctcccacgagatgagct

SEQ ID NO: 969136 - DNA, 25 bp, Mus musculus
tccatcttctcccaggagatgagct

SEQ ID NO: 969137 - DNA, 25 bp, Mus musculus
tccatcttgactcgcaggaagacga

SEQ ID NO: 969138 - DNA, 25 bp, Mus musculus
tccatcttgactcgctggacaccat

SEQ ID NO: 969139 - DNA, 25 bp, Mus musculus
tccatcttgactcggaggaagacga

SEQ ID NO: 969140 - DNA, 25 bp, Mus musculus
tccatcttgactcggtggacaccat

SEQ ID NO: 969141 - DNA, 25 bp, Mus musculus
tccatcttggaaatcgatgagacct

SEQ ID NO: 969142 - DNA, 25 bp, Mus musculus
tccatcttggaaatggatgagacct

SEQ ID NO: 969143 - DNA, 25 bp, Mus musculus
tccatctttgctctggctcccatgg

SEQ ID NO: 969144 - DNA, 25 bp, Mus musculus
tccatctttggtctggctcccatgg

SEQ ID NO: 969145 - DNA, 25 bp, Mus musculus
tccatgaaaaccaagatgggcatat

SEQ ID NO: 969146 - DNA, 25 bp, Mus musculus
tccatgaaaagcaagatgggcatat

SEQ ID NO: 969147 - DNA, 25 bp, Mus musculus
tccatgaaccagaacctcacatctt

SEQ ID NO: 969148 - DNA, 25 bp, Mus musculus
tccatgaaccagtacctcacatctt

SEQ ID NO: 969149 - DNA, 25 bp, Mus musculus
tccatgaaggagcatcaggttatcc

SEQ ID NO: 969150 - DNA, 25 bp, Mus musculus
tccatgaaggaggatcaggttatcc

SEQ ID NO: 969151 - DNA, 25 bp, Mus musculus
tccatgacgtagctctgcgcagggt

SEQ ID NO: 969152 - DNA, 25 bp, Mus musculus
tccatgacgtaggtctgcgcagggt

SEQ ID NO: 969153 - DNA, 25 bp, Mus musculus
tccatgagaagacgaagcttcttga

SEQ ID NO: 969154 - DNA, 25 bp, Mus musculus
tccatgagaagaggaagcttcttga

SEQ ID NO: 969155 - DNA, 25 bp, Mus musculus
tccatgagatggattctgacgttgg

SEQ ID NO: 969156 - DNA, 25 bp, Mus musculus
tccatgagatggccgttatgctctg

SEQ ID NO: 969157 - DNA, 25 bp, Mus musculus
tccatgagatggcgcaggcgttatg

SEQ ID NO: 969158 - DNA, 25 bp, Mus musculus
tccatgagatgggcgttatgctctg

SEQ ID NO: 969159 - DNA, 25 bp, Mus musculus
tccatgagatggggcaggcgttatg

SEQ ID NO: 969160 - DNA, 25 bp, Mus musculus
tccatgagatggtttctgacgttgg

SEQ ID NO: 969161 - DNA, 25 bp, Mus musculus
tccatgagttcatccatggctaaag

SEQ ID NO: 969162 - DNA, 25 bp, Mus musculus
tccatgagttcatccatgtctactt

SEQ ID NO: 969163 - DNA, 25 bp, Mus musculus
tccatgagttcatcgatggctaaag

SEQ ID NO: 969164 - DNA, 25 bp, Mus musculus
tccatgagttcatcgatgtctactt

SEQ ID NO: 969165 - DNA, 25 bp, Mus musculus
tccatgattcagaacttaataaagc

SEQ ID NO: 969166 - DNA, 25 bp, Mus musculus
tccatgattcagtacttaataaagc

SEQ ID NO: 969167 - DNA, 25 bp, Mus musculus
tccatgcagtatgctgcctggctga

SEQ ID NO: 969168 - DNA, 25 bp, Mus musculus
tccatgcagtcccccagcctgcaga

SEQ ID NO: 969169 - DNA, 25 bp, Mus musculus
tccatgcagtgccccagcctgcaga

SEQ ID NO: 969170 - DNA, 25 bp, Mus musculus
tccatgcagtttgctgcctggctga

SEQ ID NO: 969171 - DNA, 25 bp, Mus musculus
tccatgcatgtgatctggcagtgag

SEQ ID NO: 969172 - DNA, 25 bp, Mus musculus
tccatgcatgtgttctggcagtgag

SEQ ID NO: 969173 - DNA, 25 bp, Mus musculus
tccatgctgagacacgatataagct

SEQ ID NO: 969174 - DNA, 25 bp, Mus musculus
tccatgctgagacaggatataagct

SEQ ID NO: 969175 - DNA, 25 bp, Mus musculus
tccatgctgtggagattcatgactt

SEQ ID NO: 969176 - DNA, 25 bp, Mus musculus
tccatgctgtggagtttcatgactt

SEQ ID NO: 969177 - DNA, 25 bp, Mus musculus
tccatgctttaacacgttgttccat

SEQ ID NO: 969178 - DNA, 25 bp, Mus musculus
tccatgctttaacaggttgttccat

SEQ ID NO: 969179 - DNA, 25 bp, Mus musculus
tccatggaagatctcatggacacaa

SEQ ID NO: 969180 - DNA, 25 bp, Mus musculus
tccatggaagttctcatggacacaa

SEQ ID NO: 969181 - DNA, 25 bp, Mus musculus
tccatggagatcatcgaggcctact

SEQ ID NO: 969182 - DNA, 25 bp, Mus musculus
tccatggagatcatggaggcctact

SEQ ID NO: 969183 - DNA, 25 bp, Mus musculus
tccatggctcagcaagcttccctgc

SEQ ID NO: 969184 - DNA, 25 bp, Mus musculus
tccatggctcaggaagcttccctgc

SEQ ID NO: 969185 - DNA, 25 bp, Mus musculus
tccatgtcccacaattctcgactat

SEQ ID NO: 969186 - DNA, 25 bp, Mus musculus
tccatgtcccacagtaacccctcta

SEQ ID NO: 969187 - DNA, 25 bp, Mus musculus
tccatgtcccactattctcgactat

SEQ ID NO: 969188 - DNA, 25 bp, Mus musculus
tccatgtcccactgtaacccctcta

SEQ ID NO: 969189 - DNA, 25 bp, Mus musculus
tccatgtcccagacattcagtactg

SEQ ID NO: 969190 - DNA, 25 bp, Mus musculus
tccatgtcccagtcattcagtactg

SEQ ID NO: 969191 - DNA, 25 bp, Mus musculus
tccatgtcggaagttgatcttgaaa

SEQ ID NO: 969192 - DNA, 25 bp, Mus musculus
tccatgtcggatgatcttgaaagtg

SEQ ID NO: 969193 - DNA, 25 bp, Mus musculus
tccatgtcggtagttgatcttgaaa

SEQ ID NO: 969194 - DNA, 25 bp, Mus musculus
tccatgtcggttgatcttgaaagtg

SEQ ID NO: 969195 - DNA, 25 bp, Mus musculus
tccattaaaacaaacatgtctcatt

SEQ ID NO: 969196 - DNA, 25 bp, Mus musculus
tccattaaaacaaagatgtctcatt

SEQ ID NO: 969197 - DNA, 25 bp, Mus musculus
tccattaagcatgacgtagagcggc

SEQ ID NO: 969198 - DNA, 25 bp, Mus musculus
tccattaagcatgaggtagagcggc

SEQ ID NO: 969199 - DNA, 25 bp, Mus musculus
tccattaatactgaggttggaatcc

SEQ ID NO: 969200 - DNA, 25 bp, Mus musculus
tccattaatagtgaggttggaatcc

SEQ ID NO: 969201 - DNA, 25 bp, Mus musculus
tccattcaaactacgatgagatgag

SEQ ID NO: 969202 - DNA, 25 bp, Mus musculus
tccattcaaagtacgatgagatgag

SEQ ID NO: 969203 - DNA, 25 bp, Mus musculus
tccattcagaaaacatagctttcca

SEQ ID NO: 969204 - DNA, 25 bp, Mus musculus
tccattcagaaaacttagctttcca

SEQ ID NO: 969205 - DNA, 25 bp, Mus musculus
tccattctctggaacattaggtcag

SEQ ID NO: 969206 - DNA, 25 bp, Mus musculus
tccattctctggaactcctagtcac

SEQ ID NO: 969207 - DNA, 25 bp, Mus musculus
tccattctctggaagattaggtcag

SEQ ID NO: 969208 - DNA, 25 bp, Mus musculus
tccattctctggaagtcctagtcac

SEQ ID NO: 969209 - DNA, 25 bp, Mus musculus
tccattgaagataacgtcaagtcct

SEQ ID NO: 969210 - DNA, 25 bp, Mus musculus
tccattgaagataaggtcaagtcct

SEQ ID NO: 969211 - DNA, 25 bp, Mus musculus
tccattgcaaagcctgggatcatct

SEQ ID NO: 969212 - DNA, 25 bp, Mus musculus
tccattgcaaaggctgggatcatct

SEQ ID NO: 969213 - DNA, 25 bp, Mus musculus
tccattgctaaacctgggatcacta

SEQ ID NO: 969214 - DNA, 25 bp, Mus musculus
tccattgctaaagctgggatcacta

SEQ ID NO: 969215 - DNA, 25 bp, Mus musculus
tccattgtgaagtcacttattggtg

SEQ ID NO: 969216 - DNA, 25 bp, Mus musculus
tccattgtgaagtctcttattggtg

SEQ ID NO: 969217 - DNA, 25 bp, Mus musculus
tccatttagcatcgctgttggaaag

SEQ ID NO: 969218 - DNA, 25 bp, Mus musculus
tccatttagcatggctgttggaaag

SEQ ID NO: 969219 - DNA, 25 bp, Mus musculus
tccatttcagagctaatcattgatg

SEQ ID NO: 969220 - DNA, 25 bp, Mus musculus
tccatttcagatgctaatcattgat

SEQ ID NO: 969221 - DNA, 25 bp, Mus musculus
tccatttcagtgctaatcattgatg

SEQ ID NO: 969222 - DNA, 25 bp, Mus musculus
tccatttcagttgctaatcattgat

SEQ ID NO: 969223 - DNA, 25 bp, Mus musculus
tccattttagatctccctcactagt

SEQ ID NO: 969224 - DNA, 25 bp, Mus musculus
tccattttagatctgcctcactagt

SEQ ID NO: 969225 - DNA, 25 bp, Mus musculus
tccattttcacgtgcagcctgacag

SEQ ID NO: 969226 - DNA, 25 bp, Mus musculus
tccattttcacgtgcgcgggccagg

SEQ ID NO: 969227 - DNA, 25 bp, Mus musculus
tccattttcacgtggagcctgacag

SEQ ID NO: 969228 - DNA, 25 bp, Mus musculus
tccattttcacgtgggcgggccagg

SEQ ID NO: 969229 - DNA, 25 bp, Mus musculus
tcccaaaaagactcctcatcttgtc

SEQ ID NO: 969230 - DNA, 25 bp, Mus musculus
tcccaaaaagtctcctcatcttgtc

SEQ ID NO: 969231 - DNA, 25 bp, Mus musculus
tcccaaaatcacagaataccacctc

SEQ ID NO: 969232 - DNA, 25 bp, Mus musculus
tcccaaaatcacagagaagcagaac

SEQ ID NO: 969233 - DNA, 25 bp, Mus musculus
tcccaaaatcacagtataccacctc

SEQ ID NO: 969234 - DNA, 25 bp, Mus musculus
tcccaaaatcacagtgaagcagaac

SEQ ID NO: 969235 - DNA, 25 bp, Mus musculus
tcccaaagagagtccctccagtact

SEQ ID NO: 969236 - DNA, 25 bp, Mus musculus
tcccaaagagtgtccctccagtact

SEQ ID NO: 969237 - DNA, 25 bp, Mus musculus
tcccaaagatactggcattgcccga

SEQ ID NO: 969238 - DNA, 25 bp, Mus musculus
tcccaaagattctggcattgcccga

SEQ ID NO: 969239 - DNA, 25 bp, Mus musculus
tcccaaattcagcgagtggcaccac

SEQ ID NO: 969240 - DNA, 25 bp, Mus musculus
tcccaaattcagggagtggcaccac

SEQ ID NO: 969241 - DNA, 25 bp, Mus musculus
tcccaacagcagctctttcagagga

SEQ ID NO: 969242 - DNA, 25 bp, Mus musculus
tcccaacagcaggtctttcagagga

SEQ ID NO: 969243 - DNA, 25 bp, Mus musculus
tcccaacatggacgcggcgtgtctc

SEQ ID NO: 969244 - DNA, 25 bp, Mus musculus
tcccaacatggaggcggcgtgtctc

SEQ ID NO: 969245 - DNA, 25 bp, Mus musculus
tcccaaccagccagaactcattgtg

SEQ ID NO: 969246 - DNA, 25 bp, Mus musculus
tcccaaccaggcagaactcattgtg

SEQ ID NO: 969247 - DNA, 25 bp, Mus musculus
tcccaactacagaaaagcagtcagc

SEQ ID NO: 969248 - DNA, 25 bp, Mus musculus
tcccaactacagtaaagcagtcagc

SEQ ID NO: 969249 - DNA, 25 bp, Mus musculus
tcccaactcccacggatcgttgctg

SEQ ID NO: 969250 - DNA, 25 bp, Mus musculus
tcccaactcccagggatcgttgctg

SEQ ID NO: 969251 - DNA, 25 bp, Mus musculus
tcccaagaaccgaacccgtcctcct

SEQ ID NO: 969252 - DNA, 25 bp, Mus musculus
tcccaagaaccgaagccgtcctcct

SEQ ID NO: 969253 - DNA, 25 bp, Mus musculus
tcccaagaagagtgactggccggaa

SEQ ID NO: 969254 - DNA, 25 bp, Mus musculus
tcccaagaagcattcatttctgcat

SEQ ID NO: 969255 - DNA, 25 bp, Mus musculus
tcccaagaaggattcatttctgcat

SEQ ID NO: 969256 - DNA, 25 bp, Mus musculus
tcccaagaagtgtgactggccggaa

SEQ ID NO: 969257 - DNA, 25 bp, Mus musculus
tcccaagctatgcttctttggctcc

SEQ ID NO: 969258 - DNA, 25 bp, Mus musculus
tcccaagctatggttctttggctcc

SEQ ID NO: 969259 - DNA, 25 bp, Mus musculus
tcccaagcttctgacgagctagaag

SEQ ID NO: 969260 - DNA, 25 bp, Mus musculus
tcccaagcttctgaggagctagaag

SEQ ID NO: 969261 - DNA, 25 bp, Mus musculus
tcccaaggagccccccaagaagctg

SEQ ID NO: 969262 - DNA, 25 bp, Mus musculus
tcccaaggaggcccccaagaagctg

SEQ ID NO: 969263 - DNA, 25 bp, Mus musculus
tcccaatgatcgcagcaagatcagc

SEQ ID NO: 969264 - DNA, 25 bp, Mus musculus
tcccaatgatctgattggctgtgtg

SEQ ID NO: 969265 - DNA, 25 bp, Mus musculus
tcccaatgatggcagcaagatcagc

SEQ ID NO: 969266 - DNA, 25 bp, Mus musculus
tcccaatgatgtgattggctgtgtg

SEQ ID NO: 969267 - DNA, 25 bp, Mus musculus
tcccaatgttgtaccgctgatggat

SEQ ID NO: 969268 - DNA, 25 bp, Mus musculus
tcccaatgttgtacggctgatggat

SEQ ID NO: 969269 - DNA, 25 bp, Mus musculus
tcccacaagtccctggcagacaact

SEQ ID NO: 969270 - DNA, 25 bp, Mus musculus
tcccacaagtgcctggcagacaact

SEQ ID NO: 969271 - DNA, 25 bp, Mus musculus
tcccacacagccttggacaaattac

SEQ ID NO: 969272 - DNA, 25 bp, Mus musculus
tcccacacagctgagaagccctacg

SEQ ID NO: 969273 - DNA, 25 bp, Mus musculus
tcccacacaggcttggacaaattac

SEQ ID NO: 969274 - DNA, 25 bp, Mus musculus
tcccacacaggtgagaagccctacg

SEQ ID NO: 969275 - DNA, 25 bp, Mus musculus
tcccacagaaatcctgcacaatgtc

SEQ ID NO: 969276 - DNA, 25 bp, Mus musculus
tcccacagaaatgctgcacaatgtc

SEQ ID NO: 969277 - DNA, 25 bp, Mus musculus
tcccacagagcttgaaatgggcatg

SEQ ID NO: 969278 - DNA, 25 bp, Mus musculus
tcccacagaggttgaaatgggcatg

SEQ ID NO: 969279 - DNA, 25 bp, Mus musculus
tcccacaggcagcacagtggacatt

SEQ ID NO: 969280 - DNA, 25 bp, Mus musculus
tcccacaggcagcactggacattca

SEQ ID NO: 969281 - DNA, 25 bp, Mus musculus
tcccacaggcagcagagtggacatt

SEQ ID NO: 969282 - DNA, 25 bp, Mus musculus
tcccacaggcagcagtggacattca

SEQ ID NO: 969283 - DNA, 25 bp, Mus musculus
tcccacagtgagacagtactatgcc

SEQ ID NO: 969284 - DNA, 25 bp, Mus musculus
tcccacagtgagtcagtactatgcc

SEQ ID NO: 969285 - DNA, 25 bp, Mus musculus
tcccacatcgacctcattgatctgg

SEQ ID NO: 969286 - DNA, 25 bp, Mus musculus
tcccacatcgacctgattgatctgg

SEQ ID NO: 969287 - DNA, 25 bp, Mus musculus
tcccaccaagaccagggtgacatgg

SEQ ID NO: 969288 - DNA, 25 bp, Mus musculus
tcccaccaagtccagggtgacatgg

SEQ ID NO: 969289 - DNA, 25 bp, Mus musculus
tcccaccaattcccacagagaacca

SEQ ID NO: 969290 - DNA, 25 bp, Mus musculus
tcccaccaattcgcacagagaacca

SEQ ID NO: 969291 - DNA, 25 bp, Mus musculus
tcccaccagatgcaccatccctgga

SEQ ID NO: 969292 - DNA, 25 bp, Mus musculus
tcccaccagatgcacgagagaagat

SEQ ID NO: 969293 - DNA, 25 bp, Mus musculus
tcccaccagatgcactgttgtggtc

SEQ ID NO: 969294 - DNA, 25 bp, Mus musculus
tcccaccagatgcagcatccctgga

SEQ ID NO: 969295 - DNA, 25 bp, Mus musculus
tcccaccagatgcaggagagaagat

SEQ ID NO: 969296 - DNA, 25 bp, Mus musculus
tcccaccagatgcagtgttgtggtc

SEQ ID NO: 969297 - DNA, 25 bp, Mus musculus
tcccacccagaaggctgccttctcc

SEQ ID NO: 969298 - DNA, 25 bp, Mus musculus
tcccacccagtaggctgccttctcc

SEQ ID NO: 969299 - DNA, 25 bp, Mus musculus
tcccaccgagcacgtgacattccca

SEQ ID NO: 969300 - DNA, 25 bp, Mus musculus
tcccaccgagcaggtgacattccca

SEQ ID NO: 969301 - DNA, 25 bp, Mus musculus
tcccacgagaggcttttttgcagat

SEQ ID NO: 969302 - DNA, 25 bp, Mus musculus
tcccacgagagggttttttgcagat

SEQ ID NO: 969303 - DNA, 25 bp, Mus musculus
tcccacggctccaacgatgccaaca

SEQ ID NO: 969304 - DNA, 25 bp, Mus musculus
tcccacggctccaaggatgccaaca

SEQ ID NO: 969305 - DNA, 25 bp, Mus musculus
tcccacggctgcagacctcctgcag

SEQ ID NO: 969306 - DNA, 25 bp, Mus musculus
tcccacggctgctgacctcctgcag

SEQ ID NO: 969307 - DNA, 25 bp, Mus musculus
tcccacgggagactcctaccaggat

SEQ ID NO: 969308 - DNA, 25 bp, Mus musculus
tcccacgggagagtcctaccaggat

SEQ ID NO: 969309 - DNA, 25 bp, Mus musculus
tcccactatagacgactcctaccgg

SEQ ID NO: 969310 - DNA, 25 bp, Mus musculus
tcccactatagaggactcctaccgg

SEQ ID NO: 969311 - DNA, 25 bp, Mus musculus
tcccactctcctcaacttccaggtc

SEQ ID NO: 969312 - DNA, 25 bp, Mus musculus
tcccactctcctcggctgcaactgg

SEQ ID NO: 969313 - DNA, 25 bp, Mus musculus
tcccactctcctcgtcctgagtcag

SEQ ID NO: 969314 - DNA, 25 bp, Mus musculus
tcccactctcctgaacttccaggtc

SEQ ID NO: 969315 - DNA, 25 bp, Mus musculus
tcccactctcctgggctgcaactgg

SEQ ID NO: 969316 - DNA, 25 bp, Mus musculus
tcccactctcctggtcctgagtcag

SEQ ID NO: 969317 - DNA, 25 bp, Mus musculus
tcccactgagcccaatgtgctttgt

SEQ ID NO: 969318 - DNA, 25 bp, Mus musculus
tcccactgaggccaatgtgctttgt

SEQ ID NO: 969319 - DNA, 25 bp, Mus musculus
tcccactgggcctgaagtggaggtg

SEQ ID NO: 969320 - DNA, 25 bp, Mus musculus
tcccactgggcgcacggcgaaagat

SEQ ID NO: 969321 - DNA, 25 bp, Mus musculus
tcccactgggcgcagggcgaaagat

SEQ ID NO: 969322 - DNA, 25 bp, Mus musculus
tcccactggggctgaagtggaggtg

SEQ ID NO: 969323 - DNA, 25 bp, Mus musculus
tcccactgtacgagatggaggccac

SEQ ID NO: 969324 - DNA, 25 bp, Mus musculus
tcccactgtacgtgatggaggccac

SEQ ID NO: 969325 - DNA, 25 bp, Mus musculus
tcccactgtgttgaccacatcgagt

SEQ ID NO: 969326 - DNA, 25 bp, Mus musculus
tcccactgtgttgacgtcctgagtt

SEQ ID NO: 969327 - DNA, 25 bp, Mus musculus
tcccactgtgttgagcacatcgagt

SEQ ID NO: 969328 - DNA, 25 bp, Mus musculus
tcccactgtgttgaggtcctgagtt

SEQ ID NO: 969329 - DNA, 25 bp, Mus musculus
tcccagaagcctcacgaacaaagtg

SEQ ID NO: 969330 - DNA, 25 bp, Mus musculus
tcccagaagcctcaggaacaaagtg

SEQ ID NO: 969331 - DNA, 25 bp, Mus musculus
tcccagaatgatatggctgcagctt

SEQ ID NO: 969332 - DNA, 25 bp, Mus musculus
tcccagaatgcatgtaaccattact

SEQ ID NO: 969333 - DNA, 25 bp, Mus musculus
tcccagaatggatgtaaccattact

SEQ ID NO: 969334 - DNA, 25 bp, Mus musculus
tcccagaatgtgtaattgtaaagtg

SEQ ID NO: 969335 - DNA, 25 bp, Mus musculus
tcccagaatgtgtatttgtaaagtg

SEQ ID NO: 969336 - DNA, 25 bp, Mus musculus
tcccagaatgttatggctgcagctt

SEQ ID NO: 969337 - DNA, 25 bp, Mus musculus
tcccagagccagccacaagatgtga

SEQ ID NO: 969338 - DNA, 25 bp, Mus musculus
tcccagagccaggcacaagatgtga

SEQ ID NO: 969339 - DNA, 25 bp, Mus musculus
tcccagatacaatacgaaacctgtc

SEQ ID NO: 969340 - DNA, 25 bp, Mus musculus
tcccagatacaataggaaacctgtc

SEQ ID NO: 969341 - DNA, 25 bp, Mus musculus
tcccagatcccgctcacgctaacac

SEQ ID NO: 969342 - DNA, 25 bp, Mus musculus
tcccagatccggctcacgctaacac

SEQ ID NO: 969343 - DNA, 25 bp, Mus musculus
tcccagatcgcacctacagaacctt

SEQ ID NO: 969344 - DNA, 25 bp, Mus musculus
tcccagatcgcagctacagaacctt

SEQ ID NO: 969345 - DNA, 25 bp, Mus musculus
tcccagattgaaagtttgaatgaag

SEQ ID NO: 969346 - DNA, 25 bp, Mus musculus
tcccagattgaatgtttgaatgaag

SEQ ID NO: 969347 - DNA, 25 bp, Mus musculus
tcccagcagcaacgtgtctggtcgg

SEQ ID NO: 969348 - DNA, 25 bp, Mus musculus
tcccagcagcaaggtgtctggtcgg

SEQ ID NO: 969349 - DNA, 25 bp, Mus musculus
tcccagcgaaaagcccattggaata

SEQ ID NO: 969350 - DNA, 25 bp, Mus musculus
tcccagcgaatagcccattggaata

SEQ ID NO: 969351 - DNA, 25 bp, Mus musculus
tcccagcgagcacccctgcaactcc

SEQ ID NO: 969352 - DNA, 25 bp, Mus musculus
tcccagcgagcagccctgcaactcc

SEQ ID NO: 969353 - DNA, 25 bp, Mus musculus
tcccagcgtcgtcattagcgatgat

SEQ ID NO: 969354 - DNA, 25 bp, Mus musculus
tcccagcgtcgtgattagcgatgat

SEQ ID NO: 969355 - DNA, 25 bp, Mus musculus
tcccagctggcgtcggagcttccac

SEQ ID NO: 969356 - DNA, 25 bp, Mus musculus
tcccagctggggtcggagcttccac

SEQ ID NO: 969357 - DNA, 25 bp, Mus musculus
tcccagcttcaacggtacacggtcc

SEQ ID NO: 969358 - DNA, 25 bp, Mus musculus
tcccagcttcaagggtacacggtcc

SEQ ID NO: 969359 - DNA, 25 bp, Mus musculus
tcccagcttccctcccaacctcctg

SEQ ID NO: 969360 - DNA, 25 bp, Mus musculus
tcccagcttccctcccggggctgcg

SEQ ID NO: 969361 - DNA, 25 bp, Mus musculus
tcccagcttccctcgcaacctcctg

SEQ ID NO: 969362 - DNA, 25 bp, Mus musculus
tcccagcttccctcgcggggctgcg

SEQ ID NO: 969363 - DNA, 25 bp, Mus musculus
tcccagcttcgcaggacccaacctc

SEQ ID NO: 969364 - DNA, 25 bp, Mus musculus
tcccagcttcgctggacccaacctc

SEQ ID NO: 969365 - DNA, 25 bp, Mus musculus
tcccaggaagctcgagaaggggtgg

SEQ ID NO: 969366 - DNA, 25 bp, Mus musculus
tcccaggaagctcgtccagctcagc

SEQ ID NO: 969367 - DNA, 25 bp, Mus musculus
tcccaggaagctggagaaggggtgg

SEQ ID NO: 969368 - DNA, 25 bp, Mus musculus
tcccaggaagctggtccagctcagc

SEQ ID NO: 969369 - DNA, 25 bp, Mus musculus
tcccaggacgatagccagccctgga

SEQ ID NO: 969370 - DNA, 25 bp, Mus musculus
tcccaggacgcctactggcaggagc

SEQ ID NO: 969371 - DNA, 25 bp, Mus musculus
tcccaggacggctactggcaggagc

SEQ ID NO: 969372 - DNA, 25 bp, Mus musculus
tcccaggacgttagccagccctgga

SEQ ID NO: 969373 - DNA, 25 bp, Mus musculus
tcccaggagacgcaatgacctggat

SEQ ID NO: 969374 - DNA, 25 bp, Mus musculus
tcccaggagacggaatgacctggat

SEQ ID NO: 969375 - DNA, 25 bp, Mus musculus
tcccaggatgctgacgttggtgatg

SEQ ID NO: 969376 - DNA, 25 bp, Mus musculus
tcccaggatgctgaggttggtgatg

SEQ ID NO: 969377 - DNA, 25 bp, Mus musculus
tcccaggccctgaatgaagaagagt

SEQ ID NO: 969378 - DNA, 25 bp, Mus musculus
tcccaggccctgtatgaagaagagt

SEQ ID NO: 969379 - DNA, 25 bp, Mus musculus
tcccaggctacatccttttgtttta

SEQ ID NO: 969380 - DNA, 25 bp, Mus musculus
tcccaggctacatcgttttgtttta

SEQ ID NO: 969381 - DNA, 25 bp, Mus musculus
tcccagggagctcagcacctcggca

SEQ ID NO: 969382 - DNA, 25 bp, Mus musculus
tcccagggaggtcagcacctcggca

SEQ ID NO: 969383 - DNA, 25 bp, Mus musculus
tcccaggtacagatcatattgatca

SEQ ID NO: 969384 - DNA, 25 bp, Mus musculus
tcccaggtacagatgatattgatca

SEQ ID NO: 969385 - DNA, 25 bp, Mus musculus
tcccaggtcgctcacgacatcagca

SEQ ID NO: 969386 - DNA, 25 bp, Mus musculus
tcccaggtcgctcacgcttgcagat

SEQ ID NO: 969387 - DNA, 25 bp, Mus musculus
tcccaggtcgctcaggacatcagca

SEQ ID NO: 969388 - DNA, 25 bp, Mus musculus
tcccaggtcgctcaggcttgcagat

SEQ ID NO: 969389 - DNA, 25 bp, Mus musculus
tcccaggtgctccacgccatccaga

SEQ ID NO: 969390 - DNA, 25 bp, Mus musculus
tcccaggtgctccaggccatccaga

SEQ ID NO: 969391 - DNA, 25 bp, Mus musculus
tcccagtgctgacacggtccctccc

SEQ ID NO: 969392 - DNA, 25 bp, Mus musculus
tcccagtgctgacagggtccctccc

SEQ ID NO: 969393 - DNA, 25 bp, Mus musculus
tcccagtgtccagacgtttgcctgt

SEQ ID NO: 969394 - DNA, 25 bp, Mus musculus
tcccagtgtccagaggtttgcctgt

SEQ ID NO: 969395 - DNA, 25 bp, Mus musculus
tcccagttcaaccgcgagaatttgc

SEQ ID NO: 969396 - DNA, 25 bp, Mus musculus
tcccagttcaaccgggagaatttgc

SEQ ID NO: 969397 - DNA, 25 bp, Mus musculus
tcccagttctcacagccccgtattc

SEQ ID NO: 969398 - DNA, 25 bp, Mus musculus
tcccagttctcagagccccgtattc

SEQ ID NO: 969399 - DNA, 25 bp, Mus musculus
tcccatccagctggtgaagacacac

SEQ ID NO: 969400 - DNA, 25 bp, Mus musculus
tcccatccaggtggtgaagacacac

SEQ ID NO: 969401 - DNA, 25 bp, Mus musculus
tcccatccctagatccagtccctga

SEQ ID NO: 969402 - DNA, 25 bp, Mus musculus
tcccatccctagttccagtccctga

SEQ ID NO: 969403 - DNA, 25 bp, Mus musculus
tcccatctttgtcacggatgttcct

SEQ ID NO: 969404 - DNA, 25 bp, Mus musculus
tcccatctttgtcagggatgttcct

SEQ ID NO: 969405 - DNA, 25 bp, Mus musculus
tcccatgaagcaaggaaatcctttt

SEQ ID NO: 969406 - DNA, 25 bp, Mus musculus
tcccatgaaggaaggaaatcctttt

SEQ ID NO: 969407 - DNA, 25 bp, Mus musculus
tcccatgcgtcacgaaatgtgtttt

SEQ ID NO: 969408 - DNA, 25 bp, Mus musculus
tcccatgcgtcaggaaatgtgtttt

SEQ ID NO: 969409 - DNA, 25 bp, Mus musculus
tcccatgttgatgctggttgttgga

SEQ ID NO: 969410 - DNA, 25 bp, Mus musculus
tcccatgttgttgctggttgttgga

SEQ ID NO: 969411 - DNA, 25 bp, Mus musculus
tcccattgggctgtacacatctggg

SEQ ID NO: 969412 - DNA, 25 bp, Mus musculus
tcccattggggtgtacacatctggg

SEQ ID NO: 969413 - DNA, 25 bp, Mus musculus
tccccaaaatgactgaaatgtgtga

SEQ ID NO: 969414 - DNA, 25 bp, Mus musculus
tccccaaaatgagtgaaatgtgtga

SEQ ID NO: 969415 - DNA, 25 bp, Mus musculus
tccccaacacagatgatgaggacag

SEQ ID NO: 969416 - DNA, 25 bp, Mus musculus
tccccaacacagttgatgaggacag

SEQ ID NO: 969417 - DNA, 25 bp, Mus musculus
tccccaacctcacctttctgacctg

SEQ ID NO: 969418 - DNA, 25 bp, Mus musculus
tccccaacctcagctttctgacctg

SEQ ID NO: 969419 - DNA, 25 bp, Mus musculus
tccccaactctatacgcttcgaggt

SEQ ID NO: 969420 - DNA, 25 bp, Mus musculus
tccccaactctataggcttcgaggt

SEQ ID NO: 969421 - DNA, 25 bp, Mus musculus
tccccaagaaaggggatcctggtgg

SEQ ID NO: 969422 - DNA, 25 bp, Mus musculus
tccccaagaatggggatcctggtgg

SEQ ID NO: 969423 - DNA, 25 bp, Mus musculus
tccccaagacacagacgtgttctgg

SEQ ID NO: 969424 - DNA, 25 bp, Mus musculus
tccccaagacactgacgtgttctgg

SEQ ID NO: 969425 - DNA, 25 bp, Mus musculus
tccccaagagctacttttctcactt

SEQ ID NO: 969426 - DNA, 25 bp, Mus musculus
tccccaagaggtacttttctcactt

SEQ ID NO: 969427 - DNA, 25 bp, Mus musculus
tccccaatcccactcattttaggtg

SEQ ID NO: 969428 - DNA, 25 bp, Mus musculus
tccccaatcccactgattttaggtg

SEQ ID NO: 969429 - DNA, 25 bp, Mus musculus
tccccacctccacggtgaagttgat

SEQ ID NO: 969430 - DNA, 25 bp, Mus musculus
tccccacctccagggtgaagttgat

SEQ ID NO: 969431 - DNA, 25 bp, Mus musculus
tccccacgctacagtcgagagtaca

SEQ ID NO: 969432 - DNA, 25 bp, Mus musculus
tccccacgctactgtcgagagtaca

SEQ ID NO: 969433 - DNA, 25 bp, Mus musculus
tccccacgtatgcacgctctgcctg

SEQ ID NO: 969434 - DNA, 25 bp, Mus musculus
tccccacgtatgcaggctctgcctg

SEQ ID NO: 969435 - DNA, 25 bp, Mus musculus
tccccagagacacggcactgctggc

SEQ ID NO: 969436 - DNA, 25 bp, Mus musculus
tccccagagacagggcactgctggc

SEQ ID NO: 969437 - DNA, 25 bp, Mus musculus
tccccagagataagctgacgctggg

SEQ ID NO: 969438 - DNA, 25 bp, Mus musculus
tccccagagatatgctgacgctggg

SEQ ID NO: 969439 - DNA, 25 bp, Mus musculus
tccccagcacagcaatcttccctgg

SEQ ID NO: 969440 - DNA, 25 bp, Mus musculus
tccccagcacaggaatcttccctgg

SEQ ID NO: 969441 - DNA, 25 bp, Mus musculus
tccccagcagacaacctgagccacc

SEQ ID NO: 969442 - DNA, 25 bp, Mus musculus
tccccagcagctccctggaatcccc

SEQ ID NO: 969443 - DNA, 25 bp, Mus musculus
tccccagcaggtccctggaatcccc

SEQ ID NO: 969444 - DNA, 25 bp, Mus musculus
tccccagcagtcaacctgagccacc

SEQ ID NO: 969445 - DNA, 25 bp, Mus musculus
tccccagcgtgccgatgatgccagg

SEQ ID NO: 969446 - DNA, 25 bp, Mus musculus
tccccagcgtgcggatgatgccagg

SEQ ID NO: 969447 - DNA, 25 bp, Mus musculus
tccccaggaccccggatcagtcaag

SEQ ID NO: 969448 - DNA, 25 bp, Mus musculus
tccccaggacccgggatcagtcaag

SEQ ID NO: 969449 - DNA, 25 bp, Mus musculus
tccccaggagctcttggtgcgcttt

SEQ ID NO: 969450 - DNA, 25 bp, Mus musculus
tccccaggaggtcttggtgcgcttt

SEQ ID NO: 969451 - DNA, 25 bp, Mus musculus
tccccaggtctccccgctctgcttt

SEQ ID NO: 969452 - DNA, 25 bp, Mus musculus
tccccaggtctcccggctctgcttt

SEQ ID NO: 969453 - DNA, 25 bp, Mus musculus
tccccagtcaagacttcagctgaaa

SEQ ID NO: 969454 - DNA, 25 bp, Mus musculus
tccccagtcaagtcttcagctgaaa

SEQ ID NO: 969455 - DNA, 25 bp, Mus musculus
tccccagtctcacatggaagagagc

SEQ ID NO: 969456 - DNA, 25 bp, Mus musculus
tccccagtctcagatggaagagagc

SEQ ID NO: 969457 - DNA, 25 bp, Mus musculus
tccccagttgccaacgatgtggatt

SEQ ID NO: 969458 - DNA, 25 bp, Mus musculus
tccccagttgccaaggatgtggatt

SEQ ID NO: 969459 - DNA, 25 bp, Mus musculus
tccccatacaagcacctcctggacc

SEQ ID NO: 969460 - DNA, 25 bp, Mus musculus
tccccatacaaggacctcctggacc

SEQ ID NO: 969461 - DNA, 25 bp, Mus musculus
tccccatacactcaggtccaagaat

SEQ ID NO: 969462 - DNA, 25 bp, Mus musculus
tccccatacactgaggtccaagaat

SEQ ID NO: 969463 - DNA, 25 bp, Mus musculus
tccccatggacccacaacatgtaga

SEQ ID NO: 969464 - DNA, 25 bp, Mus musculus
tccccatggacccagaacatgtaga

SEQ ID NO: 969465 - DNA, 25 bp, Mus musculus
tcccccaatccacgaggctgctgga

SEQ ID NO: 969466 - DNA, 25 bp, Mus musculus
tcccccaatccactacaggaggctg

SEQ ID NO: 969467 - DNA, 25 bp, Mus musculus
tcccccaatccaggaggctgctgga

SEQ ID NO: 969468 - DNA, 25 bp, Mus musculus
tcccccaatccagtacaggaggctg

SEQ ID NO: 969469 - DNA, 25 bp, Mus musculus
tcccccacagcaccacaagagatac

SEQ ID NO: 969470 - DNA, 25 bp, Mus musculus
tcccccacaggaccacaagagatac

SEQ ID NO: 969471 - DNA, 25 bp, Mus musculus
tcccccaccccccacgacatgacag

SEQ ID NO: 969472 - DNA, 25 bp, Mus musculus
tcccccaccccccaggacatgacag

SEQ ID NO: 969473 - DNA, 25 bp, Mus musculus
tcccccagagaggccaggctgggac

SEQ ID NO: 969474 - DNA, 25 bp, Mus musculus
tcccccagagagtcatggaccaaca

SEQ ID NO: 969475 - DNA, 25 bp, Mus musculus
tcccccagagtggccaggctgggac

SEQ ID NO: 969476 - DNA, 25 bp, Mus musculus
tcccccagagtgtcatggaccaaca

SEQ ID NO: 969477 - DNA, 25 bp, Mus musculus
tcccccatctggaacgcccttctct

SEQ ID NO: 969478 - DNA, 25 bp, Mus musculus
tcccccatctggaaggcccttctct

SEQ ID NO: 969479 - DNA, 25 bp, Mus musculus
tccccccagccacgatgatgtctac

SEQ ID NO: 969480 - DNA, 25 bp, Mus musculus
tccccccagccaggatgatgtctac

SEQ ID NO: 969481 - DNA, 25 bp, Mus musculus
tcccccctgggtctccagccatggc

SEQ ID NO: 969482 - DNA, 25 bp, Mus musculus
tcccccctgggtctcccatggcaat

SEQ ID NO: 969483 - DNA, 25 bp, Mus musculus
tcccccctgggtctgcagccatggc

SEQ ID NO: 969484 - DNA, 25 bp, Mus musculus
tcccccctgggtctgccatggcaat

SEQ ID NO: 969485 - DNA, 25 bp, Mus musculus
tcccccgagctccagtcctcagacg

SEQ ID NO: 969486 - DNA, 25 bp, Mus musculus
tcccccgagctcgagtcctcagacg

SEQ ID NO: 969487 - DNA, 25 bp, Mus musculus
tccccctgaccgaacagctctggct

SEQ ID NO: 969488 - DNA, 25 bp, Mus musculus
tccccctgaccgaagagctctggct

SEQ ID NO: 969489 - DNA, 25 bp, Mus musculus
tcccccttggatgcctctctgcatt

SEQ ID NO: 969490 - DNA, 25 bp, Mus musculus
tcccccttggttgcctctctgcatt

SEQ ID NO: 969491 - DNA, 25 bp, Mus musculus
tccccgacatcgacgtggaggtgga

SEQ ID NO: 969492 - DNA, 25 bp, Mus musculus
tccccgacatcgtcgtggaggtgga

SEQ ID NO: 969493 - DNA, 25 bp, Mus musculus
tccccgactacgatcgacctaacac

SEQ ID NO: 969494 - DNA, 25 bp, Mus musculus
tccccgactacgatggacctaacac

SEQ ID NO: 969495 - DNA, 25 bp, Mus musculus
tccccgcagttgccctgaatgtgta

SEQ ID NO: 969496 - DNA, 25 bp, Mus musculus
tccccgcagttggcctgaatgtgta

SEQ ID NO: 969497 - DNA, 25 bp, Mus musculus
tccccgcgccaccgacaagtgacgc

SEQ ID NO: 969498 - DNA, 25 bp, Mus musculus
tccccgcgccacggacaagtgacgc

SEQ ID NO: 969499 - DNA, 25 bp, Mus musculus
tccccgcggacgccactgagagtat

SEQ ID NO: 969500 - DNA, 25 bp, Mus musculus
tccccgcggacgccatggcaggacc

SEQ ID NO: 969501 - DNA, 25 bp, Mus musculus
tccccgcggacggcactgagagtat

SEQ ID NO: 969502 - DNA, 25 bp, Mus musculus
tccccgcggacggcatggcaggacc

SEQ ID NO: 969503 - DNA, 25 bp, Mus musculus
tccccgctgctccttggccccatgc

SEQ ID NO: 969504 - DNA, 25 bp, Mus musculus
tccccgctgctcgttggccccatgc

SEQ ID NO: 969505 - DNA, 25 bp, Mus musculus
tccccggacgcagctgaagaagaag

SEQ ID NO: 969506 - DNA, 25 bp, Mus musculus
tccccggacggagctgaagaagaag

SEQ ID NO: 969507 - DNA, 25 bp, Mus musculus
tccccggagccacagctcccagaac

SEQ ID NO: 969508 - DNA, 25 bp, Mus musculus
tccccggagccagagctcccagaac

SEQ ID NO: 969509 - DNA, 25 bp, Mus musculus
tccccggataacctggaccatgtgt

SEQ ID NO: 969510 - DNA, 25 bp, Mus musculus
tccccggataacgtggaccatgtgt

SEQ ID NO: 969511 - DNA, 25 bp, Mus musculus
tccccggcggagatgaggaaactga

SEQ ID NO: 969512 - DNA, 25 bp, Mus musculus
tccccggcggagttgaggaaactga

SEQ ID NO: 969513 - DNA, 25 bp, Mus musculus
tccccggttgtcatctatcacggtg

SEQ ID NO: 969514 - DNA, 25 bp, Mus musculus
tccccggttgtcatgtatcacggtg

SEQ ID NO: 969515 - DNA, 25 bp, Mus musculus
tccccgttagcccagcaggtggcca

SEQ ID NO: 969516 - DNA, 25 bp, Mus musculus
tccccgttaggccagcaggtggcca

SEQ ID NO: 969517 - DNA, 25 bp, Mus musculus
tcccctagagccccagaaacttctg

SEQ ID NO: 969518 - DNA, 25 bp, Mus musculus
tcccctagaggcccagaaacttctg

SEQ ID NO: 969519 - DNA, 25 bp, Mus musculus
tcccctatgcctcgtgtgccccaga

SEQ ID NO: 969520 - DNA, 25 bp, Mus musculus
tcccctatgcctggtgtgccccaga

SEQ ID NO: 969521 - DNA, 25 bp, Mus musculus
tcccctcctacacgagcgggagaag

SEQ ID NO: 969522 - DNA, 25 bp, Mus musculus
tcccctcctacaggagcgggagaag

SEQ ID NO: 969523 - DNA, 25 bp, Mus musculus
tcccctcctgaagctgattggcgtc

SEQ ID NO: 969524 - DNA, 25 bp, Mus musculus
tcccctcctgtagctgattggcgtc

SEQ ID NO: 969525 - DNA, 25 bp, Mus musculus
tcccctctcttgcaggtgcaattga

SEQ ID NO: 969526 - DNA, 25 bp, Mus musculus
tcccctctcttggaggtgcaattga

SEQ ID NO: 969527 - DNA, 25 bp, Mus musculus
tcccctcttgcatgtcacggcagtc

SEQ ID NO: 969528 - DNA, 25 bp, Mus musculus
tcccctcttggatgtcacggcagtc

SEQ ID NO: 969529 - DNA, 25 bp, Mus musculus
tcccctgcaaagattcctgcgacgg

SEQ ID NO: 969530 - DNA, 25 bp, Mus musculus
tcccctgcaaagtttcctgcgacgg

SEQ ID NO: 969531 - DNA, 25 bp, Mus musculus
tcccctgccccacacaacattctgg

SEQ ID NO: 969532 - DNA, 25 bp, Mus musculus
tcccctgccccagacaacattctgg

SEQ ID NO: 969533 - DNA, 25 bp, Mus musculus
tcccctgcccggaattctgatcaag

SEQ ID NO: 969534 - DNA, 25 bp, Mus musculus
tcccctgcccggtattctgatcaag

SEQ ID NO: 969535 - DNA, 25 bp, Mus musculus
tcccctgctcccatccttatcattg

SEQ ID NO: 969536 - DNA, 25 bp, Mus musculus
tcccctgctcccatgcttatcattg

SEQ ID NO: 969537 - DNA, 25 bp, Mus musculus
tccccttatcagagcctgccccagt

SEQ ID NO: 969538 - DNA, 25 bp, Mus musculus
tccccttatcagtgcctgccccagt

SEQ ID NO: 969539 - DNA, 25 bp, Mus musculus
tccccttctgaacagcaggttgccc

SEQ ID NO: 969540 - DNA, 25 bp, Mus musculus
tccccttctgtacagcaggttgccc

SEQ ID NO: 969541 - DNA, 25 bp, Mus musculus
tccccttgacctgaaacatcctata

SEQ ID NO: 969542 - DNA, 25 bp, Mus musculus
tccccttgacctgatacatcctata

SEQ ID NO: 969543 - DNA, 25 bp, Mus musculus
tcccctttcagaccagccacagggt

SEQ ID NO: 969544 - DNA, 25 bp, Mus musculus
tcccctttcagacctgccacagggt

SEQ ID NO: 969545 - DNA, 25 bp, Mus musculus
tcccgaaaccaactggagctgattg

SEQ ID NO: 969546 - DNA, 25 bp, Mus musculus
tcccgaaaccaagtggagctgattg

SEQ ID NO: 969547 - DNA, 25 bp, Mus musculus
tcccgaattacactgtcttaatacc

SEQ ID NO: 969548 - DNA, 25 bp, Mus musculus
tcccgaattacagtgtcttaatacc

SEQ ID NO: 969549 - DNA, 25 bp, Mus musculus
tcccgaattctgcacacccatgcag

SEQ ID NO: 969550 - DNA, 25 bp, Mus musculus
tcccgaattctgcacgtatccaacg

SEQ ID NO: 969551 - DNA, 25 bp, Mus musculus
tcccgaattctgcagacccatgcag

SEQ ID NO: 969552 - DNA, 25 bp, Mus musculus
tcccgaattctgcaggtatccaacg

SEQ ID NO: 969553 - DNA, 25 bp, Mus musculus
tcccgaccattgcgtttaatgtgga

SEQ ID NO: 969554 - DNA, 25 bp, Mus musculus
tcccgaccattgggtttaatgtgga

SEQ ID NO: 969555 - DNA, 25 bp, Mus musculus
tcccgacccagagtagctcacactc

SEQ ID NO: 969556 - DNA, 25 bp, Mus musculus
tcccgacccagagttgctcacactc

SEQ ID NO: 969557 - DNA, 25 bp, Mus musculus
tcccgagaagctgatcgtgaagaca

SEQ ID NO: 969558 - DNA, 25 bp, Mus musculus
tcccgagaaggtgatcgtgaagaca

SEQ ID NO: 969559 - DNA, 25 bp, Mus musculus
tcccgagagaaagtcgtggacatag

SEQ ID NO: 969560 - DNA, 25 bp, Mus musculus
tcccgagagaaagtggtggacatag

SEQ ID NO: 969561 - DNA, 25 bp, Mus musculus
tcccgagcagctcaatgaccctgct

SEQ ID NO: 969562 - DNA, 25 bp, Mus musculus
tcccgagcaggtcaatgaccctgct

SEQ ID NO: 969563 - DNA, 25 bp, Mus musculus
tcccgagccagacgagtacttttga

SEQ ID NO: 969564 - DNA, 25 bp, Mus musculus
tcccgagccagaggagtacttttga

SEQ ID NO: 969565 - DNA, 25 bp, Mus musculus
tcccgaggccgacggattatgtgca

SEQ ID NO: 969566 - DNA, 25 bp, Mus musculus
tcccgaggccgagggattatgtgca

SEQ ID NO: 969567 - DNA, 25 bp, Mus musculus
tcccgccgcgcaggagaatggcgct

SEQ ID NO: 969568 - DNA, 25 bp, Mus musculus
tcccgccgcggaggagaatggcgct

SEQ ID NO: 969569 - DNA, 25 bp, Mus musculus
tcccgcgcctctcactgctcaggag

SEQ ID NO: 969570 - DNA, 25 bp, Mus musculus
tcccgcgcctctcagtgctcaggag

SEQ ID NO: 969571 - DNA, 25 bp, Mus musculus
tcccgctgagacgtaggcaattttc

SEQ ID NO: 969572 - DNA, 25 bp, Mus musculus
tcccgctgagctcccgccatcctat

SEQ ID NO: 969573 - DNA, 25 bp, Mus musculus
tcccgctgaggtcccgccatcctat

SEQ ID NO: 969574 - DNA, 25 bp, Mus musculus
tcccgctgagtcgtaggcaattttc

SEQ ID NO: 969575 - DNA, 25 bp, Mus musculus
tcccgctgcccgcccccaatatgcc

SEQ ID NO: 969576 - DNA, 25 bp, Mus musculus
tcccgctgcccgccgccaatatgcc

SEQ ID NO: 969577 - DNA, 25 bp, Mus musculus
tcccggaaggaacgtcggcagctct

SEQ ID NO: 969578 - DNA, 25 bp, Mus musculus
tcccggaaggaaggtcggcagctct

SEQ ID NO: 969579 - DNA, 25 bp, Mus musculus
tcccggaaggatattgaccagtgga

SEQ ID NO: 969580 - DNA, 25 bp, Mus musculus
tcccggaaggttattgaccagtgga

SEQ ID NO: 969581 - DNA, 25 bp, Mus musculus
tcccggcgtccacatgattgctgaa

SEQ ID NO: 969582 - DNA, 25 bp, Mus musculus
tcccggcgtccagatgattgctgaa

SEQ ID NO: 969583 - DNA, 25 bp, Mus musculus
tcccggctcagacgtgcttcgaatc

SEQ ID NO: 969584 - DNA, 25 bp, Mus musculus
tcccggctcagaggtgcttcgaatc

SEQ ID NO: 969585 - DNA, 25 bp, Mus musculus
tcccggctctgtcgtgccttagctg

SEQ ID NO: 969586 - DNA, 25 bp, Mus musculus
tcccggctctgtggtgccttagctg

SEQ ID NO: 969587 - DNA, 25 bp, Mus musculus
tcccggctgcagcgtctgtcaccgc

SEQ ID NO: 969588 - DNA, 25 bp, Mus musculus
tcccggctgcagggtctgtcaccgc

SEQ ID NO: 969589 - DNA, 25 bp, Mus musculus
tcccgggaccccaaagtgccagctg

SEQ ID NO: 969590 - DNA, 25 bp, Mus musculus
tcccgggaccccaatgtgccagctg

SEQ ID NO: 969591 - DNA, 25 bp, Mus musculus
tcccgggggcgaagccattacagtg

SEQ ID NO: 969592 - DNA, 25 bp, Mus musculus
tcccgggggcgaaggcattacagtg

SEQ ID NO: 969593 - DNA, 25 bp, Mus musculus
tcccgggttctgctccagagacagc

SEQ ID NO: 969594 - DNA, 25 bp, Mus musculus
tcccgggttctgctcggccactgcc

SEQ ID NO: 969595 - DNA, 25 bp, Mus musculus
tcccgggttctgctctctcagtgcc

SEQ ID NO: 969596 - DNA, 25 bp, Mus musculus
tcccgggttctgctgcagagacagc

SEQ ID NO: 969597 - DNA, 25 bp, Mus musculus
tcccgggttctgctgggccactgcc

SEQ ID NO: 969598 - DNA, 25 bp, Mus musculus
tcccgggttctgctgtctcagtgcc

SEQ ID NO: 969599 - DNA, 25 bp, Mus musculus
tcccggtggcattactagtgatgag

SEQ ID NO: 969600 - DNA, 25 bp, Mus musculus
tcccggtggcattactgatgaggaa

SEQ ID NO: 969601 - DNA, 25 bp, Mus musculus
tcccggtggcattagtagtgatgag

SEQ ID NO: 969602 - DNA, 25 bp, Mus musculus
tcccggtggcattagtgatgaggaa

SEQ ID NO: 969603 - DNA, 25 bp, Mus musculus
tcccgtctgtaactcggatcatggc

SEQ ID NO: 969604 - DNA, 25 bp, Mus musculus
tcccgtctgtaactctcatcagaga

SEQ ID NO: 969605 - DNA, 25 bp, Mus musculus
tcccgtctgtaactgggatcatggc

SEQ ID NO: 969606 - DNA, 25 bp, Mus musculus
tcccgtctgtaactgtcatcagaga

SEQ ID NO: 969607 - DNA, 25 bp, Mus musculus
tcccgtggtgcgaaagaaaaagtca

SEQ ID NO: 969608 - DNA, 25 bp, Mus musculus
tcccgtggtgcgtaagaaaaagtca

SEQ ID NO: 969609 - DNA, 25 bp, Mus musculus
tcccgttcagagcacatcggagaga

SEQ ID NO: 969610 - DNA, 25 bp, Mus musculus
tcccgttcagagcagatcggagaga

SEQ ID NO: 969611 - DNA, 25 bp, Mus musculus
tccctaaagaaagactttgacctgg

SEQ ID NO: 969612 - DNA, 25 bp, Mus musculus
tccctaaagaaagagtttgacctgg

SEQ ID NO: 969613 - DNA, 25 bp, Mus musculus
tccctaaagaatgactttgacctgg

SEQ ID NO: 969614 - DNA, 25 bp, Mus musculus
tccctaaagaatgagtttgacctgg

SEQ ID NO: 969615 - DNA, 25 bp, Mus musculus
tccctaagcttcctcgtgcaaatag

SEQ ID NO: 969616 - DNA, 25 bp, Mus musculus
tccctaagcttcctggtgcaaatag

SEQ ID NO: 969617 - DNA, 25 bp, Mus musculus
tccctaccatagctttcaatgtgga

SEQ ID NO: 969618 - DNA, 25 bp, Mus musculus
tccctaccataggtttcaatgtgga

SEQ ID NO: 969619 - DNA, 25 bp, Mus musculus
tccctagaagatggattcatgggtg

SEQ ID NO: 969620 - DNA, 25 bp, Mus musculus
tccctagaagatgtgctgccccctg

SEQ ID NO: 969621 - DNA, 25 bp, Mus musculus
tccctagaagcgcaacaacccggat

SEQ ID NO: 969622 - DNA, 25 bp, Mus musculus
tccctagaagggcaacaacccggat

SEQ ID NO: 969623 - DNA, 25 bp, Mus musculus
tccctagaagttggattcatgggtg

SEQ ID NO: 969624 - DNA, 25 bp, Mus musculus
tccctagaagttgtgctgccccctg

SEQ ID NO: 969625 - DNA, 25 bp, Mus musculus
tccctagcgccacaccaggctccat

SEQ ID NO: 969626 - DNA, 25 bp, Mus musculus
tccctagcgccacacgcatggggag

SEQ ID NO: 969627 - DNA, 25 bp, Mus musculus
tccctagcgccacacgctccatgac

SEQ ID NO: 969628 - DNA, 25 bp, Mus musculus
tccctagcgccacagcaggctccat

SEQ ID NO: 969629 - DNA, 25 bp, Mus musculus
tccctagcgccacaggcatggggag

SEQ ID NO: 969630 - DNA, 25 bp, Mus musculus
tccctagcgccacaggctccatgac

SEQ ID NO: 969631 - DNA, 25 bp, Mus musculus
tccctaggggagctcatcaatatct

SEQ ID NO: 969632 - DNA, 25 bp, Mus musculus
tccctaggggaggtcatcaatatct

SEQ ID NO: 969633 - DNA, 25 bp, Mus musculus
tccctagttcaagacgaagaaatgc

SEQ ID NO: 969634 - DNA, 25 bp, Mus musculus
tccctagttcaagacgacacaatgt

SEQ ID NO: 969635 - DNA, 25 bp, Mus musculus
tccctagttcaagaggaagaaatgc

SEQ ID NO: 969636 - DNA, 25 bp, Mus musculus
tccctagttcaagaggacacaatgt

SEQ ID NO: 969637 - DNA, 25 bp, Mus musculus
tccctatccacactgaacggaggtg

SEQ ID NO: 969638 - DNA, 25 bp, Mus musculus
tccctatccacagtgaacggaggtg

SEQ ID NO: 969639 - DNA, 25 bp, Mus musculus
tccctatgaatacacgagtggaggc

SEQ ID NO: 969640 - DNA, 25 bp, Mus musculus
tccctatgaatacaggagtggaggc

SEQ ID NO: 969641 - DNA, 25 bp, Mus musculus
tccctattatcgcaatgactctgac

SEQ ID NO: 969642 - DNA, 25 bp, Mus musculus
tccctattatggcaatgactctgac

SEQ ID NO: 969643 - DNA, 25 bp, Mus musculus
tccctcaatgcaaaaaggccagata

SEQ ID NO: 969644 - DNA, 25 bp, Mus musculus
tccctcaatggaaaaaggccagata

SEQ ID NO: 969645 - DNA, 25 bp, Mus musculus
tccctcacacacctgcacgttctct

SEQ ID NO: 969646 - DNA, 25 bp, Mus musculus
tccctcacactcctgcacgttctct

SEQ ID NO: 969647 - DNA, 25 bp, Mus musculus
tccctcaccaagcttagcaaggagt

SEQ ID NO: 969648 - DNA, 25 bp, Mus musculus
tccctcaccaaggttagcaaggagt

SEQ ID NO: 969649 - DNA, 25 bp, Mus musculus
tccctcacctcccactggcaccacc

SEQ ID NO: 969650 - DNA, 25 bp, Mus musculus
tccctcacctcccagtggcaccacc

SEQ ID NO: 969651 - DNA, 25 bp, Mus musculus
tccctcagactccgggtcgcatccc

SEQ ID NO: 969652 - DNA, 25 bp, Mus musculus
tccctcagactccgtacctcggaat

SEQ ID NO: 969653 - DNA, 25 bp, Mus musculus
tccctcagactccgtcccccagagg

SEQ ID NO: 969654 - DNA, 25 bp, Mus musculus
tccctcagactcggggtcgcatccc

SEQ ID NO: 969655 - DNA, 25 bp, Mus musculus
tccctcagactcggtacctcggaat

SEQ ID NO: 969656 - DNA, 25 bp, Mus musculus
tccctcagactcggtcccccagagg

SEQ ID NO: 969657 - DNA, 25 bp, Mus musculus
tccctcagcaaccatcacttctatg

SEQ ID NO: 969658 - DNA, 25 bp, Mus musculus
tccctcagcatccatcacttctatg

SEQ ID NO: 969659 - DNA, 25 bp, Mus musculus
tccctccagaaaatcttgccatgca

SEQ ID NO: 969660 - DNA, 25 bp, Mus musculus
tccctccagaaattcttgccatgca

SEQ ID NO: 969661 - DNA, 25 bp, Mus musculus
tccctccagatgacaacagacgcat

SEQ ID NO: 969662 - DNA, 25 bp, Mus musculus
tccctccagatgactacagacgcat

SEQ ID NO: 969663 - DNA, 25 bp, Mus musculus
tccctccagatggaaatctgtatcc

SEQ ID NO: 969664 - DNA, 25 bp, Mus musculus
tccctccagatggatatctgtatcc

SEQ ID NO: 969665 - DNA, 25 bp, Mus musculus
tccctccctgccagggggaggagga

SEQ ID NO: 969666 - DNA, 25 bp, Mus musculus
tccctccctggcagggggaggagga

SEQ ID NO: 969667 - DNA, 25 bp, Mus musculus
tccctcgacccatcagactgtttac

SEQ ID NO: 969668 - DNA, 25 bp, Mus musculus
tccctcgacccatctgactgtttac

SEQ ID NO: 969669 - DNA, 25 bp, Mus musculus
tccctctaagcccaacgcctggaaa

SEQ ID NO: 969670 - DNA, 25 bp, Mus musculus
tccctctaaggccaacgcctggaaa

SEQ ID NO: 969671 - DNA, 25 bp, Mus musculus
tccctctatgccaaaaggccagata

SEQ ID NO: 969672 - DNA, 25 bp, Mus musculus
tccctctatggcaaaaggccagata

SEQ ID NO: 969673 - DNA, 25 bp, Mus musculus
tccctctctgctgccgtcatgtagg

SEQ ID NO: 969674 - DNA, 25 bp, Mus musculus
tccctctctgctgcggtcatgtagg

SEQ ID NO: 969675 - DNA, 25 bp, Mus musculus
tccctctgcatgccccagagtggcc

SEQ ID NO: 969676 - DNA, 25 bp, Mus musculus
tccctctgcatgccgcagagtggcc

SEQ ID NO: 969677 - DNA, 25 bp, Mus musculus
tccctctgctagactccttgaacgt

SEQ ID NO: 969678 - DNA, 25 bp, Mus musculus
tccctctgctagtctccttgaacgt

SEQ ID NO: 969679 - DNA, 25 bp, Mus musculus
tccctctggacacttgctgattatg

SEQ ID NO: 969680 - DNA, 25 bp, Mus musculus
tccctctggacagttgctgattatg

SEQ ID NO: 969681 - DNA, 25 bp, Mus musculus
tccctctgtccccacggaacagact

SEQ ID NO: 969682 - DNA, 25 bp, Mus musculus
tccctctgtccccagggaacagact

SEQ ID NO: 969683 - DNA, 25 bp, Mus musculus
tccctctgtgcccaacatctcatca

SEQ ID NO: 969684 - DNA, 25 bp, Mus musculus
tccctctgtgccgaacatctcatca

SEQ ID NO: 969685 - DNA, 25 bp, Mus musculus
tccctgacaaagctgactctcgggc

SEQ ID NO: 969686 - DNA, 25 bp, Mus musculus
tccctgacaaaggtgactctcgggc

SEQ ID NO: 969687 - DNA, 25 bp, Mus musculus
tccctgagctgtgacgcgcagcaag

SEQ ID NO: 969688 - DNA, 25 bp, Mus musculus
tccctgagctgtgaggcgcagcaag

SEQ ID NO: 969689 - DNA, 25 bp, Mus musculus
tccctgagggctacctcggaatcgg

SEQ ID NO: 969690 - DNA, 25 bp, Mus musculus
tccctgaggggtacctcggaatcgg

SEQ ID NO: 969691 - DNA, 25 bp, Mus musculus
tccctgagtacacgcgggccaacaa

SEQ ID NO: 969692 - DNA, 25 bp, Mus musculus
tccctgagtacacgggggccaacaa

SEQ ID NO: 969693 - DNA, 25 bp, Mus musculus
tccctgataagacactatggtggtt

SEQ ID NO: 969694 - DNA, 25 bp, Mus musculus
tccctgataagagactatggtggtt

SEQ ID NO: 969695 - DNA, 25 bp, Mus musculus
tccctgatagagttccaacatctcg

SEQ ID NO: 969696 - DNA, 25 bp, Mus musculus
tccctgatagagttgcaacatctcg

SEQ ID NO: 969697 - DNA, 25 bp, Mus musculus
tccctgatcacaaagcagacccagg

SEQ ID NO: 969698 - DNA, 25 bp, Mus musculus
tccctgatcacatagcagacccagg

SEQ ID NO: 969699 - DNA, 25 bp, Mus musculus
tccctgatccggaatgtggagaaca

SEQ ID NO: 969700 - DNA, 25 bp, Mus musculus
tccctgatccggtatgtggagaaca

SEQ ID NO: 969701 - DNA, 25 bp, Mus musculus
tccctgcaatagaaaggacctaagt

SEQ ID NO: 969702 - DNA, 25 bp, Mus musculus
tccctgcaatagtaaggacctaagt

SEQ ID NO: 969703 - DNA, 25 bp, Mus musculus
tccctgcacaagaacggtgcaggta

SEQ ID NO: 969704 - DNA, 25 bp, Mus musculus
tccctgcacaagaagggtgcaggta

SEQ ID NO: 969705 - DNA, 25 bp, Mus musculus
tccctgcaccttcacgctggagcca

SEQ ID NO: 969706 - DNA, 25 bp, Mus musculus
tccctgcaccttcaggctggagcca

SEQ ID NO: 969707 - DNA, 25 bp, Mus musculus
tccctgcaggctcccacaaaacagc

SEQ ID NO: 969708 - DNA, 25 bp, Mus musculus
tccctgcagggtcccacaaaacagc

SEQ ID NO: 969709 - DNA, 25 bp, Mus musculus
tccctgcatagacgtagttcctaat

SEQ ID NO: 969710 - DNA, 25 bp, Mus musculus
tccctgcatagacgtgtgaaattga

SEQ ID NO: 969711 - DNA, 25 bp, Mus musculus
tccctgcatagaggtagttcctaat

SEQ ID NO: 969712 - DNA, 25 bp, Mus musculus
tccctgcatagaggtgtgaaattga

SEQ ID NO: 969713 - DNA, 25 bp, Mus musculus
tccctgccaaagcggctgactgaaa

SEQ ID NO: 969714 - DNA, 25 bp, Mus musculus
tccctgccaaaggggctgactgaaa

SEQ ID NO: 969715 - DNA, 25 bp, Mus musculus
tccctgccctcacggaggagtttct

SEQ ID NO: 969716 - DNA, 25 bp, Mus musculus
tccctgccctgacggaggagtttct

SEQ ID NO: 969717 - DNA, 25 bp, Mus musculus
tccctgcctgagcagctgcagaagt

SEQ ID NO: 969718 - DNA, 25 bp, Mus musculus
tccctgcctgaggagctgcagaagt

SEQ ID NO: 969719 - DNA, 25 bp, Mus musculus
tccctgccttcagacgccttctaca

SEQ ID NO: 969720 - DNA, 25 bp, Mus musculus
tccctgccttcagaggccttctaca

SEQ ID NO: 969721 - DNA, 25 bp, Mus musculus
tccctgcgcagctccgcatttcagt

SEQ ID NO: 969722 - DNA, 25 bp, Mus musculus
tccctgcgcagctcggcatttcagt

SEQ ID NO: 969723 - DNA, 25 bp, Mus musculus
tccctgctacagcaacttctcctgg

SEQ ID NO: 969724 - DNA, 25 bp, Mus musculus
tccctgctacaggaacttctcctgg

SEQ ID NO: 969725 - DNA, 25 bp, Mus musculus
tccctgctccagctcaccactcctt

SEQ ID NO: 969726 - DNA, 25 bp, Mus musculus
tccctgctccaggtcaccactcctt

SEQ ID NO: 969727 - DNA, 25 bp, Mus musculus
tccctgcttcagcaagcttccctgt

SEQ ID NO: 969728 - DNA, 25 bp, Mus musculus
tccctgcttcaggaagcttccctgt

SEQ ID NO: 969729 - DNA, 25 bp, Mus musculus
tccctgctttttcgagaggacgacc

SEQ ID NO: 969730 - DNA, 25 bp, Mus musculus
tccctgctttttggagaggacgacc

SEQ ID NO: 969731 - DNA, 25 bp, Mus musculus
tccctggacaagctgtggccagcgt

SEQ ID NO: 969732 - DNA, 25 bp, Mus musculus
tccctggacaaggtgtggccagcgt

SEQ ID NO: 969733 - DNA, 25 bp, Mus musculus
tccctggaccaacgtgcttcacctg

SEQ ID NO: 969734 - DNA, 25 bp, Mus musculus
tccctggaccaaggtgcttcacctg

SEQ ID NO: 969735 - DNA, 25 bp, Mus musculus
tccctggcaatctaccttctttggt

SEQ ID NO: 969736 - DNA, 25 bp, Mus musculus
tccctggcaatctagcttctttggt

SEQ ID NO: 969737 - DNA, 25 bp, Mus musculus
tccctggcacagaaacatcatccaa

SEQ ID NO: 969738 - DNA, 25 bp, Mus musculus
tccctggcacagtaacatcatccaa

SEQ ID NO: 969739 - DNA, 25 bp, Mus musculus
tccctggcactgcaagtttccccag

SEQ ID NO: 969740 - DNA, 25 bp, Mus musculus
tccctggcactggaagtttccccag

SEQ ID NO: 969741 - DNA, 25 bp, Mus musculus
tccctggcattacggcaggctggat

SEQ ID NO: 969742 - DNA, 25 bp, Mus musculus
tccctggcattactacactgtagct

SEQ ID NO: 969743 - DNA, 25 bp, Mus musculus
tccctggcattagggcaggctggat

SEQ ID NO: 969744 - DNA, 25 bp, Mus musculus
tccctggcattagtacactgtagct

SEQ ID NO: 969745 - DNA, 25 bp, Mus musculus
tccctggcggttcacaagagcaaga

SEQ ID NO: 969746 - DNA, 25 bp, Mus musculus
tccctggcggttgacaagagcaaga

SEQ ID NO: 969747 - DNA, 25 bp, Mus musculus
tccctggctaagcaagcttccctgt

SEQ ID NO: 969748 - DNA, 25 bp, Mus musculus
tccctggctaaggaagcttccctgt

SEQ ID NO: 969749 - DNA, 25 bp, Mus musculus
tccctgggctgtcgtggtgagaagc

SEQ ID NO: 969750 - DNA, 25 bp, Mus musculus
tccctgggctgtggtggtgagaagc

SEQ ID NO: 969751 - DNA, 25 bp, Mus musculus
tccctgggtgtgaaaccggacttgc

SEQ ID NO: 969752 - DNA, 25 bp, Mus musculus
tccctgggtgtgtaaccggacttgc

SEQ ID NO: 969753 - DNA, 25 bp, Mus musculus
tccctggtacagcaagcttccctgt

SEQ ID NO: 969754 - DNA, 25 bp, Mus musculus
tccctggtacagcaagctttcctgg

SEQ ID NO: 969755 - DNA, 25 bp, Mus musculus
tccctggtacagcttccctgtttca

SEQ ID NO: 969756 - DNA, 25 bp, Mus musculus
tccctggtacaggaagcttccctgt

SEQ ID NO: 969757 - DNA, 25 bp, Mus musculus
tccctggtacaggaagctttcctgg

SEQ ID NO: 969758 - DNA, 25 bp, Mus musculus
tccctggtacaggttccctgtttca

SEQ ID NO: 969759 - DNA, 25 bp, Mus musculus
tccctggtcagtcggagctcaacct

SEQ ID NO: 969760 - DNA, 25 bp, Mus musculus
tccctggtcagtgggagctcaacct

SEQ ID NO: 969761 - DNA, 25 bp, Mus musculus
tccctggtgatgcgtacgaggaact

SEQ ID NO: 969762 - DNA, 25 bp, Mus musculus
tccctggtgatgggtacgaggaact

SEQ ID NO: 969763 - DNA, 25 bp, Mus musculus
tccctgtcatcacattgatcttttc

SEQ ID NO: 969764 - DNA, 25 bp, Mus musculus
tccctgtcatcagattgatcttttc

SEQ ID NO: 969765 - DNA, 25 bp, Mus musculus
tccctgtcggcgcctggcagggatg

SEQ ID NO: 969766 - DNA, 25 bp, Mus musculus
tccctgtcggcggctggcagggatg

SEQ ID NO: 969767 - DNA, 25 bp, Mus musculus
tccctgtctcagcgtgaaacgcaaa

SEQ ID NO: 969768 - DNA, 25 bp, Mus musculus
tccctgtctcagggtgaaacgcaaa

SEQ ID NO: 969769 - DNA, 25 bp, Mus musculus
tccctgtctgtgcccaggagggccg

SEQ ID NO: 969770 - DNA, 25 bp, Mus musculus
tccctgtctgtggccaggagggccg

SEQ ID NO: 969771 - DNA, 25 bp, Mus musculus
tccctgtggcagaggaggtgaagcc

SEQ ID NO: 969772 - DNA, 25 bp, Mus musculus
tccctgtggcagctgaccttggaca

SEQ ID NO: 969773 - DNA, 25 bp, Mus musculus
tccctgtggcaggtgaccttggaca

SEQ ID NO: 969774 - DNA, 25 bp, Mus musculus
tccctgtggcagtggaggtgaagcc

SEQ ID NO: 969775 - DNA, 25 bp, Mus musculus
tccctgtgggcactggtctaggtta

SEQ ID NO: 969776 - DNA, 25 bp, Mus musculus
tccctgtgggcagtggtctaggtta

SEQ ID NO: 969777 - DNA, 25 bp, Mus musculus
tccctgtgtggcaacgttggtgctc

SEQ ID NO: 969778 - DNA, 25 bp, Mus musculus
tccctgtgtggcaaggttggtgctc

SEQ ID NO: 969779 - DNA, 25 bp, Mus musculus
tccctgtttcagcaaccttccatgg

SEQ ID NO: 969780 - DNA, 25 bp, Mus musculus
tccctgtttcagcaaccttccctgc

SEQ ID NO: 969781 - DNA, 25 bp, Mus musculus
tccctgtttcagcaaccttccctgg

SEQ ID NO: 969782 - DNA, 25 bp, Mus musculus
tccctgtttcagcaagcttccctgt

SEQ ID NO: 969783 - DNA, 25 bp, Mus musculus
tccctgtttcagcaatcttccctgg

SEQ ID NO: 969784 - DNA, 25 bp, Mus musculus
tccctgtttcagcttccctgtttca

SEQ ID NO: 969785 - DNA, 25 bp, Mus musculus
tccctgtttcaggaaccttccatgg

SEQ ID NO: 969786 - DNA, 25 bp, Mus musculus
tccctgtttcaggaaccttccctgc

SEQ ID NO: 969787 - DNA, 25 bp, Mus musculus
tccctgtttcaggaaccttccctgg

SEQ ID NO: 969788 - DNA, 25 bp, Mus musculus
tccctgtttcaggaagcttccctgt

SEQ ID NO: 969789 - DNA, 25 bp, Mus musculus
tccctgtttcaggaatcttccctgg

SEQ ID NO: 969790 - DNA, 25 bp, Mus musculus
tccctgtttcaggttccctgtttca

SEQ ID NO: 969791 - DNA, 25 bp, Mus musculus
tccctgtttggagacacatcatttc

SEQ ID NO: 969792 - DNA, 25 bp, Mus musculus
tccctgtttggagacagacatcatt

SEQ ID NO: 969793 - DNA, 25 bp, Mus musculus
tccctgtttggagagacatcatttc

SEQ ID NO: 969794 - DNA, 25 bp, Mus musculus
tccctgtttggagagagacatcatt

SEQ ID NO: 969795 - DNA, 25 bp, Mus musculus
tccctgttttctaccctgcagaaaa

SEQ ID NO: 969796 - DNA, 25 bp, Mus musculus
tccctgttttcttccctgcagaaaa

SEQ ID NO: 969797 - DNA, 25 bp, Mus musculus
tcccttaactgaagtgccggtgaat

SEQ ID NO: 969798 - DNA, 25 bp, Mus musculus
tcccttaactgatgtgccggtgaat

SEQ ID NO: 969799 - DNA, 25 bp, Mus musculus
tcccttgcagccactgcaagaaaaa

SEQ ID NO: 969800 - DNA, 25 bp, Mus musculus
tcccttgcagccagacgttagggga

SEQ ID NO: 969801 - DNA, 25 bp, Mus musculus
tcccttgcagcctctgcaagaaaaa

SEQ ID NO: 969802 - DNA, 25 bp, Mus musculus
tcccttgcagcctgacgttagggga

SEQ ID NO: 969803 - DNA, 25 bp, Mus musculus
tcccttgtaaagaaacgtgtgagaa

SEQ ID NO: 969804 - DNA, 25 bp, Mus musculus
tcccttgtaaagtaacgtgtgagaa

SEQ ID NO: 969805 - DNA, 25 bp, Mus musculus
tccctttctgatcctctgtcagaca

SEQ ID NO: 969806 - DNA, 25 bp, Mus musculus
tccctttctgatgctctgtcagaca

SEQ ID NO: 969807 - DNA, 25 bp, Mus musculus
tccgaaagaactggaataagtgggc

SEQ ID NO: 969808 - DNA, 25 bp, Mus musculus
tccgaaagaagtggaataagtgggc

SEQ ID NO: 969809 - DNA, 25 bp, Mus musculus
tccgaaagcagtctgtggaccacta

SEQ ID NO: 969810 - DNA, 25 bp, Mus musculus
tccgaaagcagtgtgtggaccacta

SEQ ID NO: 969811 - DNA, 25 bp, Mus musculus
tccgaagaccaagccctggaaggta

SEQ ID NO: 969812 - DNA, 25 bp, Mus musculus
tccgaagaccaagccgatctctttc

SEQ ID NO: 969813 - DNA, 25 bp, Mus musculus
tccgaagaccaagcgctggaaggta

SEQ ID NO: 969814 - DNA, 25 bp, Mus musculus
tccgaagaccaagcggatctctttc

SEQ ID NO: 969815 - DNA, 25 bp, Mus musculus
tccgaagtgaggcgcttgcagatgg

SEQ ID NO: 969816 - DNA, 25 bp, Mus musculus
tccgaagtgaggggcttgcagatgg

SEQ ID NO: 969817 - DNA, 25 bp, Mus musculus
tccgaatgaacgagcgagagcggag

SEQ ID NO: 969818 - DNA, 25 bp, Mus musculus
tccgaatgaaggagcgagagcggag

SEQ ID NO: 969819 - DNA, 25 bp, Mus musculus
tccgaatgtggacgccagtgctctc

SEQ ID NO: 969820 - DNA, 25 bp, Mus musculus
tccgaatgtggaggccagtgctctc

SEQ ID NO: 969821 - DNA, 25 bp, Mus musculus
tccgaattagctcgacactcaagtg

SEQ ID NO: 969822 - DNA, 25 bp, Mus musculus
tccgaattagctggacactcaagtg

SEQ ID NO: 969823 - DNA, 25 bp, Mus musculus
tccgacatccaggtcaaactgtttg

SEQ ID NO: 969824 - DNA, 25 bp, Mus musculus
tccgacatccaggtgaaactgtttg

SEQ ID NO: 969825 - DNA, 25 bp, Mus musculus
tccgacatcgagatccgggccaaag

SEQ ID NO: 969826 - DNA, 25 bp, Mus musculus
tccgacatcgatcctgcagtagtaa

SEQ ID NO: 969827 - DNA, 25 bp, Mus musculus
tccgacatcgccagacagacacaaa

SEQ ID NO: 969828 - DNA, 25 bp, Mus musculus
tccgacatcggcagacagacacaaa

SEQ ID NO: 969829 - DNA, 25 bp, Mus musculus
tccgacatcgtgatccgggccaaag

SEQ ID NO: 969830 - DNA, 25 bp, Mus musculus
tccgacatcgttcctgcagtagtaa

SEQ ID NO: 969831 - DNA, 25 bp, Mus musculus
tccgaccaccagcctacctcattca

SEQ ID NO: 969832 - DNA, 25 bp, Mus musculus
tccgaccaccaggctacctcattca

SEQ ID NO: 969833 - DNA, 25 bp, Mus musculus
tccgacctcactcttggccagttct

SEQ ID NO: 969834 - DNA, 25 bp, Mus musculus
tccgacctcactgttggccagttct

SEQ ID NO: 969835 - DNA, 25 bp, Mus musculus
tccgacgctgacatggactgggctg

SEQ ID NO: 969836 - DNA, 25 bp, Mus musculus
tccgacgctgacttggactgggctg

SEQ ID NO: 969837 - DNA, 25 bp, Mus musculus
tccgactcagaacatctcttccagg

SEQ ID NO: 969838 - DNA, 25 bp, Mus musculus
tccgactcagaagatctcttccagg

SEQ ID NO: 969839 - DNA, 25 bp, Mus musculus
tccgactccactgcggactgccaat

SEQ ID NO: 969840 - DNA, 25 bp, Mus musculus
tccgactccagtgcggactgccaat

SEQ ID NO: 969841 - DNA, 25 bp, Mus musculus
tccgagaaagctgataattgatgac

SEQ ID NO: 969842 - DNA, 25 bp, Mus musculus
tccgagaaaggtgataattgatgac

SEQ ID NO: 969843 - DNA, 25 bp, Mus musculus
tccgagaaccagagggcacatctgc

SEQ ID NO: 969844 - DNA, 25 bp, Mus musculus
tccgagaaccagatgataaaattac

SEQ ID NO: 969845 - DNA, 25 bp, Mus musculus
tccgagaaccagtgggcacatctgc

SEQ ID NO: 969846 - DNA, 25 bp, Mus musculus
tccgagaaccagttgataaaattac

SEQ ID NO: 969847 - DNA, 25 bp, Mus musculus
tccgagaagaagaaggaggagaggt

SEQ ID NO: 969848 - DNA, 25 bp, Mus musculus
tccgagaagaagcaggagaggtaca

SEQ ID NO: 969849 - DNA, 25 bp, Mus musculus
tccgagaagaaggaggagaggtaca

SEQ ID NO: 969850 - DNA, 25 bp, Mus musculus
tccgagaagaagtaggaggagaggt

SEQ ID NO: 969851 - DNA, 25 bp, Mus musculus
tccgagagagctgccgttctctgag

SEQ ID NO: 969852 - DNA, 25 bp, Mus musculus
tccgagagaggtgccgttctctgag

SEQ ID NO: 969853 - DNA, 25 bp, Mus musculus
tccgagaggaaccgcgcgagaacca

SEQ ID NO: 969854 - DNA, 25 bp, Mus musculus
tccgagaggaacggcgcgagaacca

SEQ ID NO: 969855 - DNA, 25 bp, Mus musculus
tccgagatattcataacaagaaatc

SEQ ID NO: 969856 - DNA, 25 bp, Mus musculus
tccgagatattcttaacaagaaatc

SEQ ID NO: 969857 - DNA, 25 bp, Mus musculus
tccgagcagaagcaagccatacagg

SEQ ID NO: 969858 - DNA, 25 bp, Mus musculus
tccgagcagaaggaagccatacagg

SEQ ID NO: 969859 - DNA, 25 bp, Mus musculus
tccgagccagcacgagggatctgat

SEQ ID NO: 969860 - DNA, 25 bp, Mus musculus
tccgagccaggacgagggatctgat

SEQ ID NO: 969861 - DNA, 25 bp, Mus musculus
tccgagcccacgtaaactgcagcga

SEQ ID NO: 969862 - DNA, 25 bp, Mus musculus
tccgagcccaggtaaactgcagcga

SEQ ID NO: 969863 - DNA, 25 bp, Mus musculus
tccgaggagctaatcagtgagatga

SEQ ID NO: 969864 - DNA, 25 bp, Mus musculus
tccgaggagctaattctgaagtccc

SEQ ID NO: 969865 - DNA, 25 bp, Mus musculus
tccgaggagctattcagtgagatga

SEQ ID NO: 969866 - DNA, 25 bp, Mus musculus
tccgaggagctatttctgaagtccc

SEQ ID NO: 969867 - DNA, 25 bp, Mus musculus
tccgaggcactccacattctcctgc

SEQ ID NO: 969868 - DNA, 25 bp, Mus musculus
tccgaggcactccagattctcctgc

SEQ ID NO: 969869 - DNA, 25 bp, Mus musculus
tccgagtcagcccaatcgtctccaa

SEQ ID NO: 969870 - DNA, 25 bp, Mus musculus
tccgagtcaggccaatcgtctccaa

SEQ ID NO: 969871 - DNA, 25 bp, Mus musculus
tccgagtgcttgctgccccagccat

SEQ ID NO: 969872 - DNA, 25 bp, Mus musculus
tccgagtgcttggtgccccagccat

SEQ ID NO: 969873 - DNA, 25 bp, Mus musculus
tccgatccaacacaccctcaggact

SEQ ID NO: 969874 - DNA, 25 bp, Mus musculus
tccgatccaacagaccctcaggact

SEQ ID NO: 969875 - DNA, 25 bp, Mus musculus
tccgatgcctgccacggggactcag

SEQ ID NO: 969876 - DNA, 25 bp, Mus musculus
tccgatgcctgccagggggactcag

SEQ ID NO: 969877 - DNA, 25 bp, Mus musculus
tccgcaacagagcgtggtgatgaga

SEQ ID NO: 969878 - DNA, 25 bp, Mus musculus
tccgcaacagcgtggtgatgagagt

SEQ ID NO: 969879 - DNA, 25 bp, Mus musculus
tccgcaacagggtggtgatgagagt

SEQ ID NO: 969880 - DNA, 25 bp, Mus musculus
tccgcaacagtgcgtggtgatgaga

SEQ ID NO: 969881 - DNA, 25 bp, Mus musculus
tccgcaactacacgtctcaccccac

SEQ ID NO: 969882 - DNA, 25 bp, Mus musculus
tccgcaactacaggtctcaccccac

SEQ ID NO: 969883 - DNA, 25 bp, Mus musculus
tccgcaccagagcaacttctgcagg

SEQ ID NO: 969884 - DNA, 25 bp, Mus musculus
tccgcaccagaggaacttctgcagg

SEQ ID NO: 969885 - DNA, 25 bp, Mus musculus
tccgcacccaagattggacaagcac

SEQ ID NO: 969886 - DNA, 25 bp, Mus musculus
tccgcacccaagccagtttggacaa

SEQ ID NO: 969887 - DNA, 25 bp, Mus musculus
tccgcacccaaggcagtttggacaa

SEQ ID NO: 969888 - DNA, 25 bp, Mus musculus
tccgcacccaagtttggacaagcac

SEQ ID NO: 969889 - DNA, 25 bp, Mus musculus
tccgcacccacactcgactgcagaa

SEQ ID NO: 969890 - DNA, 25 bp, Mus musculus
tccgcacccacactcgtgagaagcc

SEQ ID NO: 969891 - DNA, 25 bp, Mus musculus
tccgcacccacactggactgcagaa

SEQ ID NO: 969892 - DNA, 25 bp, Mus musculus
tccgcacccacactggtgagaagcc

SEQ ID NO: 969893 - DNA, 25 bp, Mus musculus
tccgcaccgccaaggagatcataga

SEQ ID NO: 969894 - DNA, 25 bp, Mus musculus
tccgcaccgccatggagatcataga

SEQ ID NO: 969895 - DNA, 25 bp, Mus musculus
tccgcacctccacacaagttcagaa

SEQ ID NO: 969896 - DNA, 25 bp, Mus musculus
tccgcacctccagacaagttcagaa

SEQ ID NO: 969897 - DNA, 25 bp, Mus musculus
tccgcacctgcaacaggagagagtt

SEQ ID NO: 969898 - DNA, 25 bp, Mus musculus
tccgcacctgcaagagagagttgac

SEQ ID NO: 969899 - DNA, 25 bp, Mus musculus
tccgcacctgcatcaggagagagtt

SEQ ID NO: 969900 - DNA, 25 bp, Mus musculus
tccgcacctgcatgagagagttgac

SEQ ID NO: 969901 - DNA, 25 bp, Mus musculus
tccgcagagccgctgccgacatcat

SEQ ID NO: 969902 - DNA, 25 bp, Mus musculus
tccgcagagccggtgccgacatcat

SEQ ID NO: 969903 - DNA, 25 bp, Mus musculus
tccgcagcagattacaatctgtatc

SEQ ID NO: 969904 - DNA, 25 bp, Mus musculus
tccgcagcagcatgagccggcaggt

SEQ ID NO: 969905 - DNA, 25 bp, Mus musculus
tccgcagcaggatgagccggcaggt

SEQ ID NO: 969906 - DNA, 25 bp, Mus musculus
tccgcagcagtttacaatctgtatc

SEQ ID NO: 969907 - DNA, 25 bp, Mus musculus
tccgcagcccacaccgtgacagaaa

SEQ ID NO: 969908 - DNA, 25 bp, Mus musculus
tccgcagcccacacggtgacagaaa

SEQ ID NO: 969909 - DNA, 25 bp, Mus musculus
tccgcagccgagcctcgcgctgtat

SEQ ID NO: 969910 - DNA, 25 bp, Mus musculus
tccgcagccgaggctcgcgctgtat

SEQ ID NO: 969911 - DNA, 25 bp, Mus musculus
tccgcaggattgtaccctctatcac

SEQ ID NO: 969912 - DNA, 25 bp, Mus musculus
tccgcaggattgtagcctctatcac

SEQ ID NO: 969913 - DNA, 25 bp, Mus musculus
tccgcaggcgcctcaaagacttgga

SEQ ID NO: 969914 - DNA, 25 bp, Mus musculus
tccgcaggcggctcaaagacttgga

SEQ ID NO: 969915 - DNA, 25 bp, Mus musculus
tccgcataacttccagagaaggact

SEQ ID NO: 969916 - DNA, 25 bp, Mus musculus
tccgcataacttcctgagaaggact

SEQ ID NO: 969917 - DNA, 25 bp, Mus musculus
tccgcatatgcgctcgtggacgcag

SEQ ID NO: 969918 - DNA, 25 bp, Mus musculus
tccgcatatgcgctcgttccagatg

SEQ ID NO: 969919 - DNA, 25 bp, Mus musculus
tccgcatatgcgctggtggacgcag

SEQ ID NO: 969920 - DNA, 25 bp, Mus musculus
tccgcatatgcgctggttccagatg

SEQ ID NO: 969921 - DNA, 25 bp, Mus musculus
tccgcatccagacgatgctgcccag

SEQ ID NO: 969922 - DNA, 25 bp, Mus musculus
tccgcatccagaggatgctgcccag

SEQ ID NO: 969923 - DNA, 25 bp, Mus musculus
tccgcatctttgactttgatgacga

SEQ ID NO: 969924 - DNA, 25 bp, Mus musculus
tccgcatctttgtctttgatgacga

SEQ ID NO: 969925 - DNA, 25 bp, Mus musculus
tccgccatcgtacgtgccgatcccc

SEQ ID NO: 969926 - DNA, 25 bp, Mus musculus
tccgccatcgtaggtgccgatcccc

SEQ ID NO: 969927 - DNA, 25 bp, Mus musculus
tccgcccaagagctcaaagcccaag

SEQ ID NO: 969928 - DNA, 25 bp, Mus musculus
tccgcccaagtgctcaaagcccaag

SEQ ID NO: 969929 - DNA, 25 bp, Mus musculus
tccgcccttgtgcgtagctcctaca

SEQ ID NO: 969930 - DNA, 25 bp, Mus musculus
tccgcccttgtgggtagctcctaca

SEQ ID NO: 969931 - DNA, 25 bp, Mus musculus
tccgccgcggcccacgttaaatgga

SEQ ID NO: 969932 - DNA, 25 bp, Mus musculus
tccgccgcggcccaggttaaatgga

SEQ ID NO: 969933 - DNA, 25 bp, Mus musculus
tccgcctatccacacatgctacgga

SEQ ID NO: 969934 - DNA, 25 bp, Mus musculus
tccgcctatccacagatgctacgga

SEQ ID NO: 969935 - DNA, 25 bp, Mus musculus
tccgcctttggcaactgcgagtgct

SEQ ID NO: 969936 - DNA, 25 bp, Mus musculus
tccgcctttggcactgtagctatct

SEQ ID NO: 969937 - DNA, 25 bp, Mus musculus
tccgcctttggcagtcagaccaagc

SEQ ID NO: 969938 - DNA, 25 bp, Mus musculus
tccgcctttggctactgcgagtgct

SEQ ID NO: 969939 - DNA, 25 bp, Mus musculus
tccgcctttggctctgtagctatct

SEQ ID NO: 969940 - DNA, 25 bp, Mus musculus
tccgcctttggctgtcagaccaagc

SEQ ID NO: 969941 - DNA, 25 bp, Mus musculus
tccgcgacgccgctgccttcgccgg

SEQ ID NO: 969942 - DNA, 25 bp, Mus musculus
tccgcgacgccggtgccttcgccgg

SEQ ID NO: 969943 - DNA, 25 bp, Mus musculus
tccgcgactccactgtatagaaaaa

SEQ ID NO: 969944 - DNA, 25 bp, Mus musculus
tccgcgactccagtgtatagaaaaa

SEQ ID NO: 969945 - DNA, 25 bp, Mus musculus
tccgcgccagcctcctgcttcagct

SEQ ID NO: 969946 - DNA, 25 bp, Mus musculus
tccgcgccaggctcctgcttcagct

SEQ ID NO: 969947 - DNA, 25 bp, Mus musculus
tccgcgcgcgcggagctgccattgc

SEQ ID NO: 969948 - DNA, 25 bp, Mus musculus
tccgcgcgcggggagctgccattgc

SEQ ID NO: 969949 - DNA, 25 bp, Mus musculus
tccgcgggctcaggaaatataagaa

SEQ ID NO: 969950 - DNA, 25 bp, Mus musculus
tccgcgggctgaggaaatataagaa

SEQ ID NO: 969951 - DNA, 25 bp, Mus musculus
tccgcggggactggacacctgggct

SEQ ID NO: 969952 - DNA, 25 bp, Mus musculus
tccgcggggactggtcacctgggct

SEQ ID NO: 969953 - DNA, 25 bp, Mus musculus
tccgctcccagaatcgatgtaacca

SEQ ID NO: 969954 - DNA, 25 bp, Mus musculus
tccgctcccagaatcttatggctgc

SEQ ID NO: 969955 - DNA, 25 bp, Mus musculus
tccgctcccagaatggatgtaacca

SEQ ID NO: 969956 - DNA, 25 bp, Mus musculus
tccgctcccagaatgttatggctgc

SEQ ID NO: 969957 - DNA, 25 bp, Mus musculus
tccgctcgttcgattctctcatatc

SEQ ID NO: 969958 - DNA, 25 bp, Mus musculus
tccgctcgttcgtttctctcatatc

SEQ ID NO: 969959 - DNA, 25 bp, Mus musculus
tccgctgagcagctatgtgtgtgga

SEQ ID NO: 969960 - DNA, 25 bp, Mus musculus
tccgctgagcaggtatgtgtgtgga

SEQ ID NO: 969961 - DNA, 25 bp, Mus musculus
tccggaagccaacaggcctctttat

SEQ ID NO: 969962 - DNA, 25 bp, Mus musculus
tccggaagccaagaggcctctttat

SEQ ID NO: 969963 - DNA, 25 bp, Mus musculus
tccggaaggaccttcgtccacccga

SEQ ID NO: 969964 - DNA, 25 bp, Mus musculus
tccggaaggagcttcgtccacccga

SEQ ID NO: 969965 - DNA, 25 bp, Mus musculus
tccggaagtcatcgaagtcctgcaa

SEQ ID NO: 969966 - DNA, 25 bp, Mus musculus
tccggaagtcatggaagtcctgcaa

SEQ ID NO: 969967 - DNA, 25 bp, Mus musculus
tccggaatgccacgtcatcctccca

SEQ ID NO: 969968 - DNA, 25 bp, Mus musculus
tccggaatgccaggtcatcctccca

SEQ ID NO: 969969 - DNA, 25 bp, Mus musculus
tccggagcggggcccgggtctgcgt

SEQ ID NO: 969970 - DNA, 25 bp, Mus musculus
tccggagcggggccggggtctgcgt

SEQ ID NO: 969971 - DNA, 25 bp, Mus musculus
tccggagctgcactgaacttttgaa

SEQ ID NO: 969972 - DNA, 25 bp, Mus musculus
tccggagctggactgaacttttgaa

SEQ ID NO: 969973 - DNA, 25 bp, Mus musculus
tccggaggatcaagacgaaactgca

SEQ ID NO: 969974 - DNA, 25 bp, Mus musculus
tccggaggatcaagagttgaaagcg

SEQ ID NO: 969975 - DNA, 25 bp, Mus musculus
tccggaggatcaagtcgaaactgca

SEQ ID NO: 969976 - DNA, 25 bp, Mus musculus
tccggaggatcaagtgttgaaagcg

SEQ ID NO: 969977 - DNA, 25 bp, Mus musculus
tccggagtgcggagcgcgggggcag

SEQ ID NO: 969978 - DNA, 25 bp, Mus musculus
tccggagtgcggagggcgggggcag

SEQ ID NO: 969979 - DNA, 25 bp, Mus musculus
tccggatggagacggaagccttgct

SEQ ID NO: 969980 - DNA, 25 bp, Mus musculus
tccggatggagagggaagccttgct

SEQ ID NO: 969981 - DNA, 25 bp, Mus musculus
tccggcaaattacgtctgactttgt

SEQ ID NO: 969982 - DNA, 25 bp, Mus musculus
tccggcaaattaggtctgactttgt

SEQ ID NO: 969983 - DNA, 25 bp, Mus musculus
tccggcaacgacatgtcccgtggtc

SEQ ID NO: 969984 - DNA, 25 bp, Mus musculus
tccggcaacgacttgtcccgtggtc

SEQ ID NO: 969985 - DNA, 25 bp, Mus musculus
tccggcacaaagcaacctacctgac

SEQ ID NO: 969986 - DNA, 25 bp, Mus musculus
tccggcacaaaggaacctacctgac

SEQ ID NO: 969987 - DNA, 25 bp, Mus musculus
tccggcatgctgcgtatcatcatta

SEQ ID NO: 969988 - DNA, 25 bp, Mus musculus
tccggcatgctgggtatcatcatta

SEQ ID NO: 969989 - DNA, 25 bp, Mus musculus
tccggccattctttcagtgtctgtg

SEQ ID NO: 969990 - DNA, 25 bp, Mus musculus
tccggccattgtttcagtgtctgtg

SEQ ID NO: 969991 - DNA, 25 bp, Mus musculus
tccggccctacgcacctcccacaga

SEQ ID NO: 969992 - DNA, 25 bp, Mus musculus
tccggccctacgcacgtcctgtcca

SEQ ID NO: 969993 - DNA, 25 bp, Mus musculus
tccggccctacgcagctcccacaga

SEQ ID NO: 969994 - DNA, 25 bp, Mus musculus
tccggccctacgcaggtcctgtcca

SEQ ID NO: 969995 - DNA, 25 bp, Mus musculus
tccggcctcgtgcgtccacaaggct

SEQ ID NO: 969996 - DNA, 25 bp, Mus musculus
tccggcctcgtgggtccacaaggct

SEQ ID NO: 969997 - DNA, 25 bp, Mus musculus
tccggccttttccacatggatgtcc

SEQ ID NO: 969998 - DNA, 25 bp, Mus musculus
tccggccttttccagatggatgtcc

SEQ ID NO: 969999 - DNA, 25 bp, Mus musculus
tccggcgacatgcctaaacgcacca

SEQ ID NO: 970000 - DNA, 25 bp, Mus musculus
tccggcgacatggctaaacgcacca

SEQ ID NO: 970001 - DNA, 25 bp, Mus musculus
tccggcggcaaaaggacattctcct

SEQ ID NO: 970002 - DNA, 25 bp, Mus musculus
tccggcggcaaatggacattctcct

SEQ ID NO: 970003 - DNA, 25 bp, Mus musculus
tccggctaggcttgttcctgcttga

SEQ ID NO: 970004 - DNA, 25 bp, Mus musculus
tccggctagggttgttcctgcttga

SEQ ID NO: 970005 - DNA, 25 bp, Mus musculus
tccggctcagatatgtcactgtcca

SEQ ID NO: 970006 - DNA, 25 bp, Mus musculus
tccggctcagatttgtcactgtcca

SEQ ID NO: 970007 - DNA, 25 bp, Mus musculus
tccggctcccgccacagctcaggcc

SEQ ID NO: 970008 - DNA, 25 bp, Mus musculus
tccggctcccgccacctcaaggtga

SEQ ID NO: 970009 - DNA, 25 bp, Mus musculus
tccggctcccgccacgagaatggtg

SEQ ID NO: 970010 - DNA, 25 bp, Mus musculus
tccggctcccgccagagctcaggcc

SEQ ID NO: 970011 - DNA, 25 bp, Mus musculus
tccggctcccgccagctcaaggtga

SEQ ID NO: 970012 - DNA, 25 bp, Mus musculus
tccggctcccgccaggagaatggtg

SEQ ID NO: 970013 - DNA, 25 bp, Mus musculus
tccggcttgatagtcagattggcag

SEQ ID NO: 970014 - DNA, 25 bp, Mus musculus
tccggcttgatagtgagattggcag

SEQ ID NO: 970015 - DNA, 25 bp, Mus musculus
tccgggacactgcgatcttccttga

SEQ ID NO: 970016 - DNA, 25 bp, Mus musculus
tccgggacactgggatcttccttga

SEQ ID NO: 970017 - DNA, 25 bp, Mus musculus
tccgggactctgatcatgttcttgg

SEQ ID NO: 970018 - DNA, 25 bp, Mus musculus
tccgggactctgatgatgttcttgg

SEQ ID NO: 970019 - DNA, 25 bp, Mus musculus
tccgggattgtgctttgagcgctgc

SEQ ID NO: 970020 - DNA, 25 bp, Mus musculus
tccgggattgtggtttgagcgctgc

SEQ ID NO: 970021 - DNA, 25 bp, Mus musculus
tccgggcagacgccagcatccgctt

SEQ ID NO: 970022 - DNA, 25 bp, Mus musculus
tccgggcagacggcagcatccgctt

SEQ ID NO: 970023 - DNA, 25 bp, Mus musculus
tccggggacgagatgatttttgatc

SEQ ID NO: 970024 - DNA, 25 bp, Mus musculus
tccggggacgagttgatttttgatc

SEQ ID NO: 970025 - DNA, 25 bp, Mus musculus
tccgggggacagatgcagctatcta

SEQ ID NO: 970026 - DNA, 25 bp, Mus musculus
tccgggggacagttgcagctatcta

SEQ ID NO: 970027 - DNA, 25 bp, Mus musculus
tccggtcactatcagtgaaacatct

SEQ ID NO: 970028 - DNA, 25 bp, Mus musculus
tccggtcactatcgtgataaagtta

SEQ ID NO: 970029 - DNA, 25 bp, Mus musculus
tccggtcactatgagtgaaacatct

SEQ ID NO: 970030 - DNA, 25 bp, Mus musculus
tccggtcactatggtgataaagtta

SEQ ID NO: 970031 - DNA, 25 bp, Mus musculus
tccggtcattagcttcaaccagatg

SEQ ID NO: 970032 - DNA, 25 bp, Mus musculus
tccggtcattaggttcaaccagatg

SEQ ID NO: 970033 - DNA, 25 bp, Mus musculus
tccggtggggatcccgacacagctg

SEQ ID NO: 970034 - DNA, 25 bp, Mus musculus
tccggtggggatccggacacagctg

SEQ ID NO: 970035 - DNA, 25 bp, Mus musculus
tccggtggtccacgaatggcctgcc

SEQ ID NO: 970036 - DNA, 25 bp, Mus musculus
tccggtggtccaggaatggcctgcc

SEQ ID NO: 970037 - DNA, 25 bp, Mus musculus
tccgtaggaagaagtccctctcgtg

SEQ ID NO: 970038 - DNA, 25 bp, Mus musculus
tccgtaggaagatgtccctctcgtg

SEQ ID NO: 970039 - DNA, 25 bp, Mus musculus
tccgtcagatgacccctaggaccat

SEQ ID NO: 970040 - DNA, 25 bp, Mus musculus
tccgtcagatgagccctaggaccat

SEQ ID NO: 970041 - DNA, 25 bp, Mus musculus
tccgtcccccacacacctgctctca

SEQ ID NO: 970042 - DNA, 25 bp, Mus musculus
tccgtccccctcacacctgctctca

SEQ ID NO: 970043 - DNA, 25 bp, Mus musculus
tccgtcctacaaacctcatccagct

SEQ ID NO: 970044 - DNA, 25 bp, Mus musculus
tccgtcctactaacctcatccagct

SEQ ID NO: 970045 - DNA, 25 bp, Mus musculus
tccgtcctggatactccatgtttcc

SEQ ID NO: 970046 - DNA, 25 bp, Mus musculus
tccgtcctggttactccatgtttcc

SEQ ID NO: 970047 - DNA, 25 bp, Mus musculus
tccgtcggaaccctctcttctgtgg

SEQ ID NO: 970048 - DNA, 25 bp, Mus musculus
tccgtcggaagcctctcttctgtgg

SEQ ID NO: 970049 - DNA, 25 bp, Mus musculus
tccgtctacttaacaatacaacaca

SEQ ID NO: 970050 - DNA, 25 bp, Mus musculus
tccgtctacttaactatacaacaca

SEQ ID NO: 970051 - DNA, 25 bp, Mus musculus
tccgtgaatatacgaaggaagagag

SEQ ID NO: 970052 - DNA, 25 bp, Mus musculus
tccgtgaatataggaaggaagagag

SEQ ID NO: 970053 - DNA, 25 bp, Mus musculus
tccgtgacagactcaaactagaaac

SEQ ID NO: 970054 - DNA, 25 bp, Mus musculus
tccgtgacagcccctttgaacggac

SEQ ID NO: 970055 - DNA, 25 bp, Mus musculus
tccgtgacaggccctttgaacggac

SEQ ID NO: 970056 - DNA, 25 bp, Mus musculus
tccgtgacagtctcaaactagaaac

SEQ ID NO: 970057 - DNA, 25 bp, Mus musculus
tccgtgactgactcatctgaaggcc

SEQ ID NO: 970058 - DNA, 25 bp, Mus musculus
tccgtgactgtctcatctgaaggcc

SEQ ID NO: 970059 - DNA, 25 bp, Mus musculus
tccgtgcccgagattcaggtgccat

SEQ ID NO: 970060 - DNA, 25 bp, Mus musculus
tccgtgcccgagtttcaggtgccat

SEQ ID NO: 970061 - DNA, 25 bp, Mus musculus
tccgtgcccgtatacattacatctc

SEQ ID NO: 970062 - DNA, 25 bp, Mus musculus
tccgtgcccgtatacgcacgtcagc

SEQ ID NO: 970063 - DNA, 25 bp, Mus musculus
tccgtgcccgtatagattacatctc

SEQ ID NO: 970064 - DNA, 25 bp, Mus musculus
tccgtgcccgtataggcacgtcagc

SEQ ID NO: 970065 - DNA, 25 bp, Mus musculus
tccgtgctggcggcagaatcctttc

SEQ ID NO: 970066 - DNA, 25 bp, Mus musculus
tccgtgctgggggcagaatcctttc

SEQ ID NO: 970067 - DNA, 25 bp, Mus musculus
tccgtggcacggcacgattcacaga

SEQ ID NO: 970068 - DNA, 25 bp, Mus musculus
tccgtggcacggcaggattcacaga

SEQ ID NO: 970069 - DNA, 25 bp, Mus musculus
tccgtgtgcaggatgttcattctgg

SEQ ID NO: 970070 - DNA, 25 bp, Mus musculus
tccgtgtgcaggttgttcattctgg

SEQ ID NO: 970071 - DNA, 25 bp, Mus musculus
tccgtgttggcagatggcaaattcc

SEQ ID NO: 970072 - DNA, 25 bp, Mus musculus
tccgtgttgggagatggcaaattcc

SEQ ID NO: 970073 - DNA, 25 bp, Mus musculus
tccgttgtctcagctaccaaggggg

SEQ ID NO: 970074 - DNA, 25 bp, Mus musculus
tccgttgtctctaccaagggggtgc

SEQ ID NO: 970075 - DNA, 25 bp, Mus musculus
tccgttgtctgagctaccaaggggg

SEQ ID NO: 970076 - DNA, 25 bp, Mus musculus
tccgttgtctgtaccaagggggtgc

SEQ ID NO: 970077 - DNA, 25 bp, Mus musculus
tccgtttgcaagctgacacgcttgg

SEQ ID NO: 970078 - DNA, 25 bp, Mus musculus
tccgtttgcaaggtgacacgcttgg

SEQ ID NO: 970079 - DNA, 25 bp, Mus musculus
tcctaaagagctcagcttggactcc

SEQ ID NO: 970080 - DNA, 25 bp, Mus musculus
tcctaaagaggtcagcttggactcc

SEQ ID NO: 970081 - DNA, 25 bp, Mus musculus
tcctaaagatactggcattgctcgt

SEQ ID NO: 970082 - DNA, 25 bp, Mus musculus
tcctaaagattctggcattgctcgt

SEQ ID NO: 970083 - DNA, 25 bp, Mus musculus
tcctaaatttaactatgcagtactg

SEQ ID NO: 970084 - DNA, 25 bp, Mus musculus
tcctaaatttaagtatgcagtactg

SEQ ID NO: 970085 - DNA, 25 bp, Mus musculus
tcctaaccagctaagatggaaacca

SEQ ID NO: 970086 - DNA, 25 bp, Mus musculus
tcctaaccaggtaagatggaaacca

SEQ ID NO: 970087 - DNA, 25 bp, Mus musculus
tcctaactgctaagcaagctctgag

SEQ ID NO: 970088 - DNA, 25 bp, Mus musculus
tcctaactgctatgcaagctctgag

SEQ ID NO: 970089 - DNA, 25 bp, Mus musculus
tcctaatgagagcaaagatgatgaa

SEQ ID NO: 970090 - DNA, 25 bp, Mus musculus
tcctaatgagagcatagatgatgaa

SEQ ID NO: 970091 - DNA, 25 bp, Mus musculus
tcctaatgcccactcgaggaggtaa

SEQ ID NO: 970092 - DNA, 25 bp, Mus musculus
tcctaatgcccactggaggaggtaa

SEQ ID NO: 970093 - DNA, 25 bp, Mus musculus
tcctaattcccaccaggtctctggg

SEQ ID NO: 970094 - DNA, 25 bp, Mus musculus
tcctaattcccacgtctctgggggt

SEQ ID NO: 970095 - DNA, 25 bp, Mus musculus
tcctaattcccagcaggtctctggg

SEQ ID NO: 970096 - DNA, 25 bp, Mus musculus
tcctaattcccaggtctctgggggt

SEQ ID NO: 970097 - DNA, 25 bp, Mus musculus
tcctacaaagagctggcagaactgg

SEQ ID NO: 970098 - DNA, 25 bp, Mus musculus
tcctacaaagaggtggcagaactgg

SEQ ID NO: 970099 - DNA, 25 bp, Mus musculus
tcctacacaaaaagctgttcagcag

SEQ ID NO: 970100 - DNA, 25 bp, Mus musculus
tcctacacaaaatgctgttcagcag

SEQ ID NO: 970101 - DNA, 25 bp, Mus musculus
tcctacacagcatggaccgcgatgg

SEQ ID NO: 970102 - DNA, 25 bp, Mus musculus
tcctacacaggatggaccgcgatgg

SEQ ID NO: 970103 - DNA, 25 bp, Mus musculus
tcctacactgcgctcctccaccaca

SEQ ID NO: 970104 - DNA, 25 bp, Mus musculus
tcctacactgggctcctccaccaca

SEQ ID NO: 970105 - DNA, 25 bp, Mus musculus
tcctacagagctaactatgtgagac

SEQ ID NO: 970106 - DNA, 25 bp, Mus musculus
tcctacagagctaagtatgtgagac

SEQ ID NO: 970107 - DNA, 25 bp, Mus musculus
tcctacagcaagccatcgtcaagtc

SEQ ID NO: 970108 - DNA, 25 bp, Mus musculus
tcctacagcaaggcatcgtcaagtc

SEQ ID NO: 970109 - DNA, 25 bp, Mus musculus
tcctacattgatttgtctgtgattg

SEQ ID NO: 970110 - DNA, 25 bp, Mus musculus
tcctacattgttttgtctgtgattg

SEQ ID NO: 970111 - DNA, 25 bp, Mus musculus
tcctaccaaagtctagtgatttgaa

SEQ ID NO: 970112 - DNA, 25 bp, Mus musculus
tcctaccaaagtcttgtgatttgaa

SEQ ID NO: 970113 - DNA, 25 bp, Mus musculus
tcctaccagcctgtcgaatagtcac

SEQ ID NO: 970114 - DNA, 25 bp, Mus musculus
tcctaccagcctgtcggtccgaagc

SEQ ID NO: 970115 - DNA, 25 bp, Mus musculus
tcctaccagcctgtggaatagtcac

SEQ ID NO: 970116 - DNA, 25 bp, Mus musculus
tcctaccagcctgtgggtccgaagc

SEQ ID NO: 970117 - DNA, 25 bp, Mus musculus
tcctacctcatgcgggtatcagtga

SEQ ID NO: 970118 - DNA, 25 bp, Mus musculus
tcctacctcatgggggtatcagtga

SEQ ID NO: 970119 - DNA, 25 bp, Mus musculus
tcctacctgaagagcaccaagctgt

SEQ ID NO: 970120 - DNA, 25 bp, Mus musculus
tcctacctgaagtgcaccaagctgt

SEQ ID NO: 970121 - DNA, 25 bp, Mus musculus
tcctacgctgtgcacttaactggac

SEQ ID NO: 970122 - DNA, 25 bp, Mus musculus
tcctacgctgtgcagttaactggac

SEQ ID NO: 970123 - DNA, 25 bp, Mus musculus
tcctacggtcagcaaaccgcatcat

SEQ ID NO: 970124 - DNA, 25 bp, Mus musculus
tcctacggtcaggaaaccgcatcat

SEQ ID NO: 970125 - DNA, 25 bp, Mus musculus
tcctacgtcattcgtacagccagtg

SEQ ID NO: 970126 - DNA, 25 bp, Mus musculus
tcctacgtcattggtacagccagtg

SEQ ID NO: 970127 - DNA, 25 bp, Mus musculus
tcctacgtcctgcacagcgacgttt

SEQ ID NO: 970128 - DNA, 25 bp, Mus musculus
tcctacgtcctgcagagcgacgttt

SEQ ID NO: 970129 - DNA, 25 bp, Mus musculus
tcctactacacgaccaaggacaaaa

SEQ ID NO: 970130 - DNA, 25 bp, Mus musculus
tcctactacacgtccaaggacaaaa

SEQ ID NO: 970131 - DNA, 25 bp, Mus musculus
tcctactctgtggacgtcagctaca

SEQ ID NO: 970132 - DNA, 25 bp, Mus musculus
tcctactctgtggaggtcagctaca

SEQ ID NO: 970133 - DNA, 25 bp, Mus musculus
tcctactggaagagccatgaagaat

SEQ ID NO: 970134 - DNA, 25 bp, Mus musculus
tcctactggaagcagagccatgaag

SEQ ID NO: 970135 - DNA, 25 bp, Mus musculus
tcctactggaagctacccagggcat

SEQ ID NO: 970136 - DNA, 25 bp, Mus musculus
tcctactggaaggagagccatgaag

SEQ ID NO: 970137 - DNA, 25 bp, Mus musculus
tcctactggaaggtacccagggcat

SEQ ID NO: 970138 - DNA, 25 bp, Mus musculus
tcctactggaagtgccatgaagaat

SEQ ID NO: 970139 - DNA, 25 bp, Mus musculus
tcctactgtgcacgactctagggct

SEQ ID NO: 970140 - DNA, 25 bp, Mus musculus
tcctactgtgcaggactctagggct

SEQ ID NO: 970141 - DNA, 25 bp, Mus musculus
tcctacttggttcgctacatgggct

SEQ ID NO: 970142 - DNA, 25 bp, Mus musculus
tcctacttggttcggtacatgggct

SEQ ID NO: 970143 - DNA, 25 bp, Mus musculus
tcctactttggcttcgccactgtgt

SEQ ID NO: 970144 - DNA, 25 bp, Mus musculus
tcctactttggcttggccactgtgt

SEQ ID NO: 970145 - DNA, 25 bp, Mus musculus
tcctagacaaggcgccctctctgag

SEQ ID NO: 970146 - DNA, 25 bp, Mus musculus
tcctagacaaggggccctctctgag

SEQ ID NO: 970147 - DNA, 25 bp, Mus musculus
tcctagcccacacccctctagggcc

SEQ ID NO: 970148 - DNA, 25 bp, Mus musculus
tcctagcccacagccctctagggcc

SEQ ID NO: 970149 - DNA, 25 bp, Mus musculus
tcctagctggaaatctggcctatgg

SEQ ID NO: 970150 - DNA, 25 bp, Mus musculus
tcctagctggaaatgtggcctatgg

SEQ ID NO: 970151 - DNA, 25 bp, Mus musculus
tcctagggacaactcactgttctgg

SEQ ID NO: 970152 - DNA, 25 bp, Mus musculus
tcctagggacaagtcactgttctgg

SEQ ID NO: 970153 - DNA, 25 bp, Mus musculus
tcctagtgagcttgtccaggtgact

SEQ ID NO: 970154 - DNA, 25 bp, Mus musculus
tcctagtgaggttgtccaggtgact

SEQ ID NO: 970155 - DNA, 25 bp, Mus musculus
tcctagtgtcagataagttctggaa

SEQ ID NO: 970156 - DNA, 25 bp, Mus musculus
tcctagtgtcagttaagttctggaa

SEQ ID NO: 970157 - DNA, 25 bp, Mus musculus
tcctatccagcaggagagcattccc

SEQ ID NO: 970158 - DNA, 25 bp, Mus musculus
tcctatccaggaggagagcattccc

SEQ ID NO: 970159 - DNA, 25 bp, Mus musculus
tcctatcttcagccagccatggctg

SEQ ID NO: 970160 - DNA, 25 bp, Mus musculus
tcctatcttcagcctgccatggctg

SEQ ID NO: 970161 - DNA, 25 bp, Mus musculus
tcctatgcacactcatgaacaagct

SEQ ID NO: 970162 - DNA, 25 bp, Mus musculus
tcctatgcactctcatgaacaagct

SEQ ID NO: 970163 - DNA, 25 bp, Mus musculus
tcctatgcgaagcacatttatggtc

SEQ ID NO: 970164 - DNA, 25 bp, Mus musculus
tcctatgcgaagcacggtgtgcaga

SEQ ID NO: 970165 - DNA, 25 bp, Mus musculus
tcctatgcgaagcagatttatggtc

SEQ ID NO: 970166 - DNA, 25 bp, Mus musculus
tcctatgcgaagcagggtgtgcaga

SEQ ID NO: 970167 - DNA, 25 bp, Mus musculus
tcctatggtgtgcttctctgggaga

SEQ ID NO: 970168 - DNA, 25 bp, Mus musculus
tcctatggtgtggttctctgggaga

SEQ ID NO: 970169 - DNA, 25 bp, Mus musculus
tcctatgtgtcacgaaggccaagga

SEQ ID NO: 970170 - DNA, 25 bp, Mus musculus
tcctatgtgtcacgtaggaaggcca

SEQ ID NO: 970171 - DNA, 25 bp, Mus musculus
tcctatgtgtcaggaaggccaagga

SEQ ID NO: 970172 - DNA, 25 bp, Mus musculus
tcctatgtgtcaggtaggaaggcca

SEQ ID NO: 970173 - DNA, 25 bp, Mus musculus
tcctatttgtggcattgttcatcac

SEQ ID NO: 970174 - DNA, 25 bp, Mus musculus
tcctatttgtgggattgttcatcac

SEQ ID NO: 970175 - DNA, 25 bp, Mus musculus
tcctcaaaggagaactgcagtttgg

SEQ ID NO: 970176 - DNA, 25 bp, Mus musculus
tcctcaaaggagaagtgcagtttgg

SEQ ID NO: 970177 - DNA, 25 bp, Mus musculus
tcctcaacacagaccctgctctcga

SEQ ID NO: 970178 - DNA, 25 bp, Mus musculus
tcctcaacacagtccctgctctcga

SEQ ID NO: 970179 - DNA, 25 bp, Mus musculus
tcctcaacagagtctacattgggcc

SEQ ID NO: 970180 - DNA, 25 bp, Mus musculus
tcctcaacagtgtctacattgggcc

SEQ ID NO: 970181 - DNA, 25 bp, Mus musculus
tcctcaagcaccagccatggtggat

SEQ ID NO: 970182 - DNA, 25 bp, Mus musculus
tcctcaagcacctgccatggtggat

SEQ ID NO: 970183 - DNA, 25 bp, Mus musculus
tcctcaatagatgaactttctagat

SEQ ID NO: 970184 - DNA, 25 bp, Mus musculus
tcctcaatagttgaactttctagat

SEQ ID NO: 970185 - DNA, 25 bp, Mus musculus
tcctcaatgtcgcggacatcggggg

SEQ ID NO: 970186 - DNA, 25 bp, Mus musculus
tcctcaatgtcggggacatcggggg

SEQ ID NO: 970187 - DNA, 25 bp, Mus musculus
tcctcacagacctcagcgacagcct

SEQ ID NO: 970188 - DNA, 25 bp, Mus musculus
tcctcacagagctcagcgacagcct

SEQ ID NO: 970189 - DNA, 25 bp, Mus musculus
tcctcacagcaaccagcctcccatg

SEQ ID NO: 970190 - DNA, 25 bp, Mus musculus
tcctcacagcaaccctcccatgtgg

SEQ ID NO: 970191 - DNA, 25 bp, Mus musculus
tcctcacagcaagcagcctcccatg

SEQ ID NO: 970192 - DNA, 25 bp, Mus musculus
tcctcacagcaagcctcccatgtgg

SEQ ID NO: 970193 - DNA, 25 bp, Mus musculus
tcctcacaggtaaccatgaggtcat

SEQ ID NO: 970194 - DNA, 25 bp, Mus musculus
tcctcacaggtaacgatgaggtcat

SEQ ID NO: 970195 - DNA, 25 bp, Mus musculus
tcctcactctacaacgactccctgc

SEQ ID NO: 970196 - DNA, 25 bp, Mus musculus
tcctcactctacaaggactccctgc

SEQ ID NO: 970197 - DNA, 25 bp, Mus musculus
tcctcactgcagcgaagtttcttga

SEQ ID NO: 970198 - DNA, 25 bp, Mus musculus
tcctcactgcagggaagtttcttga

SEQ ID NO: 970199 - DNA, 25 bp, Mus musculus
tcctcactgcttcccgtactactaa

SEQ ID NO: 970200 - DNA, 25 bp, Mus musculus
tcctcactgcttgccgtactactaa

SEQ ID NO: 970201 - DNA, 25 bp, Mus musculus
tcctcactggttatcctttccatga

SEQ ID NO: 970202 - DNA, 25 bp, Mus musculus
tcctcactggttatcgatccatctg

SEQ ID NO: 970203 - DNA, 25 bp, Mus musculus
tcctcactggttatgctttccatga

SEQ ID NO: 970204 - DNA, 25 bp, Mus musculus
tcctcactggttatggatccatctg

SEQ ID NO: 970205 - DNA, 25 bp, Mus musculus
tcctcagacaggctgtgctgggcat

SEQ ID NO: 970206 - DNA, 25 bp, Mus musculus
tcctcagacagggtgtgctgggcat

SEQ ID NO: 970207 - DNA, 25 bp, Mus musculus
tcctcagactcgataaaacgtttac

SEQ ID NO: 970208 - DNA, 25 bp, Mus musculus
tcctcagactcgttaaaacgtttac

SEQ ID NO: 970209 - DNA, 25 bp, Mus musculus
tcctcagagtctcatgccaagccat

SEQ ID NO: 970210 - DNA, 25 bp, Mus musculus
tcctcagagtctccaagaaactaca

SEQ ID NO: 970211 - DNA, 25 bp, Mus musculus
tcctcagagtctgatgccaagccat

SEQ ID NO: 970212 - DNA, 25 bp, Mus musculus
tcctcagagtctgcaagaaactaca

SEQ ID NO: 970213 - DNA, 25 bp, Mus musculus
tcctcagcatgcagcggagccctgg

SEQ ID NO: 970214 - DNA, 25 bp, Mus musculus
tcctcagcatgcaggggagccctgg

SEQ ID NO: 970215 - DNA, 25 bp, Mus musculus
tcctcagccgcacgctggaggagaa

SEQ ID NO: 970216 - DNA, 25 bp, Mus musculus
tcctcagccgcaggctggaggagaa

SEQ ID NO: 970217 - DNA, 25 bp, Mus musculus
tcctcagggctgttcagcttccaga

SEQ ID NO: 970218 - DNA, 25 bp, Mus musculus
tcctcagggctgttgagcttccaga

SEQ ID NO: 970219 - DNA, 25 bp, Mus musculus
tcctcatcagcggggaaagcggagc

SEQ ID NO: 970220 - DNA, 25 bp, Mus musculus
tcctcatcaggggggaaagcggagc

SEQ ID NO: 970221 - DNA, 25 bp, Mus musculus
tcctcatcggactgtttaagactca

SEQ ID NO: 970222 - DNA, 25 bp, Mus musculus
tcctcatcggtctgtttaagactca

SEQ ID NO: 970223 - DNA, 25 bp, Mus musculus
tcctcatggaagccgcccctcggag

SEQ ID NO: 970224 - DNA, 25 bp, Mus musculus
tcctcatggaaggcgcccctcggag

SEQ ID NO: 970225 - DNA, 25 bp, Mus musculus
tcctcatttatgatcccataaaaac

SEQ ID NO: 970226 - DNA, 25 bp, Mus musculus
tcctcatttatgttcccataaaaac

SEQ ID NO: 970227 - DNA, 25 bp, Mus musculus
tcctccaaaacctcaggctggctac

SEQ ID NO: 970228 - DNA, 25 bp, Mus musculus
tcctccaaaagctcaggctggctac

SEQ ID NO: 970229 - DNA, 25 bp, Mus musculus
tcctccacaaagcctgtggtgaagc

SEQ ID NO: 970230 - DNA, 25 bp, Mus musculus
tcctccacaaaggctgtggtgaagc

SEQ ID NO: 970231 - DNA, 25 bp, Mus musculus
tcctccactccacatcatgtcatca

SEQ ID NO: 970232 - DNA, 25 bp, Mus musculus
tcctccactccagatcatgtcatca

SEQ ID NO: 970233 - DNA, 25 bp, Mus musculus
tcctccagccaccaccccctgcccg

SEQ ID NO: 970234 - DNA, 25 bp, Mus musculus
tcctccagccaccagcccctgcccg

SEQ ID NO: 970235 - DNA, 25 bp, Mus musculus
tcctccagggagcctatgacaccat

SEQ ID NO: 970236 - DNA, 25 bp, Mus musculus
tcctccagggaggctatgacaccat

SEQ ID NO: 970237 - DNA, 25 bp, Mus musculus
tcctccagtggatccgaaaaggcct

SEQ ID NO: 970238 - DNA, 25 bp, Mus musculus
tcctccagtggatcggaaaaggcct

SEQ ID NO: 970239 - DNA, 25 bp, Mus musculus
tcctccatcttgccatgtgctccac

SEQ ID NO: 970240 - DNA, 25 bp, Mus musculus
tcctccatcttggcatgtgctccac

SEQ ID NO: 970241 - DNA, 25 bp, Mus musculus
tcctcccaaagaaactggcattgcc

SEQ ID NO: 970242 - DNA, 25 bp, Mus musculus
tcctcccaaagatactggcattgcc

SEQ ID NO: 970243 - DNA, 25 bp, Mus musculus
tcctccccagaaatagatgaagacc

SEQ ID NO: 970244 - DNA, 25 bp, Mus musculus
tcctccccagtaatagatgaagacc

SEQ ID NO: 970245 - DNA, 25 bp, Mus musculus
tcctccgagaaccacagggcacatc

SEQ ID NO: 970246 - DNA, 25 bp, Mus musculus
tcctccgagaaccacttgataaaat

SEQ ID NO: 970247 - DNA, 25 bp, Mus musculus
tcctccgagaaccagagggcacatc

SEQ ID NO: 970248 - DNA, 25 bp, Mus musculus
tcctccgagaaccagttgataaaat

SEQ ID NO: 970249 - DNA, 25 bp, Mus musculus
tcctccgagagacgtgccgttctct

SEQ ID NO: 970250 - DNA, 25 bp, Mus musculus
tcctccgagagaggtgccgttctct

SEQ ID NO: 970251 - DNA, 25 bp, Mus musculus
tcctccgaggcggatgtgctaagag

SEQ ID NO: 970252 - DNA, 25 bp, Mus musculus
tcctccgagggggatgtgctaagag

SEQ ID NO: 970253 - DNA, 25 bp, Mus musculus
tcctccggctagttggaggtgagct

SEQ ID NO: 970254 - DNA, 25 bp, Mus musculus
tcctccggcttgttggaggtgagct

SEQ ID NO: 970255 - DNA, 25 bp, Mus musculus
tcctcctacaacacggtagaggact

SEQ ID NO: 970256 - DNA, 25 bp, Mus musculus
tcctcctacaatgagcagacacggt

SEQ ID NO: 970257 - DNA, 25 bp, Mus musculus
tcctcctacatcacggtagaggact

SEQ ID NO: 970258 - DNA, 25 bp, Mus musculus
tcctcctacattgagcagacacggt

SEQ ID NO: 970259 - DNA, 25 bp, Mus musculus
tcctcctagaagcgcctcctcacag

SEQ ID NO: 970260 - DNA, 25 bp, Mus musculus
tcctcctagaagggcctcctcacag

SEQ ID NO: 970261 - DNA, 25 bp, Mus musculus
tcctcctcagcactgtgcctcacca

SEQ ID NO: 970262 - DNA, 25 bp, Mus musculus
tcctcctcaggactgtgcctcacca

SEQ ID NO: 970263 - DNA, 25 bp, Mus musculus
tcctcctccaagcatcagggttgtg

SEQ ID NO: 970264 - DNA, 25 bp, Mus musculus
tcctcctccaaggatcagggttgtg

SEQ ID NO: 970265 - DNA, 25 bp, Mus musculus
tcctcctccgagcgggatgtgctaa

SEQ ID NO: 970266 - DNA, 25 bp, Mus musculus
tcctcctccgagggggatgtgctaa

SEQ ID NO: 970267 - DNA, 25 bp, Mus musculus
tcctcctcgaatcataatctggagg

SEQ ID NO: 970268 - DNA, 25 bp, Mus musculus
tcctcctcgaatgataatctggagg

SEQ ID NO: 970269 - DNA, 25 bp, Mus musculus
tcctcctgaccacctcaccagctca

SEQ ID NO: 970270 - DNA, 25 bp, Mus musculus
tcctcctgaccagctcaccagctca

SEQ ID NO: 970271 - DNA, 25 bp, Mus musculus
tcctcctggcagatcatttgtagca

SEQ ID NO: 970272 - DNA, 25 bp, Mus musculus
tcctcctggcagttcatttgtagca

SEQ ID NO: 970273 - DNA, 25 bp, Mus musculus
tcctcctgtccaccaaatctcccag

SEQ ID NO: 970274 - DNA, 25 bp, Mus musculus
tcctcctgtccagcaaatctcccag

SEQ ID NO: 970275 - DNA, 25 bp, Mus musculus
tcctccttcagtgacattaaagatt

SEQ ID NO: 970276 - DNA, 25 bp, Mus musculus
tcctccttcagtgagattaaagatt

SEQ ID NO: 970277 - DNA, 25 bp, Mus musculus
tcctccttggctcgcagcacagact

SEQ ID NO: 970278 - DNA, 25 bp, Mus musculus
tcctccttggctcggaaaatgaccc

SEQ ID NO: 970279 - DNA, 25 bp, Mus musculus
tcctccttggctcggggaagaacag

SEQ ID NO: 970280 - DNA, 25 bp, Mus musculus
tcctccttggctggcagcacagact

SEQ ID NO: 970281 - DNA, 25 bp, Mus musculus
tcctccttggctgggaaaatgaccc

SEQ ID NO: 970282 - DNA, 25 bp, Mus musculus
tcctccttggctgggggaagaacag

SEQ ID NO: 970283 - DNA, 25 bp, Mus musculus
tcctcgaatgataatctggaggctg

SEQ ID NO: 970284 - DNA, 25 bp, Mus musculus
tcctcgaatgttaatctggaggctg

SEQ ID NO: 970285 - DNA, 25 bp, Mus musculus
tcctcgatacagcacagaactcggc

SEQ ID NO: 970286 - DNA, 25 bp, Mus musculus
tcctcgatacaggacagaactcggc

SEQ ID NO: 970287 - DNA, 25 bp, Mus musculus
tcctcgccacagccttgatgcaggt

SEQ ID NO: 970288 - DNA, 25 bp, Mus musculus
tcctcgccacaggcttgatgcaggt

SEQ ID NO: 970289 - DNA, 25 bp, Mus musculus
tcctcgcctgtgaactcatcagcac

SEQ ID NO: 970290 - DNA, 25 bp, Mus musculus
tcctcgcctgtgtactcatcagcac

SEQ ID NO: 970291 - DNA, 25 bp, Mus musculus
tcctcggaagcagacatggctatga

SEQ ID NO: 970292 - DNA, 25 bp, Mus musculus
tcctcggaagcagagatggctatga

SEQ ID NO: 970293 - DNA, 25 bp, Mus musculus
tcctcggcccggcgcagcagggcgg

SEQ ID NO: 970294 - DNA, 25 bp, Mus musculus
tcctcggcccggggcagcagggcgg

SEQ ID NO: 970295 - DNA, 25 bp, Mus musculus
tcctcggcctcacgtttgaagctgg

SEQ ID NO: 970296 - DNA, 25 bp, Mus musculus
tcctcggcctcaggtttgaagctgg

SEQ ID NO: 970297 - DNA, 25 bp, Mus musculus
tcctcggctgcccgcgcctgactac

SEQ ID NO: 970298 - DNA, 25 bp, Mus musculus
tcctcggctgcccgggcctgactac

SEQ ID NO: 970299 - DNA, 25 bp, Mus musculus
tcctcggggcagaaaatatctgcag

SEQ ID NO: 970300 - DNA, 25 bp, Mus musculus
tcctcggggcagatcgtaatgtaaa

SEQ ID NO: 970301 - DNA, 25 bp, Mus musculus
tcctcggggcagtaaatatctgcag

SEQ ID NO: 970302 - DNA, 25 bp, Mus musculus
tcctcggggcagttcgtaatgtaaa

SEQ ID NO: 970303 - DNA, 25 bp, Mus musculus
tcctcgtaagagccattctgtcttc

SEQ ID NO: 970304 - DNA, 25 bp, Mus musculus
tcctcgtaagtgccattctgtcttc

SEQ ID NO: 970305 - DNA, 25 bp, Mus musculus
tcctcgtgtgcgcattcctttgttt

SEQ ID NO: 970306 - DNA, 25 bp, Mus musculus
tcctcgtgtgcgctgcacgatctga

SEQ ID NO: 970307 - DNA, 25 bp, Mus musculus
tcctcgtgtgcggattcctttgttt

SEQ ID NO: 970308 - DNA, 25 bp, Mus musculus
tcctcgtgtgcggtgcacgatctga

SEQ ID NO: 970309 - DNA, 25 bp, Mus musculus
tcctcgttatcgcaatgaccaatag

SEQ ID NO: 970310 - DNA, 25 bp, Mus musculus
tcctcgttatcggaatgaccaatag

SEQ ID NO: 970311 - DNA, 25 bp, Mus musculus
tcctctaaaaggcaacaactctaca

SEQ ID NO: 970312 - DNA, 25 bp, Mus musculus
tcctctaaaaggcccgcgcctgcgc

SEQ ID NO: 970313 - DNA, 25 bp, Mus musculus
tcctctaaaagggaacaactctaca

SEQ ID NO: 970314 - DNA, 25 bp, Mus musculus
tcctctaaaagggccgcgcctgcgc

SEQ ID NO: 970315 - DNA, 25 bp, Mus musculus
tcctctaaacaacacgggccgcatt

SEQ ID NO: 970316 - DNA, 25 bp, Mus musculus
tcctctaaacaagacgggccgcatt

SEQ ID NO: 970317 - DNA, 25 bp, Mus musculus
tcctctactgtccccgtgtgccagc

SEQ ID NO: 970318 - DNA, 25 bp, Mus musculus
tcctctactgtcccggtgtgccagc

SEQ ID NO: 970319 - DNA, 25 bp, Mus musculus
tcctctatgaagactggaccacgcc

SEQ ID NO: 970320 - DNA, 25 bp, Mus musculus
tcctctatgaagtctggaccacgcc

SEQ ID NO: 970321 - DNA, 25 bp, Mus musculus
tcctctcaaatccacggacaaattt

SEQ ID NO: 970322 - DNA, 25 bp, Mus musculus
tcctctcaaatccagggacaaattt

SEQ ID NO: 970323 - DNA, 25 bp, Mus musculus
tcctctcaagcctcaaactcagaaa

SEQ ID NO: 970324 - DNA, 25 bp, Mus musculus
tcctctcaaggctcaaactcagaaa

SEQ ID NO: 970325 - DNA, 25 bp, Mus musculus
tcctctcagtgtcactttctcagca

SEQ ID NO: 970326 - DNA, 25 bp, Mus musculus
tcctctcagtgtcagtttctcagca

SEQ ID NO: 970327 - DNA, 25 bp, Mus musculus
tcctctccaaccaacgcatcctcgg

SEQ ID NO: 970328 - DNA, 25 bp, Mus musculus
tcctctccaaccaacgtatcatgtt

SEQ ID NO: 970329 - DNA, 25 bp, Mus musculus
tcctctccaaccaaggcatcctcgg

SEQ ID NO: 970330 - DNA, 25 bp, Mus musculus
tcctctccaaccaaggtatcatgtt

SEQ ID NO: 970331 - DNA, 25 bp, Mus musculus
tcctctctccagacagacaatacat

SEQ ID NO: 970332 - DNA, 25 bp, Mus musculus
tcctctctccagtcagacaatacat

SEQ ID NO: 970333 - DNA, 25 bp, Mus musculus
tcctctctgctgcgggcagctcaca

SEQ ID NO: 970334 - DNA, 25 bp, Mus musculus
tcctctctgctgggggcagctcaca

SEQ ID NO: 970335 - DNA, 25 bp, Mus musculus
tcctctctgcttgacgaagaagctc

SEQ ID NO: 970336 - DNA, 25 bp, Mus musculus
tcctctctgcttgaggaagaagctc

SEQ ID NO: 970337 - DNA, 25 bp, Mus musculus
tcctctgacccactcttggaactga

SEQ ID NO: 970338 - DNA, 25 bp, Mus musculus
tcctctgacccagtcttggaactga

SEQ ID NO: 970339 - DNA, 25 bp, Mus musculus
tcctctgatacacggcggagttcag

SEQ ID NO: 970340 - DNA, 25 bp, Mus musculus
tcctctgatacagggcggagttcag

SEQ ID NO: 970341 - DNA, 25 bp, Mus musculus
tcctctgcagatgttgacctcctgt

SEQ ID NO: 970342 - DNA, 25 bp, Mus musculus
tcctctgcagttgttgacctcctgt

SEQ ID NO: 970343 - DNA, 25 bp, Mus musculus
tcctctgctcagcacccactctcta

SEQ ID NO: 970344 - DNA, 25 bp, Mus musculus
tcctctgctcagcacggataactct

SEQ ID NO: 970345 - DNA, 25 bp, Mus musculus
tcctctgctcagcagccactctcta

SEQ ID NO: 970346 - DNA, 25 bp, Mus musculus
tcctctgctcagcagggataactct

SEQ ID NO: 970347 - DNA, 25 bp, Mus musculus
tcctctggaatgccctatttacact

SEQ ID NO: 970348 - DNA, 25 bp, Mus musculus
tcctctggaatggcctatttacact

SEQ ID NO: 970349 - DNA, 25 bp, Mus musculus
tcctctgtggagcctttggccactg

SEQ ID NO: 970350 - DNA, 25 bp, Mus musculus
tcctctgtggaggctttggccactg

SEQ ID NO: 970351 - DNA, 25 bp, Mus musculus
tcctcttccaagagtcccccagaag

SEQ ID NO: 970352 - DNA, 25 bp, Mus musculus
tcctcttccaagtgtcccccagaag

SEQ ID NO: 970353 - DNA, 25 bp, Mus musculus
tcctcttcgccgccattgctcctgt

SEQ ID NO: 970354 - DNA, 25 bp, Mus musculus
tcctcttcgccggcattgctcctgt

SEQ ID NO: 970355 - DNA, 25 bp, Mus musculus
tcctcttggaacaaattctgcatag

SEQ ID NO: 970356 - DNA, 25 bp, Mus musculus
tcctcttggaactaattctgcatag

SEQ ID NO: 970357 - DNA, 25 bp, Mus musculus
tcctctttcatacgcggaaccctct

SEQ ID NO: 970358 - DNA, 25 bp, Mus musculus
tcctctttcatacggattttgataa

SEQ ID NO: 970359 - DNA, 25 bp, Mus musculus
tcctctttcataggcggaaccctct

SEQ ID NO: 970360 - DNA, 25 bp, Mus musculus
tcctctttcatagggattttgataa

SEQ ID NO: 970361 - DNA, 25 bp, Mus musculus
tcctgaaaatagaattgccaagaag

SEQ ID NO: 970362 - DNA, 25 bp, Mus musculus
tcctgaaaatagtattgccaagaag

SEQ ID NO: 970363 - DNA, 25 bp, Mus musculus
tcctgaaagcccaactggccgcacg

SEQ ID NO: 970364 - DNA, 25 bp, Mus musculus
tcctgaaagcccaagtggccgcacg

SEQ ID NO: 970365 - DNA, 25 bp, Mus musculus
tcctgaaatgcctaacatacatggt

SEQ ID NO: 970366 - DNA, 25 bp, Mus musculus
tcctgaaatggctaacatacatggt

SEQ ID NO: 970367 - DNA, 25 bp, Mus musculus
tcctgaacatcaaccgttctcccat

SEQ ID NO: 970368 - DNA, 25 bp, Mus musculus
tcctgaacatcaacggttctcccat

SEQ ID NO: 970369 - DNA, 25 bp, Mus musculus
tcctgaaccaagagaccgggttgga

SEQ ID NO: 970370 - DNA, 25 bp, Mus musculus
tcctgaaccaagtgaccgggttgga

SEQ ID NO: 970371 - DNA, 25 bp, Mus musculus
tcctgaagagcttggtggagggcca

SEQ ID NO: 970372 - DNA, 25 bp, Mus musculus
tcctgaagaggttggtggagggcca

SEQ ID NO: 970373 - DNA, 25 bp, Mus musculus
tcctgaagtcagaactggaaaacat

SEQ ID NO: 970374 - DNA, 25 bp, Mus musculus
tcctgaagtcagtactggaaaacat

SEQ ID NO: 970375 - DNA, 25 bp, Mus musculus
tcctgaagtgattttcctcgcatct

SEQ ID NO: 970376 - DNA, 25 bp, Mus musculus
tcctgaagtgtttttcctcgcatct

SEQ ID NO: 970377 - DNA, 25 bp, Mus musculus
tcctgaatacaacggcgagtggaaa

SEQ ID NO: 970378 - DNA, 25 bp, Mus musculus
tcctgaatacaagggcgagtggaaa

SEQ ID NO: 970379 - DNA, 25 bp, Mus musculus
tcctgaatgcagatggaatgccaag

SEQ ID NO: 970380 - DNA, 25 bp, Mus musculus
tcctgaatgcagttggaatgccaag

SEQ ID NO: 970381 - DNA, 25 bp, Mus musculus
tcctgacaacaagaacctctgtgtc

SEQ ID NO: 970382 - DNA, 25 bp, Mus musculus
tcctgacaacaagatcctctgtgtc

SEQ ID NO: 970383 - DNA, 25 bp, Mus musculus
tcctgacaccagcctcaggacatgg

SEQ ID NO: 970384 - DNA, 25 bp, Mus musculus
tcctgacaccaggctcaggacatgg

SEQ ID NO: 970385 - DNA, 25 bp, Mus musculus
tcctgacagctgcgatctccatctt

SEQ ID NO: 970386 - DNA, 25 bp, Mus musculus
tcctgacagctgggatctccatctt

SEQ ID NO: 970387 - DNA, 25 bp, Mus musculus
tcctgacatgaaccccccctaggcc

SEQ ID NO: 970388 - DNA, 25 bp, Mus musculus
tcctgacatgaagcccccctaggcc

SEQ ID NO: 970389 - DNA, 25 bp, Mus musculus
tcctgaccagagagcttctgtgtgg

SEQ ID NO: 970390 - DNA, 25 bp, Mus musculus
tcctgaccagagtgcttctgtgtgg

SEQ ID NO: 970391 - DNA, 25 bp, Mus musculus
tcctgaccagctcaccagctcaggg

SEQ ID NO: 970392 - DNA, 25 bp, Mus musculus
tcctgaccaggtcaccagctcaggg

SEQ ID NO: 970393 - DNA, 25 bp, Mus musculus
tcctgacgagcgcatccgtttccga

SEQ ID NO: 970394 - DNA, 25 bp, Mus musculus
tcctgacgagggcatccgtttccga

SEQ ID NO: 970395 - DNA, 25 bp, Mus musculus
tcctgactaccccccagatcctgca

SEQ ID NO: 970396 - DNA, 25 bp, Mus musculus
tcctgactacgccccagatcctgca

SEQ ID NO: 970397 - DNA, 25 bp, Mus musculus
tcctgactactgcacccagcggccc

SEQ ID NO: 970398 - DNA, 25 bp, Mus musculus
tcctgactactgcagccagcggccc

SEQ ID NO: 970399 - DNA, 25 bp, Mus musculus
tcctgagagaagcatgtcacagctg

SEQ ID NO: 970400 - DNA, 25 bp, Mus musculus
tcctgagagaaggatgtcacagctg

SEQ ID NO: 970401 - DNA, 25 bp, Mus musculus
tcctgagataagcaggatgctgcgg

SEQ ID NO: 970402 - DNA, 25 bp, Mus musculus
tcctgagataagcatgctgcggcta

SEQ ID NO: 970403 - DNA, 25 bp, Mus musculus
tcctgagataaggaggatgctgcgg

SEQ ID NO: 970404 - DNA, 25 bp, Mus musculus
tcctgagataaggatgctgcggcta

SEQ ID NO: 970405 - DNA, 25 bp, Mus musculus
tcctgagcagattgggaagctgcgc

SEQ ID NO: 970406 - DNA, 25 bp, Mus musculus
tcctgagcagctgaaactggttctt

SEQ ID NO: 970407 - DNA, 25 bp, Mus musculus
tcctgagcaggtgaaactggttctt

SEQ ID NO: 970408 - DNA, 25 bp, Mus musculus
tcctgagcagtttgggaagctgcgc

SEQ ID NO: 970409 - DNA, 25 bp, Mus musculus
tcctgaggcgagcacctggtggccc

SEQ ID NO: 970410 - DNA, 25 bp, Mus musculus
tcctgaggcgagcacctgtggcccc

SEQ ID NO: 970411 - DNA, 25 bp, Mus musculus
tcctgaggcgagcagctggtggccc

SEQ ID NO: 970412 - DNA, 25 bp, Mus musculus
tcctgaggcgagcagctgtggcccc

SEQ ID NO: 970413 - DNA, 25 bp, Mus musculus
tcctgagggcaaatccgtcatcgta

SEQ ID NO: 970414 - DNA, 25 bp, Mus musculus
tcctgagggcaattccgtcatcgta

SEQ ID NO: 970415 - DNA, 25 bp, Mus musculus
tcctgaggtggatgagtgggtgcag

SEQ ID NO: 970416 - DNA, 25 bp, Mus musculus
tcctgaggtggatgtgtgggtgcag

SEQ ID NO: 970417 - DNA, 25 bp, Mus musculus
tcctgataacagctacctgtatgtg

SEQ ID NO: 970418 - DNA, 25 bp, Mus musculus
tcctgataacaggtacctgtatgtg

SEQ ID NO: 970419 - DNA, 25 bp, Mus musculus
tcctgatcacagcacagctccctct

SEQ ID NO: 970420 - DNA, 25 bp, Mus musculus
tcctgatcacaggacagctccctct

SEQ ID NO: 970421 - DNA, 25 bp, Mus musculus
tcctgatcattgcgtattctaccat

SEQ ID NO: 970422 - DNA, 25 bp, Mus musculus
tcctgatcattgggtattctaccat

SEQ ID NO: 970423 - DNA, 25 bp, Mus musculus
tcctgatgaaagtcattggtctcag

SEQ ID NO: 970424 - DNA, 25 bp, Mus musculus
tcctgatgaacttatagtgcctcgc

SEQ ID NO: 970425 - DNA, 25 bp, Mus musculus
tcctgatgaagaacctgaaagtcat

SEQ ID NO: 970426 - DNA, 25 bp, Mus musculus
tcctgatgaagaacgtgaaagtcat

SEQ ID NO: 970427 - DNA, 25 bp, Mus musculus
tcctgatgaagttatagtgcctcgc

SEQ ID NO: 970428 - DNA, 25 bp, Mus musculus
tcctgatgaatgtcattggtctcag

SEQ ID NO: 970429 - DNA, 25 bp, Mus musculus
tcctgatgagatggctgctcagctc

SEQ ID NO: 970430 - DNA, 25 bp, Mus musculus
tcctgatgagttggctgctcagctc

SEQ ID NO: 970431 - DNA, 25 bp, Mus musculus
tcctgatggcaagacctacagcagc

SEQ ID NO: 970432 - DNA, 25 bp, Mus musculus
tcctgatggcaagagctacagcagc

SEQ ID NO: 970433 - DNA, 25 bp, Mus musculus
tcctgattaacacgggagcacatat

SEQ ID NO: 970434 - DNA, 25 bp, Mus musculus
tcctgattaacaggggagcacatat

SEQ ID NO: 970435 - DNA, 25 bp, Mus musculus
tcctgcaagccacgttttcacacat

SEQ ID NO: 970436 - DNA, 25 bp, Mus musculus
tcctgcaagccaggttttcacacat

SEQ ID NO: 970437 - DNA, 25 bp, Mus musculus
tcctgcaaggacctggatgagtgtg

SEQ ID NO: 970438 - DNA, 25 bp, Mus musculus
tcctgcaaggtcctggatgagtgtg

SEQ ID NO: 970439 - DNA, 25 bp, Mus musculus
tcctgcaagtgggtcgaatccatgt

SEQ ID NO: 970440 - DNA, 25 bp, Mus musculus
tcctgcaagtgggtggaatccatgt

SEQ ID NO: 970441 - DNA, 25 bp, Mus musculus
tcctgcacgtgacactgggctccct

SEQ ID NO: 970442 - DNA, 25 bp, Mus musculus
tcctgcacgtgacagtgggctccct

SEQ ID NO: 970443 - DNA, 25 bp, Mus musculus
tcctgcactttgaggaggaagagat

SEQ ID NO: 970444 - DNA, 25 bp, Mus musculus
tcctgcactttgtggaggaagagat

SEQ ID NO: 970445 - DNA, 25 bp, Mus musculus
tcctgcagagccaccgtcaagatgc

SEQ ID NO: 970446 - DNA, 25 bp, Mus musculus
tcctgcagagccacggtcaagatgc

SEQ ID NO: 970447 - DNA, 25 bp, Mus musculus
tcctgcagcaaacccaccatgccaa

SEQ ID NO: 970448 - DNA, 25 bp, Mus musculus
tcctgcagcaaagccaccatgccaa

SEQ ID NO: 970449 - DNA, 25 bp, Mus musculus
tcctgcagccagaacaatatccagt

SEQ ID NO: 970450 - DNA, 25 bp, Mus musculus
tcctgcagccagaaccagcgtttga

SEQ ID NO: 970451 - DNA, 25 bp, Mus musculus
tcctgcagccagaaccgtttgacgt

SEQ ID NO: 970452 - DNA, 25 bp, Mus musculus
tcctgcagccagaagaatatccagt

SEQ ID NO: 970453 - DNA, 25 bp, Mus musculus
tcctgcagccagaagcagcgtttga

SEQ ID NO: 970454 - DNA, 25 bp, Mus musculus
tcctgcagccagaagcgtttgacgt

SEQ ID NO: 970455 - DNA, 25 bp, Mus musculus
tcctgcagtgcgtcctggtggtgct

SEQ ID NO: 970456 - DNA, 25 bp, Mus musculus
tcctgcagtgggtcctggtggtgct

SEQ ID NO: 970457 - DNA, 25 bp, Mus musculus
tcctgcataacaaacgcatcgccca

SEQ ID NO: 970458 - DNA, 25 bp, Mus musculus
tcctgcataacaaaggcatcgccca

SEQ ID NO: 970459 - DNA, 25 bp, Mus musculus
tcctgcatttctcttccttagtgat

SEQ ID NO: 970460 - DNA, 25 bp, Mus musculus
tcctgcatttgtcttccttagtgat

SEQ ID NO: 970461 - DNA, 25 bp, Mus musculus
tcctgccaatgtcagcaaaggcaca

SEQ ID NO: 970462 - DNA, 25 bp, Mus musculus
tcctgccaatgtgagcaaaggcaca

SEQ ID NO: 970463 - DNA, 25 bp, Mus musculus
tcctgccacaatcaaaaccaagact

SEQ ID NO: 970464 - DNA, 25 bp, Mus musculus
tcctgccacagacacggccactgcc

SEQ ID NO: 970465 - DNA, 25 bp, Mus musculus
tcctgccacagacagggccactgcc

SEQ ID NO: 970466 - DNA, 25 bp, Mus musculus
tcctgccacattcaaaaccaagact

SEQ ID NO: 970467 - DNA, 25 bp, Mus musculus
tcctgccataggccaacaaatccga

SEQ ID NO: 970468 - DNA, 25 bp, Mus musculus
tcctgccatagggcaacaaatccga

SEQ ID NO: 970469 - DNA, 25 bp, Mus musculus
tcctgcccagcatggcagtacctgg

SEQ ID NO: 970470 - DNA, 25 bp, Mus musculus
tcctgcccagctcaatggtggctct

SEQ ID NO: 970471 - DNA, 25 bp, Mus musculus
tcctgcccagctttgcacaccctta

SEQ ID NO: 970472 - DNA, 25 bp, Mus musculus
tcctgcccaggatggcagtacctgg

SEQ ID NO: 970473 - DNA, 25 bp, Mus musculus
tcctgcccaggtcaatggtggctct

SEQ ID NO: 970474 - DNA, 25 bp, Mus musculus
tcctgcccaggtttgcacaccctta

SEQ ID NO: 970475 - DNA, 25 bp, Mus musculus
tcctgccgctgctgcgtggctgcgt

SEQ ID NO: 970476 - DNA, 25 bp, Mus musculus
tcctgccgctgctgggtggctgcgt

SEQ ID NO: 970477 - DNA, 25 bp, Mus musculus
tcctgcctctggccggaaaaactga

SEQ ID NO: 970478 - DNA, 25 bp, Mus musculus
tcctgcctctggcttaacaatcaag

SEQ ID NO: 970479 - DNA, 25 bp, Mus musculus
tcctgcctctgggcggaaaaactga

SEQ ID NO: 970480 - DNA, 25 bp, Mus musculus
tcctgcctctgggttaacaatcaag

SEQ ID NO: 970481 - DNA, 25 bp, Mus musculus
tcctgcctgccacaacatgctgttt

SEQ ID NO: 970482 - DNA, 25 bp, Mus musculus
tcctgcctgccagaacatgctgttt

SEQ ID NO: 970483 - DNA, 25 bp, Mus musculus
tcctgcctggagcggacatgatgac

SEQ ID NO: 970484 - DNA, 25 bp, Mus musculus
tcctgcctggaggggacatgatgac

SEQ ID NO: 970485 - DNA, 25 bp, Mus musculus
tcctgccttgatcacagggtccctt

SEQ ID NO: 970486 - DNA, 25 bp, Mus musculus
tcctgccttgatgacagggtccctt

SEQ ID NO: 970487 - DNA, 25 bp, Mus musculus
tcctgcgagataagtttggggaggc

SEQ ID NO: 970488 - DNA, 25 bp, Mus musculus
tcctgcgagatatgtttggggaggc

SEQ ID NO: 970489 - DNA, 25 bp, Mus musculus
tcctgcgcaaagcgatcagtggcga

SEQ ID NO: 970490 - DNA, 25 bp, Mus musculus
tcctgcgcaaagggatcagtggcga

SEQ ID NO: 970491 - DNA, 25 bp, Mus musculus
tcctgctacgggcacgctggaacga

SEQ ID NO: 970492 - DNA, 25 bp, Mus musculus
tcctgctacgggcaggctggaacga

SEQ ID NO: 970493 - DNA, 25 bp, Mus musculus
tcctgctagccactgctttcgcagt

SEQ ID NO: 970494 - DNA, 25 bp, Mus musculus
tcctgctagccagtgctttcgcagt

SEQ ID NO: 970495 - DNA, 25 bp, Mus musculus
tcctgctcaactgccctatcgtgtt

SEQ ID NO: 970496 - DNA, 25 bp, Mus musculus
tcctgctcaagtgccctatcgtgtt

SEQ ID NO: 970497 - DNA, 25 bp, Mus musculus
tcctgctcagattttgatccgattt

SEQ ID NO: 970498 - DNA, 25 bp, Mus musculus
tcctgctcagtttttgatccgattt

SEQ ID NO: 970499 - DNA, 25 bp, Mus musculus
tcctgctccactgactttccagcag

SEQ ID NO: 970500 - DNA, 25 bp, Mus musculus
tcctgctccagtgactttccagcag

SEQ ID NO: 970501 - DNA, 25 bp, Mus musculus
tcctgctccatgaacgtccacctgc

SEQ ID NO: 970502 - DNA, 25 bp, Mus musculus
tcctgctccatgaaggtccacctgc

SEQ ID NO: 970503 - DNA, 25 bp, Mus musculus
tcctgctgagccgagtaacaagaaa

SEQ ID NO: 970504 - DNA, 25 bp, Mus musculus
tcctgctgaggcgagtaacaagaaa

SEQ ID NO: 970505 - DNA, 25 bp, Mus musculus
tcctgctgctgccgttcagctcaac

SEQ ID NO: 970506 - DNA, 25 bp, Mus musculus
tcctgctgctgcggttcagctcaac

SEQ ID NO: 970507 - DNA, 25 bp, Mus musculus
tcctgctggccgccattgaatgtcc

SEQ ID NO: 970508 - DNA, 25 bp, Mus musculus
tcctgctggccggcattgaatgtcc

SEQ ID NO: 970509 - DNA, 25 bp, Mus musculus
tcctgctgtgaagtgggctagtgtg

SEQ ID NO: 970510 - DNA, 25 bp, Mus musculus
tcctgctgtgtagtgggctagtgtg

SEQ ID NO: 970511 - DNA, 25 bp, Mus musculus
tcctggaaaagcatatcttttccag

SEQ ID NO: 970512 - DNA, 25 bp, Mus musculus
tcctggaaaagcatttcttttccag

SEQ ID NO: 970513 - DNA, 25 bp, Mus musculus
tcctggaaatttcacgatcattggg

SEQ ID NO: 970514 - DNA, 25 bp, Mus musculus
tcctggaaatttcaggatcattggg

SEQ ID NO: 970515 - DNA, 25 bp, Mus musculus
tcctggacaccacacagctccttgg

SEQ ID NO: 970516 - DNA, 25 bp, Mus musculus
tcctggacaccacacgaaagaatgt

SEQ ID NO: 970517 - DNA, 25 bp, Mus musculus
tcctggacaccacagagctccttgg

SEQ ID NO: 970518 - DNA, 25 bp, Mus musculus
tcctggacaccacaggaaagaatgt

SEQ ID NO: 970519 - DNA, 25 bp, Mus musculus
tcctggacagcctgcgaaggcccca

SEQ ID NO: 970520 - DNA, 25 bp, Mus musculus
tcctggacagctggtggtcgggccc

SEQ ID NO: 970521 - DNA, 25 bp, Mus musculus
tcctggacaggctgcgaaggcccca

SEQ ID NO: 970522 - DNA, 25 bp, Mus musculus
tcctggacaggtggtggtcgggccc

SEQ ID NO: 970523 - DNA, 25 bp, Mus musculus
tcctggacctcggacaacttccagg

SEQ ID NO: 970524 - DNA, 25 bp, Mus musculus
tcctggacctcggacccacagagat

SEQ ID NO: 970525 - DNA, 25 bp, Mus musculus
tcctggacctcggacctgcccagac

SEQ ID NO: 970526 - DNA, 25 bp, Mus musculus
tcctggacctcggacggatgactcg

SEQ ID NO: 970527 - DNA, 25 bp, Mus musculus
tcctggacctcggagaacttccagg

SEQ ID NO: 970528 - DNA, 25 bp, Mus musculus
tcctggacctcggagccacagagat

SEQ ID NO: 970529 - DNA, 25 bp, Mus musculus
tcctggacctcggagctgcccagac

SEQ ID NO: 970530 - DNA, 25 bp, Mus musculus
tcctggacctcggagggatgactcg

SEQ ID NO: 970531 - DNA, 25 bp, Mus musculus
tcctggactcagcgtagatggaatg

SEQ ID NO: 970532 - DNA, 25 bp, Mus musculus
tcctggactcagggtagatggaatg

SEQ ID NO: 970533 - DNA, 25 bp, Mus musculus
tcctggagagatcacttgagaccca

SEQ ID NO: 970534 - DNA, 25 bp, Mus musculus
tcctggagagatcagttgagaccca

SEQ ID NO: 970535 - DNA, 25 bp, Mus musculus
tcctggagaggacggtctagagaca

SEQ ID NO: 970536 - DNA, 25 bp, Mus musculus
tcctggagaggagggtctagagaca

SEQ ID NO: 970537 - DNA, 25 bp, Mus musculus
tcctggaggtcacggtggcagtggt

SEQ ID NO: 970538 - DNA, 25 bp, Mus musculus
tcctggaggtcagggtggcagtggt

SEQ ID NO: 970539 - DNA, 25 bp, Mus musculus
tcctggagttcccggaaaggcaggc

SEQ ID NO: 970540 - DNA, 25 bp, Mus musculus
tcctggagttccgggaaaggcaggc

SEQ ID NO: 970541 - DNA, 25 bp, Mus musculus
tcctggatagctgagaaagaagcaa

SEQ ID NO: 970542 - DNA, 25 bp, Mus musculus
tcctggataggtgagaaagaagcaa

SEQ ID NO: 970543 - DNA, 25 bp, Mus musculus
tcctggatcaagctgcgcaggcgcg

SEQ ID NO: 970544 - DNA, 25 bp, Mus musculus
tcctggatcaaggtgcgcaggcgcg

SEQ ID NO: 970545 - DNA, 25 bp, Mus musculus
tcctggatcacactcgatgcagcct

SEQ ID NO: 970546 - DNA, 25 bp, Mus musculus
tcctggatcacactggatgcagcct

SEQ ID NO: 970547 - DNA, 25 bp, Mus musculus
tcctggatgaaacataagcagtccc

SEQ ID NO: 970548 - DNA, 25 bp, Mus musculus
tcctggatgaaacgtcgagatttca

SEQ ID NO: 970549 - DNA, 25 bp, Mus musculus
tcctggatgaaagataagcagtccc

SEQ ID NO: 970550 - DNA, 25 bp, Mus musculus
tcctggatgaaaggtcgagatttca

SEQ ID NO: 970551 - DNA, 25 bp, Mus musculus
tcctggatgcagccctgccaggcag

SEQ ID NO: 970552 - DNA, 25 bp, Mus musculus
tcctggatgcaggcctgccaggcag

SEQ ID NO: 970553 - DNA, 25 bp, Mus musculus
tcctggatgtgctgcagcggtcccc

SEQ ID NO: 970554 - DNA, 25 bp, Mus musculus
tcctggatgtgctggagcggtcccc

SEQ ID NO: 970555 - DNA, 25 bp, Mus musculus
tcctggattctgccattaatgtgga

SEQ ID NO: 970556 - DNA, 25 bp, Mus musculus
tcctggattctggcattaatgtgga

SEQ ID NO: 970557 - DNA, 25 bp, Mus musculus
tcctggcaagatttgcctcctggtc

SEQ ID NO: 970558 - DNA, 25 bp, Mus musculus
tcctggcaagttttgcctcctggtc

SEQ ID NO: 970559 - DNA, 25 bp, Mus musculus
tcctggcagtggcaagtcagagtcc

SEQ ID NO: 970560 - DNA, 25 bp, Mus musculus
tcctggcagtggcaggccagagtcc

SEQ ID NO: 970561 - DNA, 25 bp, Mus musculus
tcctggcagtgggaagtcagagtcc

SEQ ID NO: 970562 - DNA, 25 bp, Mus musculus
tcctggcagtgggaggccagagtcc

SEQ ID NO: 970563 - DNA, 25 bp, Mus musculus
tcctggcatctgcccgagctgaaga

SEQ ID NO: 970564 - DNA, 25 bp, Mus musculus
tcctggcatctgccggagctgaaga

SEQ ID NO: 970565 - DNA, 25 bp, Mus musculus
tcctggcatgctacttttctcactt

SEQ ID NO: 970566 - DNA, 25 bp, Mus musculus
tcctggcatggtacttttctcactt

SEQ ID NO: 970567 - DNA, 25 bp, Mus musculus
tcctggcattaacggctccacgggg

SEQ ID NO: 970568 - DNA, 25 bp, Mus musculus
tcctggcattaagggctccacgggg

SEQ ID NO: 970569 - DNA, 25 bp, Mus musculus
tcctggccccaacgtggccattgaa

SEQ ID NO: 970570 - DNA, 25 bp, Mus musculus
tcctggccccaaggtggccattgaa

SEQ ID NO: 970571 - DNA, 25 bp, Mus musculus
tcctggcctcagcagacaacaatcg

SEQ ID NO: 970572 - DNA, 25 bp, Mus musculus
tcctggcctcagctgacaaccaggg

SEQ ID NO: 970573 - DNA, 25 bp, Mus musculus
tcctggcctcaggagacaacaatcg

SEQ ID NO: 970574 - DNA, 25 bp, Mus musculus
tcctggcctcaggtgacaaccaggg

SEQ ID NO: 970575 - DNA, 25 bp, Mus musculus
tcctggcctgctgtgcatcggccac

SEQ ID NO: 970576 - DNA, 25 bp, Mus musculus
tcctggcctggtgtgcatcggccac

SEQ ID NO: 970577 - DNA, 25 bp, Mus musculus
tcctggcggagagacctgagatggt

SEQ ID NO: 970578 - DNA, 25 bp, Mus musculus
tcctggcggagagagctgagatggt

SEQ ID NO: 970579 - DNA, 25 bp, Mus musculus
tcctggcttcagaaagttccggctc

SEQ ID NO: 970580 - DNA, 25 bp, Mus musculus
tcctggcttcagtaagttccggctc

SEQ ID NO: 970581 - DNA, 25 bp, Mus musculus
tcctggcttgcacaccggggccctg

SEQ ID NO: 970582 - DNA, 25 bp, Mus musculus
tcctggcttgcactgtgcctgcagt

SEQ ID NO: 970583 - DNA, 25 bp, Mus musculus
tcctggcttgcagaccggggccctg

SEQ ID NO: 970584 - DNA, 25 bp, Mus musculus
tcctggcttgcagtgtgcctgcagt

SEQ ID NO: 970585 - DNA, 25 bp, Mus musculus
tcctgggagatgctatgggcgtctc

SEQ ID NO: 970586 - DNA, 25 bp, Mus musculus
tcctgggagatggtatgggcgtctc

SEQ ID NO: 970587 - DNA, 25 bp, Mus musculus
tcctgggatacagtccactgccatt

SEQ ID NO: 970588 - DNA, 25 bp, Mus musculus
tcctgggatacagtgcactgccatt

SEQ ID NO: 970589 - DNA, 25 bp, Mus musculus
tcctgggatgctcatcagaacaagc

SEQ ID NO: 970590 - DNA, 25 bp, Mus musculus
tcctgggatggtcatcagaacaagc

SEQ ID NO: 970591 - DNA, 25 bp, Mus musculus
tcctgggcacagaccgcgggacagt

SEQ ID NO: 970592 - DNA, 25 bp, Mus musculus
tcctgggcacagtccgcgggacagt

SEQ ID NO: 970593 - DNA, 25 bp, Mus musculus
tcctgggctctggacgcttcattgg

SEQ ID NO: 970594 - DNA, 25 bp, Mus musculus
tcctgggctctggaggcttcattgg

SEQ ID NO: 970595 - DNA, 25 bp, Mus musculus
tcctggggacccagtcctccatcca

SEQ ID NO: 970596 - DNA, 25 bp, Mus musculus
tcctggggaccctgtcctccatcca

SEQ ID NO: 970597 - DNA, 25 bp, Mus musculus
tcctgggtacaacccaaaggtcatt

SEQ ID NO: 970598 - DNA, 25 bp, Mus musculus
tcctgggtacaagccaaaggtcatt

SEQ ID NO: 970599 - DNA, 25 bp, Mus musculus
tcctggtaccagcaccagcgagcac

SEQ ID NO: 970600 - DNA, 25 bp, Mus musculus
tcctggtaccaggaccagcgagcac

SEQ ID NO: 970601 - DNA, 25 bp, Mus musculus
tcctggtataagctcatattaagca

SEQ ID NO: 970602 - DNA, 25 bp, Mus musculus
tcctggtataaggtcatattaagca

SEQ ID NO: 970603 - DNA, 25 bp, Mus musculus
tcctggtatcagcatcagcgatccc

SEQ ID NO: 970604 - DNA, 25 bp, Mus musculus
tcctggtatcaggatcagcgatccc

SEQ ID NO: 970605 - DNA, 25 bp, Mus musculus
tcctggtatgagcacggcatccttg

SEQ ID NO: 970606 - DNA, 25 bp, Mus musculus
tcctggtatgagcagggcatccttg

SEQ ID NO: 970607 - DNA, 25 bp, Mus musculus
tcctggtcagctcaaagagctggta

SEQ ID NO: 970608 - DNA, 25 bp, Mus musculus
tcctggtcaggtcaaagagctggta

SEQ ID NO: 970609 - DNA, 25 bp, Mus musculus
tcctggtctcagctaatctccaaaa

SEQ ID NO: 970610 - DNA, 25 bp, Mus musculus
tcctggtctcaggtaatctccaaaa

SEQ ID NO: 970611 - DNA, 25 bp, Mus musculus
tcctggtgacaacggttccaaagga

SEQ ID NO: 970612 - DNA, 25 bp, Mus musculus
tcctggtgacaagggttccaaagga

SEQ ID NO: 970613 - DNA, 25 bp, Mus musculus
tcctggtgctagcacaggttagtgt

SEQ ID NO: 970614 - DNA, 25 bp, Mus musculus
tcctggtgctagcagtggcctgcag

SEQ ID NO: 970615 - DNA, 25 bp, Mus musculus
tcctggtgctagctggtgaagacac

SEQ ID NO: 970616 - DNA, 25 bp, Mus musculus
tcctggtgctaggacaggttagtgt

SEQ ID NO: 970617 - DNA, 25 bp, Mus musculus
tcctggtgctaggagtggcctgcag

SEQ ID NO: 970618 - DNA, 25 bp, Mus musculus
tcctggtgctaggtggtgaagacac

SEQ ID NO: 970619 - DNA, 25 bp, Mus musculus
tcctggtgtgcccgggtcaccaggt

SEQ ID NO: 970620 - DNA, 25 bp, Mus musculus
tcctggtgtgccggggtcaccaggt

SEQ ID NO: 970621 - DNA, 25 bp, Mus musculus
tcctggtttgaacatcccaatactt

SEQ ID NO: 970622 - DNA, 25 bp, Mus musculus
tcctggtttgaacgtttggagtcga

SEQ ID NO: 970623 - DNA, 25 bp, Mus musculus
tcctggtttgaagatcccaatactt

SEQ ID NO: 970624 - DNA, 25 bp, Mus musculus
tcctggtttgaaggtttggagtcga

SEQ ID NO: 970625 - DNA, 25 bp, Mus musculus
tcctgtaccactcaccaggtggaga

SEQ ID NO: 970626 - DNA, 25 bp, Mus musculus
tcctgtaccactgaccaggtggaga

SEQ ID NO: 970627 - DNA, 25 bp, Mus musculus
tcctgtaccgctgcccgtcatggcg

SEQ ID NO: 970628 - DNA, 25 bp, Mus musculus
tcctgtaccggtgcccgtcatggcg

SEQ ID NO: 970629 - DNA, 25 bp, Mus musculus
tcctgtagccaacaccacatccttc

SEQ ID NO: 970630 - DNA, 25 bp, Mus musculus
tcctgtagccaacgtcagattacct

SEQ ID NO: 970631 - DNA, 25 bp, Mus musculus
tcctgtagccaagaccacatccttc

SEQ ID NO: 970632 - DNA, 25 bp, Mus musculus
tcctgtagccaaggtcagattacct

SEQ ID NO: 970633 - DNA, 25 bp, Mus musculus
tcctgtagtgcgctgtgcaaaacta

SEQ ID NO: 970634 - DNA, 25 bp, Mus musculus
tcctgtagtgcggtgtgcaaaacta

SEQ ID NO: 970635 - DNA, 25 bp, Mus musculus
tcctgtcaggaacgagtcacacctg

SEQ ID NO: 970636 - DNA, 25 bp, Mus musculus
tcctgtcaggaaggagtcacacctg

SEQ ID NO: 970637 - DNA, 25 bp, Mus musculus
tcctgtcatgcgcgctagtggtggt

SEQ ID NO: 970638 - DNA, 25 bp, Mus musculus
tcctgtcatgcgggctagtggtggt

SEQ ID NO: 970639 - DNA, 25 bp, Mus musculus
tcctgtccagagagaacattataag

SEQ ID NO: 970640 - DNA, 25 bp, Mus musculus
tcctgtccagagccgagtggtccaa

SEQ ID NO: 970641 - DNA, 25 bp, Mus musculus
tcctgtccagcaaatctcccagctg

SEQ ID NO: 970642 - DNA, 25 bp, Mus musculus
tcctgtccagcagagaacacaagct

SEQ ID NO: 970643 - DNA, 25 bp, Mus musculus
tcctgtccaggaaatctcccagctg

SEQ ID NO: 970644 - DNA, 25 bp, Mus musculus
tcctgtccaggagagaacacaagct

SEQ ID NO: 970645 - DNA, 25 bp, Mus musculus
tcctgtccagtgagaacattataag

SEQ ID NO: 970646 - DNA, 25 bp, Mus musculus
tcctgtccagtgccgagtggtccaa

SEQ ID NO: 970647 - DNA, 25 bp, Mus musculus
tcctgtccatcttcttcctcatgtg

SEQ ID NO: 970648 - DNA, 25 bp, Mus musculus
tcctgtccatgttcttcctcatgtg

SEQ ID NO: 970649 - DNA, 25 bp, Mus musculus
tcctgtccccaaccgcataaagaag

SEQ ID NO: 970650 - DNA, 25 bp, Mus musculus
tcctgtccccaagcgcataaagaag

SEQ ID NO: 970651 - DNA, 25 bp, Mus musculus
tcctgtcccgaaacaagccttcacc

SEQ ID NO: 970652 - DNA, 25 bp, Mus musculus
tcctgtcccgtaacaagccttcacc

SEQ ID NO: 970653 - DNA, 25 bp, Mus musculus
tcctgtcctcagcgaccgcagcagc

SEQ ID NO: 970654 - DNA, 25 bp, Mus musculus
tcctgtcctcagcgccttcagggac

SEQ ID NO: 970655 - DNA, 25 bp, Mus musculus
tcctgtcctcagggaccgcagcagc

SEQ ID NO: 970656 - DNA, 25 bp, Mus musculus
tcctgtcctcagggccttcagggac

SEQ ID NO: 970657 - DNA, 25 bp, Mus musculus
tcctgtcctctcaacgctcaaactc

SEQ ID NO: 970658 - DNA, 25 bp, Mus musculus
tcctgtcctctcaaggctcaaactc

SEQ ID NO: 970659 - DNA, 25 bp, Mus musculus
tcctgtcctcttatagctccttcca

SEQ ID NO: 970660 - DNA, 25 bp, Mus musculus
tcctgtcctcttttagctccttcca

SEQ ID NO: 970661 - DNA, 25 bp, Mus musculus
tcctgtctatcgagaaaataagtcc

SEQ ID NO: 970662 - DNA, 25 bp, Mus musculus
tcctgtctatggagaaaataagtcc

SEQ ID NO: 970663 - DNA, 25 bp, Mus musculus
tcctgtctcacacacaagctctctt

SEQ ID NO: 970664 - DNA, 25 bp, Mus musculus
tcctgtctcacagacaagctctctt

SEQ ID NO: 970665 - DNA, 25 bp, Mus musculus
tcctgtgaagacatcaacgaatgca

SEQ ID NO: 970666 - DNA, 25 bp, Mus musculus
tcctgtgaagacatcaatgagtgtg

SEQ ID NO: 970667 - DNA, 25 bp, Mus musculus
tcctgtgaagaccaagacgagtgtt

SEQ ID NO: 970668 - DNA, 25 bp, Mus musculus
tcctgtgaagatattgacgaatgcg

SEQ ID NO: 970669 - DNA, 25 bp, Mus musculus
tcctgtgaagtcatcaacgaatgca

SEQ ID NO: 970670 - DNA, 25 bp, Mus musculus
tcctgtgaagtcatcaatgagtgtg

SEQ ID NO: 970671 - DNA, 25 bp, Mus musculus
tcctgtgaagtccaagacgagtgtt

SEQ ID NO: 970672 - DNA, 25 bp, Mus musculus
tcctgtgaagttattgacgaatgcg

SEQ ID NO: 970673 - DNA, 25 bp, Mus musculus
tcctgtgacaagccctgaagaaaca

SEQ ID NO: 970674 - DNA, 25 bp, Mus musculus
tcctgtgacaaggcctgaagaaaca

SEQ ID NO: 970675 - DNA, 25 bp, Mus musculus
tcctgtgacaagttattggatgacg

SEQ ID NO: 970676 - DNA, 25 bp, Mus musculus
tcctgtgacatgttattggatgacg

SEQ ID NO: 970677 - DNA, 25 bp, Mus musculus
tcctgtgactcgcgactacgtgcac

SEQ ID NO: 970678 - DNA, 25 bp, Mus musculus
tcctgtgactggcgactacgtgcac

SEQ ID NO: 970679 - DNA, 25 bp, Mus musculus
tcctgtgcagaacgcaaggcctgcg

SEQ ID NO: 970680 - DNA, 25 bp, Mus musculus
tcctgtgcagaaggcaaggcctgcg

SEQ ID NO: 970681 - DNA, 25 bp, Mus musculus
tcctgtgcagatctgtggccctggc

SEQ ID NO: 970682 - DNA, 25 bp, Mus musculus
tcctgtgcagttctgtggccctggc

SEQ ID NO: 970683 - DNA, 25 bp, Mus musculus
tcctgtgccaaaaaacattgccgta

SEQ ID NO: 970684 - DNA, 25 bp, Mus musculus
tcctgtgccataaaacattgccgta

SEQ ID NO: 970685 - DNA, 25 bp, Mus musculus
tcctgtgcccacaagcctcccctcg

SEQ ID NO: 970686 - DNA, 25 bp, Mus musculus
tcctgtgcccactagcctcccctcg

SEQ ID NO: 970687 - DNA, 25 bp, Mus musculus
tcctgtgcgtggcggagacaggttt

SEQ ID NO: 970688 - DNA, 25 bp, Mus musculus
tcctgtgcgtgggggagacaggttt

SEQ ID NO: 970689 - DNA, 25 bp, Mus musculus
tcctgtggatgtctgacttctgggg

SEQ ID NO: 970690 - DNA, 25 bp, Mus musculus
tcctgtggatgtgtgacttctgggg

SEQ ID NO: 970691 - DNA, 25 bp, Mus musculus
tcctgtgttcaacgctgcaaattgg

SEQ ID NO: 970692 - DNA, 25 bp, Mus musculus
tcctgtgttcaaggctgcaaattgg

SEQ ID NO: 970693 - DNA, 25 bp, Mus musculus
tcctgtgtttgctacagggcaatgc

SEQ ID NO: 970694 - DNA, 25 bp, Mus musculus
tcctgtgtttgctagagggcaatgc

SEQ ID NO: 970695 - DNA, 25 bp, Mus musculus
tcctgttcaaccctcactctaaggg

SEQ ID NO: 970696 - DNA, 25 bp, Mus musculus
tcctgttcaaccctgactctaaggg

SEQ ID NO: 970697 - DNA, 25 bp, Mus musculus
tcctgttcacctcacatgcctgtgg

SEQ ID NO: 970698 - DNA, 25 bp, Mus musculus
tcctgttcacctcagatgcctgtgg

SEQ ID NO: 970699 - DNA, 25 bp, Mus musculus
tcctgttcagcaccatcagcaccag

SEQ ID NO: 970700 - DNA, 25 bp, Mus musculus
tcctgttcaggaccatcagcaccag

SEQ ID NO: 970701 - DNA, 25 bp, Mus musculus
tcctgttcggagctctcatcggctc

SEQ ID NO: 970702 - DNA, 25 bp, Mus musculus
tcctgttcggaggtctcatcggctc

SEQ ID NO: 970703 - DNA, 25 bp, Mus musculus
tcctgtttaacagttcagatgcctg

SEQ ID NO: 970704 - DNA, 25 bp, Mus musculus
tcctgtttaaccatcagcagtgtta

SEQ ID NO: 970705 - DNA, 25 bp, Mus musculus
tcctgtttaagagttcagatgcctg

SEQ ID NO: 970706 - DNA, 25 bp, Mus musculus
tcctgtttaagcatcagcagtgtta

SEQ ID NO: 970707 - DNA, 25 bp, Mus musculus
tcctgtttgaagcgatcgcccgaat

SEQ ID NO: 970708 - DNA, 25 bp, Mus musculus
tcctgtttgaagggatcgcccgaat

SEQ ID NO: 970709 - DNA, 25 bp, Mus musculus
tccttaaaacaactaactccatcaa

SEQ ID NO: 970710 - DNA, 25 bp, Mus musculus
tccttaaaacaagtaactccatcaa

SEQ ID NO: 970711 - DNA, 25 bp, Mus musculus
tccttaatgagatcctcacattagc

SEQ ID NO: 970712 - DNA, 25 bp, Mus musculus
tccttaatgagatcgtcacattagc

SEQ ID NO: 970713 - DNA, 25 bp, Mus musculus
tccttacagcagctggccccttctg

SEQ ID NO: 970714 - DNA, 25 bp, Mus musculus
tccttacagcaggtggccccttctg

SEQ ID NO: 970715 - DNA, 25 bp, Mus musculus
tccttacagcccaaccagccaccta

SEQ ID NO: 970716 - DNA, 25 bp, Mus musculus
tccttacagcccaagcagccaccta

SEQ ID NO: 970717 - DNA, 25 bp, Mus musculus
tccttaccagcagatcgagactcat

SEQ ID NO: 970718 - DNA, 25 bp, Mus musculus
tccttaccaggagatcgagactcat

SEQ ID NO: 970719 - DNA, 25 bp, Mus musculus
tccttagatttacacattcaaacac

SEQ ID NO: 970720 - DNA, 25 bp, Mus musculus
tccttagatttagacattcaaacac

SEQ ID NO: 970721 - DNA, 25 bp, Mus musculus
tccttagcaccaaggaggctgcagt

SEQ ID NO: 970722 - DNA, 25 bp, Mus musculus
tccttagcacgaaggaggctgcagt

SEQ ID NO: 970723 - DNA, 25 bp, Mus musculus
tccttatagtctcattcctttctcc

SEQ ID NO: 970724 - DNA, 25 bp, Mus musculus
tccttatagtctgattcctttctcc

SEQ ID NO: 970725 - DNA, 25 bp, Mus musculus
tccttatcatccttagcaagagatg

SEQ ID NO: 970726 - DNA, 25 bp, Mus musculus
tccttatcatcctttgcaagagatg

SEQ ID NO: 970727 - DNA, 25 bp, Mus musculus
tccttattacagatcctggagggtc

SEQ ID NO: 970728 - DNA, 25 bp, Mus musculus
tccttattacagttcctggagggtc

SEQ ID NO: 970729 - DNA, 25 bp, Mus musculus
tccttcaaagcaccccaatcatgga

SEQ ID NO: 970730 - DNA, 25 bp, Mus musculus
tccttcaaagcagcccaatcatgga

SEQ ID NO: 970731 - DNA, 25 bp, Mus musculus
tccttcaaggagatcctctgctggt

SEQ ID NO: 970732 - DNA, 25 bp, Mus musculus
tccttcaaggagatgctctgctggt

SEQ ID NO: 970733 - DNA, 25 bp, Mus musculus
tccttcacagcatttggaagctccc

SEQ ID NO: 970734 - DNA, 25 bp, Mus musculus
tccttcacaggatttggaagctccc

SEQ ID NO: 970735 - DNA, 25 bp, Mus musculus
tccttcaccaatatatcaaaagttt

SEQ ID NO: 970736 - DNA, 25 bp, Mus musculus
tccttcaccaatttatcaaaagttt

SEQ ID NO: 970737 - DNA, 25 bp, Mus musculus
tccttcaccacaaacgtgggccttt

SEQ ID NO: 970738 - DNA, 25 bp, Mus musculus
tccttcaccacaaaggtgggccttt

SEQ ID NO: 970739 - DNA, 25 bp, Mus musculus
tccttcagaactacatgatggtgga

SEQ ID NO: 970740 - DNA, 25 bp, Mus musculus
tccttcagaagtacatgatggtgga

SEQ ID NO: 970741 - DNA, 25 bp, Mus musculus
tccttcagagatttatccaataatg

SEQ ID NO: 970742 - DNA, 25 bp, Mus musculus
tccttcagagttttatccaataatg

SEQ ID NO: 970743 - DNA, 25 bp, Mus musculus
tccttcaggaccccaaggtcatgat

SEQ ID NO: 970744 - DNA, 25 bp, Mus musculus
tccttcaggacccctaggtcatgat

SEQ ID NO: 970745 - DNA, 25 bp, Mus musculus
tccttcagtgagattaaagattttt

SEQ ID NO: 970746 - DNA, 25 bp, Mus musculus
tccttcagtgagtttaaagattttt

SEQ ID NO: 970747 - DNA, 25 bp, Mus musculus
tccttcatagaacatcaagatgtag

SEQ ID NO: 970748 - DNA, 25 bp, Mus musculus
tccttcatagaacgtacttcaagag

SEQ ID NO: 970749 - DNA, 25 bp, Mus musculus
tccttcatagaagatcaagatgtag

SEQ ID NO: 970750 - DNA, 25 bp, Mus musculus
tccttcatagaaggtacttcaagag

SEQ ID NO: 970751 - DNA, 25 bp, Mus musculus
tccttcatcgacaacgtacgcttcc

SEQ ID NO: 970752 - DNA, 25 bp, Mus musculus
tccttcatcgacaaggtacgcttcc

SEQ ID NO: 970753 - DNA, 25 bp, Mus musculus
tccttcatggagcatgatcgggtgt

SEQ ID NO: 970754 - DNA, 25 bp, Mus musculus
tccttcatggaggatgatcgggtgt

SEQ ID NO: 970755 - DNA, 25 bp, Mus musculus
tccttccaaacaggatttgttggta

SEQ ID NO: 970756 - DNA, 25 bp, Mus musculus
tccttccaaagaggatttgttggta

SEQ ID NO: 970757 - DNA, 25 bp, Mus musculus
tccttccaactcaggctgcttctga

SEQ ID NO: 970758 - DNA, 25 bp, Mus musculus
tccttccaactctggctgcttctga

SEQ ID NO: 970759 - DNA, 25 bp, Mus musculus
tccttccagtgaccttgcttcccag

SEQ ID NO: 970760 - DNA, 25 bp, Mus musculus
tccttccagtgagcttgcttcccag

SEQ ID NO: 970761 - DNA, 25 bp, Mus musculus
tccttcccagattctgaacttctgg

SEQ ID NO: 970762 - DNA, 25 bp, Mus musculus
tccttcccagtttctgaacttctgg

SEQ ID NO: 970763 - DNA, 25 bp, Mus musculus
tccttccggtcagactcggcccagt

SEQ ID NO: 970764 - DNA, 25 bp, Mus musculus
tccttccggtcagagtcggcccagt

SEQ ID NO: 970765 - DNA, 25 bp, Mus musculus
tccttcctctctagctcttagtgat

SEQ ID NO: 970766 - DNA, 25 bp, Mus musculus
tccttcctctcttgctcttagtgat

SEQ ID NO: 970767 - DNA, 25 bp, Mus musculus
tccttccttcagaagagttcgctcc

SEQ ID NO: 970768 - DNA, 25 bp, Mus musculus
tccttccttcagtagagttcgctcc

SEQ ID NO: 970769 - DNA, 25 bp, Mus musculus
tccttcgcctcagacgtcgagccca

SEQ ID NO: 970770 - DNA, 25 bp, Mus musculus
tccttcgcctcagacgtggcatgca

SEQ ID NO: 970771 - DNA, 25 bp, Mus musculus
tccttcgcctcagaggtcgagccca

SEQ ID NO: 970772 - DNA, 25 bp, Mus musculus
tccttcgcctcagaggtggcatgca

SEQ ID NO: 970773 - DNA, 25 bp, Mus musculus
tccttcgtcttctgcatcactgggg

SEQ ID NO: 970774 - DNA, 25 bp, Mus musculus
tccttcgtcttctggatcactgggg

SEQ ID NO: 970775 - DNA, 25 bp, Mus musculus
tccttctaccagctcagtcatttcc

SEQ ID NO: 970776 - DNA, 25 bp, Mus musculus
tccttctaccagctgagtcatttcc

SEQ ID NO: 970777 - DNA, 25 bp, Mus musculus
tccttctagcagccctgcctacttt

SEQ ID NO: 970778 - DNA, 25 bp, Mus musculus
tccttctagcaggcctgcctacttt

SEQ ID NO: 970779 - DNA, 25 bp, Mus musculus
tccttctcatcccacgagaaaagcc

SEQ ID NO: 970780 - DNA, 25 bp, Mus musculus
tccttctcatcccaggagaaaagcc

SEQ ID NO: 970781 - DNA, 25 bp, Mus musculus
tccttctggaccaacctatagagga

SEQ ID NO: 970782 - DNA, 25 bp, Mus musculus
tccttctggaccaagctatagagga

SEQ ID NO: 970783 - DNA, 25 bp, Mus musculus
tccttctggtgccacctctaggaat

SEQ ID NO: 970784 - DNA, 25 bp, Mus musculus
tccttctggtgccagctctaggaat

SEQ ID NO: 970785 - DNA, 25 bp, Mus musculus
tccttctgtggcaacaccaagatga

SEQ ID NO: 970786 - DNA, 25 bp, Mus musculus
tccttctgtggcaagaccaagatga

SEQ ID NO: 970787 - DNA, 25 bp, Mus musculus
tccttgaattccagcatgagaacag

SEQ ID NO: 970788 - DNA, 25 bp, Mus musculus
tccttgaattccaggatgagaacag

SEQ ID NO: 970789 - DNA, 25 bp, Mus musculus
tccttgactttgaacgttgtcttga

SEQ ID NO: 970790 - DNA, 25 bp, Mus musculus
tccttgactttgaaggttgtcttga

SEQ ID NO: 970791 - DNA, 25 bp, Mus musculus
tccttgagtgggcactgtcagggca

SEQ ID NO: 970792 - DNA, 25 bp, Mus musculus
tccttgagtggggactgtcagggca

SEQ ID NO: 970793 - DNA, 25 bp, Mus musculus
tccttgataactattctctgaaacc

SEQ ID NO: 970794 - DNA, 25 bp, Mus musculus
tccttgataagtattctctgaaacc

SEQ ID NO: 970795 - DNA, 25 bp, Mus musculus
tccttgatgcaaaatttgctgatca

SEQ ID NO: 970796 - DNA, 25 bp, Mus musculus
tccttgatgcaatatttgctgatca

SEQ ID NO: 970797 - DNA, 25 bp, Mus musculus
tccttgatgccacacggaaaaggcg

SEQ ID NO: 970798 - DNA, 25 bp, Mus musculus
tccttgatgccagacggaaaaggcg

SEQ ID NO: 970799 - DNA, 25 bp, Mus musculus
tccttgcatacactaatgtgcaaga

SEQ ID NO: 970800 - DNA, 25 bp, Mus musculus
tccttgcatacagtaatgtgcaaga

SEQ ID NO: 970801 - DNA, 25 bp, Mus musculus
tccttgcctgccaacgtcctcttct

SEQ ID NO: 970802 - DNA, 25 bp, Mus musculus
tccttgcctgccaaggtcctcttct

SEQ ID NO: 970803 - DNA, 25 bp, Mus musculus
tccttgcgacaacacatggagaagt

SEQ ID NO: 970804 - DNA, 25 bp, Mus musculus
tccttgcgacaacagatggagaagt

SEQ ID NO: 970805 - DNA, 25 bp, Mus musculus
tccttgctattgctcctgggcctgc

SEQ ID NO: 970806 - DNA, 25 bp, Mus musculus
tccttgctattggtcctgggcctgc

SEQ ID NO: 970807 - DNA, 25 bp, Mus musculus
tccttgctcacacgggactacattc

SEQ ID NO: 970808 - DNA, 25 bp, Mus musculus
tccttgctcacaggggactacattc

SEQ ID NO: 970809 - DNA, 25 bp, Mus musculus
tccttgctgctgcctgacactttgc

SEQ ID NO: 970810 - DNA, 25 bp, Mus musculus
tccttgctgctggctgacactttgc

SEQ ID NO: 970811 - DNA, 25 bp, Mus musculus
tccttgctgttcagtttgtgaagtt

SEQ ID NO: 970812 - DNA, 25 bp, Mus musculus
tccttgctgttctgtttgtgaagtt

SEQ ID NO: 970813 - DNA, 25 bp, Mus musculus
tccttggagaatcgttataagtaca

SEQ ID NO: 970814 - DNA, 25 bp, Mus musculus
tccttggagaatggttataagtaca

SEQ ID NO: 970815 - DNA, 25 bp, Mus musculus
tccttggagacactctcccttgctt

SEQ ID NO: 970816 - DNA, 25 bp, Mus musculus
tccttggagacgccctcacagagtt

SEQ ID NO: 970817 - DNA, 25 bp, Mus musculus
tccttggagacggcctcacagagtt

SEQ ID NO: 970818 - DNA, 25 bp, Mus musculus
tccttggagagactctcccttgctt

SEQ ID NO: 970819 - DNA, 25 bp, Mus musculus
tccttggcagaacctctgcagatcc

SEQ ID NO: 970820 - DNA, 25 bp, Mus musculus
tccttggcagaacgtagcacggctt

SEQ ID NO: 970821 - DNA, 25 bp, Mus musculus
tccttggcagaagctctgcagatcc

SEQ ID NO: 970822 - DNA, 25 bp, Mus musculus
tccttggcagaaggtagcacggctt

SEQ ID NO: 970823 - DNA, 25 bp, Mus musculus
tccttggctacacgattatcagact

SEQ ID NO: 970824 - DNA, 25 bp, Mus musculus
tccttggctacaggattatcagact

SEQ ID NO: 970825 - DNA, 25 bp, Mus musculus
tccttggctatccgtttggtgttta

SEQ ID NO: 970826 - DNA, 25 bp, Mus musculus
tccttggctatcggtttggtgttta

SEQ ID NO: 970827 - DNA, 25 bp, Mus musculus
tccttggctgaccacgatattttca

SEQ ID NO: 970828 - DNA, 25 bp, Mus musculus
tccttggctgaccaggatattttca

SEQ ID NO: 970829 - DNA, 25 bp, Mus musculus
tccttggctgccagcacagactctg

SEQ ID NO: 970830 - DNA, 25 bp, Mus musculus
tccttggctgcgaaaatgacccagc

SEQ ID NO: 970831 - DNA, 25 bp, Mus musculus
tccttggctgcgggaagaacagttc

SEQ ID NO: 970832 - DNA, 25 bp, Mus musculus
tccttggctggaagctcaggccctg

SEQ ID NO: 970833 - DNA, 25 bp, Mus musculus
tccttggctggactcaggccctgga

SEQ ID NO: 970834 - DNA, 25 bp, Mus musculus
tccttggctggagtcaggccctgga

SEQ ID NO: 970835 - DNA, 25 bp, Mus musculus
tccttggctggatgctcaggccctg

SEQ ID NO: 970836 - DNA, 25 bp, Mus musculus
tccttggctggcagcacagactctg

SEQ ID NO: 970837 - DNA, 25 bp, Mus musculus
tccttggctgggaaaatgacccagc

SEQ ID NO: 970838 - DNA, 25 bp, Mus musculus
tccttggctgggggaagaacagttc

SEQ ID NO: 970839 - DNA, 25 bp, Mus musculus
tccttggttcaaaacagaagcaaag

SEQ ID NO: 970840 - DNA, 25 bp, Mus musculus
tccttggttcaatacagaagcaaag

SEQ ID NO: 970841 - DNA, 25 bp, Mus musculus
tccttgtagactaaacacatgaaga

SEQ ID NO: 970842 - DNA, 25 bp, Mus musculus
tccttgtagacttaacacatgaaga

SEQ ID NO: 970843 - DNA, 25 bp, Mus musculus
tccttgtcaaagactacaaaatacc

SEQ ID NO: 970844 - DNA, 25 bp, Mus musculus
tccttgtcaaagatcgactgtgccg

SEQ ID NO: 970845 - DNA, 25 bp, Mus musculus
tccttgtcaaagtctacaaaatacc

SEQ ID NO: 970846 - DNA, 25 bp, Mus musculus
tccttgtcaaagttcgactgtgccg

SEQ ID NO: 970847 - DNA, 25 bp, Mus musculus
tccttgtcccagcccaagatggatg

SEQ ID NO: 970848 - DNA, 25 bp, Mus musculus
tccttgtcccaggccaagatggatg

SEQ ID NO: 970849 - DNA, 25 bp, Mus musculus
tccttgttttcgggcggctgctgaa

SEQ ID NO: 970850 - DNA, 25 bp, Mus musculus
tccttgttttcggggggctgctgaa

SEQ ID NO: 970851 - DNA, 25 bp, Mus musculus
tcctttacaggcgacatgatttttg

SEQ ID NO: 970852 - DNA, 25 bp, Mus musculus
tcctttacaggcgagatgatttttg

SEQ ID NO: 970853 - DNA, 25 bp, Mus musculus
tcctttcaagaattacaggcccggc

SEQ ID NO: 970854 - DNA, 25 bp, Mus musculus
tcctttcaagtattacaggcccggc

SEQ ID NO: 970855 - DNA, 25 bp, Mus musculus
tcctttcaccaacctccatgtgtcc

SEQ ID NO: 970856 - DNA, 25 bp, Mus musculus
tcctttcaccaagctccatgtgtcc

SEQ ID NO: 970857 - DNA, 25 bp, Mus musculus
tcctttcccgagaggtggatgtgtt

SEQ ID NO: 970858 - DNA, 25 bp, Mus musculus
tcctttcccgagtggtggatgtgtt

SEQ ID NO: 970859 - DNA, 25 bp, Mus musculus
tcctttcctaaccctgctgcatttt

SEQ ID NO: 970860 - DNA, 25 bp, Mus musculus
tcctttcctaacgctgctgcatttt

SEQ ID NO: 970861 - DNA, 25 bp, Mus musculus
tcctttctctgacgtcctggcctac

SEQ ID NO: 970862 - DNA, 25 bp, Mus musculus
tcctttctctgaggtcctggcctac

SEQ ID NO: 970863 - DNA, 25 bp, Mus musculus
tcctttgaagagcacatggcccagt

SEQ ID NO: 970864 - DNA, 25 bp, Mus musculus
tcctttgaagagcacgttgcttcca

SEQ ID NO: 970865 - DNA, 25 bp, Mus musculus
tcctttgaagagcagatggcccagt

SEQ ID NO: 970866 - DNA, 25 bp, Mus musculus
tcctttgaagagcaggttgcttcca

SEQ ID NO: 970867 - DNA, 25 bp, Mus musculus
tcctttgagtccatcagcagtgtta

SEQ ID NO: 970868 - DNA, 25 bp, Mus musculus
tcctttgagtgcatcagcagtgtta

SEQ ID NO: 970869 - DNA, 25 bp, Mus musculus
tcctttggaaaacttgctgtggttc

SEQ ID NO: 970870 - DNA, 25 bp, Mus musculus
tcctttggaaaagttgctgtggttc

SEQ ID NO: 970871 - DNA, 25 bp, Mus musculus
tcctttggcgtacgcggacttggag

SEQ ID NO: 970872 - DNA, 25 bp, Mus musculus
tcctttggcgtaggcggacttggag

SEQ ID NO: 970873 - DNA, 25 bp, Mus musculus
tcctttggtgtgccatattcccaca

SEQ ID NO: 970874 - DNA, 25 bp, Mus musculus
tcctttggtgtggcatattcccaca

SEQ ID NO: 970875 - DNA, 25 bp, Mus musculus
tcctttgtatctctcctggaaagaa

SEQ ID NO: 970876 - DNA, 25 bp, Mus musculus
tcctttgtatctgtcctggaaagaa

SEQ ID NO: 970877 - DNA, 25 bp, Mus musculus
tcctttgtgtatttaagcaatgttg

SEQ ID NO: 970878 - DNA, 25 bp, Mus musculus
tcctttgtgtttttaagcaatgttg

SEQ ID NO: 970879 - DNA, 25 bp, Mus musculus
tccttttctacacgaagagcagtga

SEQ ID NO: 970880 - DNA, 25 bp, Mus musculus
tccttttctacaggaagagcagtga

SEQ ID NO: 970881 - DNA, 25 bp, Mus musculus
tcgaaaatctatgaaagccctggtt

SEQ ID NO: 970882 - DNA, 25 bp, Mus musculus
tcgaaaatctatgaaatcagcaacc

SEQ ID NO: 970883 - DNA, 25 bp, Mus musculus
tcgaaaatctatgatagccctggtt

SEQ ID NO: 970884 - DNA, 25 bp, Mus musculus
tcgaaaatctatgatatcagcaacc

SEQ ID NO: 970885 - DNA, 25 bp, Mus musculus
tcgaaaccagcacaccttctctgtg

SEQ ID NO: 970886 - DNA, 25 bp, Mus musculus
tcgaaaccaggacaccttctctgtg

SEQ ID NO: 970887 - DNA, 25 bp, Mus musculus
tcgaaatgaaagatccagcaatgac

SEQ ID NO: 970888 - DNA, 25 bp, Mus musculus
tcgaaatgaaagttccagcaatgac

SEQ ID NO: 970889 - DNA, 25 bp, Mus musculus
tcgaacaatgagctgatagagtgca

SEQ ID NO: 970890 - DNA, 25 bp, Mus musculus
tcgaacaatgaggtgatagagtgca

SEQ ID NO: 970891 - DNA, 25 bp, Mus musculus
tcgaacacagagacagatctgcatc

SEQ ID NO: 970892 - DNA, 25 bp, Mus musculus
tcgaacacagtgacagatctgcatc

SEQ ID NO: 970893 - DNA, 25 bp, Mus musculus
tcgaacagacaaccctttgaggacc

SEQ ID NO: 970894 - DNA, 25 bp, Mus musculus
tcgaacagacaacggtgtgtctgca

SEQ ID NO: 970895 - DNA, 25 bp, Mus musculus
tcgaacagacaagcctttgaggacc

SEQ ID NO: 970896 - DNA, 25 bp, Mus musculus
tcgaacagacaagggtgtgtctgca

SEQ ID NO: 970897 - DNA, 25 bp, Mus musculus
tcgaacatagcactgttgagctgaa

SEQ ID NO: 970898 - DNA, 25 bp, Mus musculus
tcgaacatagcagtgttgagctgaa

SEQ ID NO: 970899 - DNA, 25 bp, Mus musculus
tcgaacggccagctgtcgtgattaa

SEQ ID NO: 970900 - DNA, 25 bp, Mus musculus
tcgaacggccaggtgtcgtgattaa

SEQ ID NO: 970901 - DNA, 25 bp, Mus musculus
tcgaacgtgccacggtcagggaaac

SEQ ID NO: 970902 - DNA, 25 bp, Mus musculus
tcgaacgtgccagggtcagggaaac

SEQ ID NO: 970903 - DNA, 25 bp, Mus musculus
tcgaagaaagatactgcagctaaag

SEQ ID NO: 970904 - DNA, 25 bp, Mus musculus
tcgaagaaagttactgcagctaaag

SEQ ID NO: 970905 - DNA, 25 bp, Mus musculus
tcgaagaatggaaacaacttatcta

SEQ ID NO: 970906 - DNA, 25 bp, Mus musculus
tcgaagaatggaaagaacttatcta

SEQ ID NO: 970907 - DNA, 25 bp, Mus musculus
tcgaagatgcccagagagcactgga

SEQ ID NO: 970908 - DNA, 25 bp, Mus musculus
tcgaagatgcccagtgagcactgga

SEQ ID NO: 970909 - DNA, 25 bp, Mus musculus
tcgaagcaccaaatcaagagaaagt

SEQ ID NO: 970910 - DNA, 25 bp, Mus musculus
tcgaagcaccaattcaagagaaagt

SEQ ID NO: 970911 - DNA, 25 bp, Mus musculus
tcgaagccagcccactggaacccca

SEQ ID NO: 970912 - DNA, 25 bp, Mus musculus
tcgaagccagcccagtggaacccca

SEQ ID NO: 970913 - DNA, 25 bp, Mus musculus
tcgaagcgtttgatgactccggaaa

SEQ ID NO: 970914 - DNA, 25 bp, Mus musculus
tcgaagcgtttgcaatcccggaagg

SEQ ID NO: 970915 - DNA, 25 bp, Mus musculus
tcgaagcgtttgcctccttccgctc

SEQ ID NO: 970916 - DNA, 25 bp, Mus musculus
tcgaagcgtttggaatcccggaagg

SEQ ID NO: 970917 - DNA, 25 bp, Mus musculus
tcgaagcgtttggctccttccgctc

SEQ ID NO: 970918 - DNA, 25 bp, Mus musculus
tcgaagcgtttgttgactccggaaa

SEQ ID NO: 970919 - DNA, 25 bp, Mus musculus
tcgaagtcagaaacgtggtatctca

SEQ ID NO: 970920 - DNA, 25 bp, Mus musculus
tcgaagtcagtaacgtggtatctca

SEQ ID NO: 970921 - DNA, 25 bp, Mus musculus
tcgaagtgagctagagctcacaaga

SEQ ID NO: 970922 - DNA, 25 bp, Mus musculus
tcgaagtgaggtagagctcacaaga

SEQ ID NO: 970923 - DNA, 25 bp, Mus musculus
tcgaataccgccatgtcatgttgcc

SEQ ID NO: 970924 - DNA, 25 bp, Mus musculus
tcgaataccggcatgtcatgttgcc

SEQ ID NO: 970925 - DNA, 25 bp, Mus musculus
tcgaatctacagcggccgggctaga

SEQ ID NO: 970926 - DNA, 25 bp, Mus musculus
tcgaatctacaggggccgggctaga

SEQ ID NO: 970927 - DNA, 25 bp, Mus musculus
tcgaatggatatacccctcctacat

SEQ ID NO: 970928 - DNA, 25 bp, Mus musculus
tcgaatggatttacccctcctacat

SEQ ID NO: 970929 - DNA, 25 bp, Mus musculus
tcgacaacagcttcctacacgaaag

SEQ ID NO: 970930 - DNA, 25 bp, Mus musculus
tcgacaacaggttcctacacgaaag

SEQ ID NO: 970931 - DNA, 25 bp, Mus musculus
tcgacaagaatgaacacagaaaaaa

SEQ ID NO: 970932 - DNA, 25 bp, Mus musculus
tcgacaagaatgaagacagaaaaaa

SEQ ID NO: 970933 - DNA, 25 bp, Mus musculus
tcgacaagagtgcacaggagatgcc

SEQ ID NO: 970934 - DNA, 25 bp, Mus musculus
tcgacaagagtgcagaggagatgcc

SEQ ID NO: 970935 - DNA, 25 bp, Mus musculus
tcgacaatggaagaccacatagata

SEQ ID NO: 970936 - DNA, 25 bp, Mus musculus
tcgacaatggaagagcacatagata

SEQ ID NO: 970937 - DNA, 25 bp, Mus musculus
tcgacacgcacacggaggtatgtgg

SEQ ID NO: 970938 - DNA, 25 bp, Mus musculus
tcgacacgcacagggaggtatgtgg

SEQ ID NO: 970939 - DNA, 25 bp, Mus musculus
tcgacagcgccgagacgcgtggcgg

SEQ ID NO: 970940 - DNA, 25 bp, Mus musculus
tcgacagcgcggagacgcgtggcgg

SEQ ID NO: 970941 - DNA, 25 bp, Mus musculus
tcgacagtggctcttccagccacag

SEQ ID NO: 970942 - DNA, 25 bp, Mus musculus
tcgacagtgggtcttccagccacag

SEQ ID NO: 970943 - DNA, 25 bp, Mus musculus
tcgacagttcatcacaggagaaatg

SEQ ID NO: 970944 - DNA, 25 bp, Mus musculus
tcgacagttcatcagaggagaaatg

SEQ ID NO: 970945 - DNA, 25 bp, Mus musculus
tcgacataatcattacagatgcctt

SEQ ID NO: 970946 - DNA, 25 bp, Mus musculus
tcgacataatgattacagatgcctt

SEQ ID NO: 970947 - DNA, 25 bp, Mus musculus
tcgacatatggacgctgtgaagaca

SEQ ID NO: 970948 - DNA, 25 bp, Mus musculus
tcgacatatggaggctgtgaagaca

SEQ ID NO: 970949 - DNA, 25 bp, Mus musculus
tcgacatcctataacccagtttatg

SEQ ID NO: 970950 - DNA, 25 bp, Mus musculus
tcgacatcctattacccagtttatg

SEQ ID NO: 970951 - DNA, 25 bp, Mus musculus
tcgacattgtgacttcactgaagaa

SEQ ID NO: 970952 - DNA, 25 bp, Mus musculus
tcgacattgtgagttcactgaagaa

SEQ ID NO: 970953 - DNA, 25 bp, Mus musculus
tcgacattttcttgcggagcaagag

SEQ ID NO: 970954 - DNA, 25 bp, Mus musculus
tcgacattttcttggggagcaagag

SEQ ID NO: 970955 - DNA, 25 bp, Mus musculus
tcgacatttttgctgtgggaagcca

SEQ ID NO: 970956 - DNA, 25 bp, Mus musculus
tcgacatttttggtgtgggaagcca

SEQ ID NO: 970957 - DNA, 25 bp, Mus musculus
tcgacccacaaacgagaatgtggaa

SEQ ID NO: 970958 - DNA, 25 bp, Mus musculus
tcgacccacaaaggagaatgtggaa

SEQ ID NO: 970959 - DNA, 25 bp, Mus musculus
tcgaccctggacgaactgctctcta

SEQ ID NO: 970960 - DNA, 25 bp, Mus musculus
tcgaccctggacgatctgctctcta

SEQ ID NO: 970961 - DNA, 25 bp, Mus musculus
tcgacctcacaacgtgactggacag

SEQ ID NO: 970962 - DNA, 25 bp, Mus musculus
tcgacctcacaactgcacgatctga

SEQ ID NO: 970963 - DNA, 25 bp, Mus musculus
tcgacctcacaaggtgactggacag

SEQ ID NO: 970964 - DNA, 25 bp, Mus musculus
tcgacctcacaagtgcacgatctga

SEQ ID NO: 970965 - DNA, 25 bp, Mus musculus
tcgacctgcttgcaatgatggaggt

SEQ ID NO: 970966 - DNA, 25 bp, Mus musculus
tcgacctgcttggaatgatggaggt

SEQ ID NO: 970967 - DNA, 25 bp, Mus musculus
tcgacgaactccaggatgtgtttgt

SEQ ID NO: 970968 - DNA, 25 bp, Mus musculus
tcgacgaactcctggatgtgtttgt

SEQ ID NO: 970969 - DNA, 25 bp, Mus musculus
tcgacgacagcgaacgaatggagct

SEQ ID NO: 970970 - DNA, 25 bp, Mus musculus
tcgacgacagggaacgaatggagct

SEQ ID NO: 970971 - DNA, 25 bp, Mus musculus
tcgacgacgcctcacgagctatgaa

SEQ ID NO: 970972 - DNA, 25 bp, Mus musculus
tcgacgacgcctcaggagctatgaa

SEQ ID NO: 970973 - DNA, 25 bp, Mus musculus
tcgacgggagctggcccaggcaaat

SEQ ID NO: 970974 - DNA, 25 bp, Mus musculus
tcgacgggaggtggcccaggcaaat

SEQ ID NO: 970975 - DNA, 25 bp, Mus musculus
tcgacgtgctggtacgcccacagaa

SEQ ID NO: 970976 - DNA, 25 bp, Mus musculus
tcgacgtgctggtaggcccacagaa

SEQ ID NO: 970977 - DNA, 25 bp, Mus musculus
tcgactactgcaaagcctacaagcc

SEQ ID NO: 970978 - DNA, 25 bp, Mus musculus
tcgactactggaaagcctacaagcc

SEQ ID NO: 970979 - DNA, 25 bp, Mus musculus
tcgactcaagcatggatcaacaatg

SEQ ID NO: 970980 - DNA, 25 bp, Mus musculus
tcgactcaaggatggatcaacaatg

SEQ ID NO: 970981 - DNA, 25 bp, Mus musculus
tcgactctccgacgattcgggttct

SEQ ID NO: 970982 - DNA, 25 bp, Mus musculus
tcgactctccgaggattcgggttct

SEQ ID NO: 970983 - DNA, 25 bp, Mus musculus
tcgactgcaataagatctatgaacg

SEQ ID NO: 970984 - DNA, 25 bp, Mus musculus
tcgactgcaatatgatctatgaacg

SEQ ID NO: 970985 - DNA, 25 bp, Mus musculus
tcgactgtccctcaagttgcctgca

SEQ ID NO: 970986 - DNA, 25 bp, Mus musculus
tcgactgtccctcaatggcacgctc

SEQ ID NO: 970987 - DNA, 25 bp, Mus musculus
tcgactgtccctcaatttcgaggac

SEQ ID NO: 970988 - DNA, 25 bp, Mus musculus
tcgactgtccctcatgttgcctgca

SEQ ID NO: 970989 - DNA, 25 bp, Mus musculus
tcgactgtccctcattggcacgctc

SEQ ID NO: 970990 - DNA, 25 bp, Mus musculus
tcgactgtccctcattttcgaggac

SEQ ID NO: 970991 - DNA, 25 bp, Mus musculus
tcgacttaagagacagtatcatgct

SEQ ID NO: 970992 - DNA, 25 bp, Mus musculus
tcgacttaagtgacagtatcatgct

SEQ ID NO: 970993 - DNA, 25 bp, Mus musculus
tcgacttagtcacgtgtcaaaagac

SEQ ID NO: 970994 - DNA, 25 bp, Mus musculus
tcgacttagtcaggtgtcaaaagac

SEQ ID NO: 970995 - DNA, 25 bp, Mus musculus
tcgacttagtgccgctgtgtggaga

SEQ ID NO: 970996 - DNA, 25 bp, Mus musculus
tcgacttagtgcggctgtgtggaga

SEQ ID NO: 970997 - DNA, 25 bp, Mus musculus
tcgacttcagcttctgtctaaaggg

SEQ ID NO: 970998 - DNA, 25 bp, Mus musculus
tcgacttcaggttctgtctaaaggg

SEQ ID NO: 970999 - DNA, 25 bp, Mus musculus
tcgagaaatgagacctctctgggag

SEQ ID NO: 971000 - DNA, 25 bp, Mus musculus
tcgagaaatgagtcctctctgggag

SEQ ID NO: 971001 - DNA, 25 bp, Mus musculus
tcgagaacatgaagatcttgcgtct

SEQ ID NO: 971002 - DNA, 25 bp, Mus musculus
tcgagaacatgatgatcttgcgtct

SEQ ID NO: 971003 - DNA, 25 bp, Mus musculus
tcgagaacctgacgtcattgctgca

SEQ ID NO: 971004 - DNA, 25 bp, Mus musculus
tcgagaacctgaggtcattgctgca

SEQ ID NO: 971005 - DNA, 25 bp, Mus musculus
tcgagaagccagcagaaactacaac

SEQ ID NO: 971006 - DNA, 25 bp, Mus musculus
tcgagaagccagctggtgaccatag

SEQ ID NO: 971007 - DNA, 25 bp, Mus musculus
tcgagaagccaggagaaactacaac

SEQ ID NO: 971008 - DNA, 25 bp, Mus musculus
tcgagaagccaggtggtgaccatag

SEQ ID NO: 971009 - DNA, 25 bp, Mus musculus
tcgagaagtcaaccatccaaaactc

SEQ ID NO: 971010 - DNA, 25 bp, Mus musculus
tcgagaagtctaccatccaaaactc

SEQ ID NO: 971011 - DNA, 25 bp, Mus musculus
tcgagaccctctaccactccctcct

SEQ ID NO: 971012 - DNA, 25 bp, Mus musculus
tcgagaccctgtaccactccctcct

SEQ ID NO: 971013 - DNA, 25 bp, Mus musculus
tcgagacgggccattgctcctgtgc

SEQ ID NO: 971014 - DNA, 25 bp, Mus musculus
tcgagacggggcattgctcctgtgc

SEQ ID NO: 971015 - DNA, 25 bp, Mus musculus
tcgagagaaaagcaggttggaaatc

SEQ ID NO: 971016 - DNA, 25 bp, Mus musculus
tcgagagaaaaggaggttggaaatc

SEQ ID NO: 971017 - DNA, 25 bp, Mus musculus
tcgagagaagatgacaatacttgcc

SEQ ID NO: 971018 - DNA, 25 bp, Mus musculus
tcgagagaagttgacaatacttgcc

SEQ ID NO: 971019 - DNA, 25 bp, Mus musculus
tcgagagccgactattcagtgtggc

SEQ ID NO: 971020 - DNA, 25 bp, Mus musculus
tcgagagccgtctattcagtgtggc

SEQ ID NO: 971021 - DNA, 25 bp, Mus musculus
tcgagagtgtccctacctacaaatg

SEQ ID NO: 971022 - DNA, 25 bp, Mus musculus
tcgagagtgtgcctacctacaaatg

SEQ ID NO: 971023 - DNA, 25 bp, Mus musculus
tcgagatccagaccaaacactggag

SEQ ID NO: 971024 - DNA, 25 bp, Mus musculus
tcgagatccagagcaaacactggag

SEQ ID NO: 971025 - DNA, 25 bp, Mus musculus
tcgagatgatcgaggttttgaatac

SEQ ID NO: 971026 - DNA, 25 bp, Mus musculus
tcgagatgatggaggttttgaatac

SEQ ID NO: 971027 - DNA, 25 bp, Mus musculus
tcgagcctaaagaacatcaaactga

SEQ ID NO: 971028 - DNA, 25 bp, Mus musculus
tcgagcctaaagtacatcaaactga

SEQ ID NO: 971029 - DNA, 25 bp, Mus musculus
tcgagcgtctcctacacaaagccac

SEQ ID NO: 971030 - DNA, 25 bp, Mus musculus
tcgagcgtctcctagacaaagccac

SEQ ID NO: 971031 - DNA, 25 bp, Mus musculus
tcgaggacagctgtccttttatcgg

SEQ ID NO: 971032 - DNA, 25 bp, Mus musculus
tcgaggacaggtgtccttttatcgg

SEQ ID NO: 971033 - DNA, 25 bp, Mus musculus
tcgaggacatggcgaatgtgttgaa

SEQ ID NO: 971034 - DNA, 25 bp, Mus musculus
tcgaggacatggggaatgtgttgaa

SEQ ID NO: 971035 - DNA, 25 bp, Mus musculus
tcgaggacccgccagatgctgagga

SEQ ID NO: 971036 - DNA, 25 bp, Mus musculus
tcgaggacccgcgagatgctgagga

SEQ ID NO: 971037 - DNA, 25 bp, Mus musculus
tcgaggacgccccacctggaagtcc

SEQ ID NO: 971038 - DNA, 25 bp, Mus musculus
tcgaggacgccccagctggaagtcc

SEQ ID NO: 971039 - DNA, 25 bp, Mus musculus
tcgaggcccgggcgctggatattga

SEQ ID NO: 971040 - DNA, 25 bp, Mus musculus
tcgaggcccgggggctggatattga

SEQ ID NO: 971041 - DNA, 25 bp, Mus musculus
tcgaggctaatgaggaagcattagg

SEQ ID NO: 971042 - DNA, 25 bp, Mus musculus
tcgaggctaatgaggtttctggctc

SEQ ID NO: 971043 - DNA, 25 bp, Mus musculus
tcgaggctaatgtggaagcattagg

SEQ ID NO: 971044 - DNA, 25 bp, Mus musculus
tcgaggctaatgtggtttctggctc

SEQ ID NO: 971045 - DNA, 25 bp, Mus musculus
tcgaggctatctcgggcgctgtccg

SEQ ID NO: 971046 - DNA, 25 bp, Mus musculus
tcgaggctatctggggcgctgtccg

SEQ ID NO: 971047 - DNA, 25 bp, Mus musculus
tcgaggtcttgcgtctgtgcagttg

SEQ ID NO: 971048 - DNA, 25 bp, Mus musculus
tcgaggtcttgcgtgtgtgcagttg

SEQ ID NO: 971049 - DNA, 25 bp, Mus musculus
tcgagtaccgcgcggctgagaagga

SEQ ID NO: 971050 - DNA, 25 bp, Mus musculus
tcgagtaccgcggggctgagaagga

SEQ ID NO: 971051 - DNA, 25 bp, Mus musculus
tcgagtagggcacgcaatggcatcc

SEQ ID NO: 971052 - DNA, 25 bp, Mus musculus
tcgagtagggcaggcaatggcatcc

SEQ ID NO: 971053 - DNA, 25 bp, Mus musculus
tcgagtcacaggcctgagggccagc

SEQ ID NO: 971054 - DNA, 25 bp, Mus musculus
tcgagtcacagggctgagggccagc

SEQ ID NO: 971055 - DNA, 25 bp, Mus musculus
tcgagtgaatcacgccatctggctg

SEQ ID NO: 971056 - DNA, 25 bp, Mus musculus
tcgagtgaatcaggccatctggctg

SEQ ID NO: 971057 - DNA, 25 bp, Mus musculus
tcgagtgtcaagactgtgatttacc

SEQ ID NO: 971058 - DNA, 25 bp, Mus musculus
tcgagtgtcaagtctgtgatttacc

SEQ ID NO: 971059 - DNA, 25 bp, Mus musculus
tcgagttaagcatctctatagtggg

SEQ ID NO: 971060 - DNA, 25 bp, Mus musculus
tcgagttaagcccacagctttttca

SEQ ID NO: 971061 - DNA, 25 bp, Mus musculus
tcgagttaaggatctctatagtggg

SEQ ID NO: 971062 - DNA, 25 bp, Mus musculus
tcgagttaaggccacagctttttca

SEQ ID NO: 971063 - DNA, 25 bp, Mus musculus
tcgagttctgggagcgcaatgtgct

SEQ ID NO: 971064 - DNA, 25 bp, Mus musculus
tcgagttctgggtgcgcaatgtgct

SEQ ID NO: 971065 - DNA, 25 bp, Mus musculus
tcgagtttgagtaagaggtgactgg

SEQ ID NO: 971066 - DNA, 25 bp, Mus musculus
tcgagtttgagttagaggtgactgg

SEQ ID NO: 971067 - DNA, 25 bp, Mus musculus
tcgataagggaagaccgcatagata

SEQ ID NO: 971068 - DNA, 25 bp, Mus musculus
tcgataagggaagagcgcatagata

SEQ ID NO: 971069 - DNA, 25 bp, Mus musculus
tcgatactcgatcctgcatgccaac

SEQ ID NO: 971070 - DNA, 25 bp, Mus musculus
tcgatactcgttcctgcatgccaac

SEQ ID NO: 971071 - DNA, 25 bp, Mus musculus
tcgatatcagctgtcctggagcctg

SEQ ID NO: 971072 - DNA, 25 bp, Mus musculus
tcgatatcaggtgtcctggagcctg

SEQ ID NO: 971073 - DNA, 25 bp, Mus musculus
tcgatcaactcaataaagccgttgt

SEQ ID NO: 971074 - DNA, 25 bp, Mus musculus
tcgatcaactcacccggctcaacat

SEQ ID NO: 971075 - DNA, 25 bp, Mus musculus
tcgatcaactcagccggctcaacat

SEQ ID NO: 971076 - DNA, 25 bp, Mus musculus
tcgatcaactcattaaagccgttgt

SEQ ID NO: 971077 - DNA, 25 bp, Mus musculus
tcgatcaatacacgtatactcgaaa

SEQ ID NO: 971078 - DNA, 25 bp, Mus musculus
tcgatcaatacaggtatactcgaaa

SEQ ID NO: 971079 - DNA, 25 bp, Mus musculus
tcgatgcaaaacccaggaggcacca

SEQ ID NO: 971080 - DNA, 25 bp, Mus musculus
tcgatgcaaatcccaggaggcacca

SEQ ID NO: 971081 - DNA, 25 bp, Mus musculus
tcgatggagatgcaatcctcaatga

SEQ ID NO: 971082 - DNA, 25 bp, Mus musculus
tcgatggagatggaatcctcaatga

SEQ ID NO: 971083 - DNA, 25 bp, Mus musculus
tcgatgggccaactgtaaccagctc

SEQ ID NO: 971084 - DNA, 25 bp, Mus musculus
tcgatgggccaagtgtaaccagctc

SEQ ID NO: 971085 - DNA, 25 bp, Mus musculus
tcgatggtagcccctgccgtgactt

SEQ ID NO: 971086 - DNA, 25 bp, Mus musculus
tcgatggtagcccgaagctgtgctg

SEQ ID NO: 971087 - DNA, 25 bp, Mus musculus
tcgatggtagccgctgccgtgactt

SEQ ID NO: 971088 - DNA, 25 bp, Mus musculus
tcgatggtagccggaagctgtgctg

SEQ ID NO: 971089 - DNA, 25 bp, Mus musculus
tcgatgtcgccaccgcccctccagc

SEQ ID NO: 971090 - DNA, 25 bp, Mus musculus
tcgatgtcgccagcgcccctccagc

SEQ ID NO: 971091 - DNA, 25 bp, Mus musculus
tcgatgtcgttgaacggtcaccaca

SEQ ID NO: 971092 - DNA, 25 bp, Mus musculus
tcgatgtcgttgtacggtcaccaca

SEQ ID NO: 971093 - DNA, 25 bp, Mus musculus
tcgatgtgcgagattgtgaagggaa

SEQ ID NO: 971094 - DNA, 25 bp, Mus musculus
tcgatgtgcgagcgaaggttgtgaa

SEQ ID NO: 971095 - DNA, 25 bp, Mus musculus
tcgatgtgcgagggaaggttgtgaa

SEQ ID NO: 971096 - DNA, 25 bp, Mus musculus
tcgatgtgcgagtttgtgaagggaa

SEQ ID NO: 971097 - DNA, 25 bp, Mus musculus
tcgattcaagcatcgcattgtatca

SEQ ID NO: 971098 - DNA, 25 bp, Mus musculus
tcgattcaaggatcgcattgtatca

SEQ ID NO: 971099 - DNA, 25 bp, Mus musculus
tcgcaaagacggaacgactggaaat

SEQ ID NO: 971100 - DNA, 25 bp, Mus musculus
tcgcaaagacggaaggactggaaat

SEQ ID NO: 971101 - DNA, 25 bp, Mus musculus
tcgcaacaggctagcagagatccac

SEQ ID NO: 971102 - DNA, 25 bp, Mus musculus
tcgcaacagggtagcagagatccac

SEQ ID NO: 971103 - DNA, 25 bp, Mus musculus
tcgcaacgaccacgtggtcacggac

SEQ ID NO: 971104 - DNA, 25 bp, Mus musculus
tcgcaacgaccaggtggtcacggac

SEQ ID NO: 971105 - DNA, 25 bp, Mus musculus
tcgcaagaacggcattaatctttct

SEQ ID NO: 971106 - DNA, 25 bp, Mus musculus
tcgcaagaacgggattaatctttct

SEQ ID NO: 971107 - DNA, 25 bp, Mus musculus
tcgcaagctgcctgaccagtgcaca

SEQ ID NO: 971108 - DNA, 25 bp, Mus musculus
tcgcaagctggctgaccagtgcaca

SEQ ID NO: 971109 - DNA, 25 bp, Mus musculus
tcgcacaagagaatcagctgatgtt

SEQ ID NO: 971110 - DNA, 25 bp, Mus musculus
tcgcacaagagaatgagctgatgtt

SEQ ID NO: 971111 - DNA, 25 bp, Mus musculus
tcgcacaagttagacgtgagggtgg

SEQ ID NO: 971112 - DNA, 25 bp, Mus musculus
tcgcacaagttagaggtgagggtgg

SEQ ID NO: 971113 - DNA, 25 bp, Mus musculus
tcgcacacggcctctgtgctcgaaa

SEQ ID NO: 971114 - DNA, 25 bp, Mus musculus
tcgcacacggcctggaggtgtgact

SEQ ID NO: 971115 - DNA, 25 bp, Mus musculus
tcgcacacgggctctgtgctcgaaa

SEQ ID NO: 971116 - DNA, 25 bp, Mus musculus
tcgcacacgggctggaggtgtgact

SEQ ID NO: 971117 - DNA, 25 bp, Mus musculus
tcgcacagcaactacgcatgaagca

SEQ ID NO: 971118 - DNA, 25 bp, Mus musculus
tcgcacagcaactaggcatgaagca

SEQ ID NO: 971119 - DNA, 25 bp, Mus musculus
tcgcaccatgcctgatcagctgact

SEQ ID NO: 971120 - DNA, 25 bp, Mus musculus
tcgcaccatggctgatcagctgact

SEQ ID NO: 971121 - DNA, 25 bp, Mus musculus
tcgcacctcaccccctccccgaagc

SEQ ID NO: 971122 - DNA, 25 bp, Mus musculus
tcgcacctcaccgcctccccgaagc

SEQ ID NO: 971123 - DNA, 25 bp, Mus musculus
tcgcactacgaatgtgacatcagtg

SEQ ID NO: 971124 - DNA, 25 bp, Mus musculus
tcgcactacgtatgtgacatcagtg

SEQ ID NO: 971125 - DNA, 25 bp, Mus musculus
tcgcactagatatcaaaatcgggtc

SEQ ID NO: 971126 - DNA, 25 bp, Mus musculus
tcgcactagatatcaatctgtggtt

SEQ ID NO: 971127 - DNA, 25 bp, Mus musculus
tcgcactagatatctaaatcgggtc

SEQ ID NO: 971128 - DNA, 25 bp, Mus musculus
tcgcactagatatctatctgtggtt

SEQ ID NO: 971129 - DNA, 25 bp, Mus musculus
tcgcactgccgggacatggctcagc

SEQ ID NO: 971130 - DNA, 25 bp, Mus musculus
tcgcactgccgggagatggctcagc

SEQ ID NO: 971131 - DNA, 25 bp, Mus musculus
tcgcagcagaaattcacaacagaca

SEQ ID NO: 971132 - DNA, 25 bp, Mus musculus
tcgcagcagaaattgacaacagaca

SEQ ID NO: 971133 - DNA, 25 bp, Mus musculus
tcgcagccaagaaactgggcacaga

SEQ ID NO: 971134 - DNA, 25 bp, Mus musculus
tcgcagccaagaaagtgggcacaga

SEQ ID NO: 971135 - DNA, 25 bp, Mus musculus
tcgcagcccaagaacaaccaagagc

SEQ ID NO: 971136 - DNA, 25 bp, Mus musculus
tcgcagcccaagaacacgcaaatcc

SEQ ID NO: 971137 - DNA, 25 bp, Mus musculus
tcgcagcccaagaagaaccaagagc

SEQ ID NO: 971138 - DNA, 25 bp, Mus musculus
tcgcagcccaagaagacgcaaatcc

SEQ ID NO: 971139 - DNA, 25 bp, Mus musculus
tcgcagccggccaagctgaggagcc

SEQ ID NO: 971140 - DNA, 25 bp, Mus musculus
tcgcagccgggcaagctgaggagcc

SEQ ID NO: 971141 - DNA, 25 bp, Mus musculus
tcgcagtgcttacagaacgatgtgg

SEQ ID NO: 971142 - DNA, 25 bp, Mus musculus
tcgcagtgcttacctcttctgtcgg

SEQ ID NO: 971143 - DNA, 25 bp, Mus musculus
tcgcagtgcttagagaacgatgtgg

SEQ ID NO: 971144 - DNA, 25 bp, Mus musculus
tcgcagtgcttagctcttctgtcgg

SEQ ID NO: 971145 - DNA, 25 bp, Mus musculus
tcgcagttcaagcagatgccagacc

SEQ ID NO: 971146 - DNA, 25 bp, Mus musculus
tcgcagttcaaggagatgccagacc

SEQ ID NO: 971147 - DNA, 25 bp, Mus musculus
tcgcatccatctcattgaccacagt

SEQ ID NO: 971148 - DNA, 25 bp, Mus musculus
tcgcatccatgtcattgaccacagt

SEQ ID NO: 971149 - DNA, 25 bp, Mus musculus
tcgcatttttcaataatgtatattt

SEQ ID NO: 971150 - DNA, 25 bp, Mus musculus
tcgcatttttcattaatgtatattt

SEQ ID NO: 971151 - DNA, 25 bp, Mus musculus
tcgccaaaaccaaggatacccagaa

SEQ ID NO: 971152 - DNA, 25 bp, Mus musculus
tcgccaaaacgaaggatacccagaa

SEQ ID NO: 971153 - DNA, 25 bp, Mus musculus
tcgccaacagcaatataactgctaa

SEQ ID NO: 971154 - DNA, 25 bp, Mus musculus
tcgccaacaggaatataactgctaa

SEQ ID NO: 971155 - DNA, 25 bp, Mus musculus
tcgccaactcagattcgatgtacat

SEQ ID NO: 971156 - DNA, 25 bp, Mus musculus
tcgccaactcagtttcgatgtacat

SEQ ID NO: 971157 - DNA, 25 bp, Mus musculus
tcgccaagagctcacctttgggatt

SEQ ID NO: 971158 - DNA, 25 bp, Mus musculus
tcgccaagagctcagctttgggatt

SEQ ID NO: 971159 - DNA, 25 bp, Mus musculus
tcgccaccacagcggaagaagtcaa

SEQ ID NO: 971160 - DNA, 25 bp, Mus musculus
tcgccaccacaggggaagaagtcaa

SEQ ID NO: 971161 - DNA, 25 bp, Mus musculus
tcgccacgtacctacaacaccacgc

SEQ ID NO: 971162 - DNA, 25 bp, Mus musculus
tcgccacgtacctagaacaccacgc

SEQ ID NO: 971163 - DNA, 25 bp, Mus musculus
tcgccaggtgcgcgaagattgtcga

SEQ ID NO: 971164 - DNA, 25 bp, Mus musculus
tcgccaggtgggcgaagattgtcga

SEQ ID NO: 971165 - DNA, 25 bp, Mus musculus
tcgccagtcacactatgcggtgaca

SEQ ID NO: 971166 - DNA, 25 bp, Mus musculus
tcgccagtcacagtatgcggtgaca

SEQ ID NO: 971167 - DNA, 25 bp, Mus musculus
tcgccagtgctgcaacagcaaacca

SEQ ID NO: 971168 - DNA, 25 bp, Mus musculus
tcgccagtgctggaacagcaaacca

SEQ ID NO: 971169 - DNA, 25 bp, Mus musculus
tcgccatctcctctcttgtccgaga

SEQ ID NO: 971170 - DNA, 25 bp, Mus musculus
tcgccatctcctgtcttgtccgaga

SEQ ID NO: 971171 - DNA, 25 bp, Mus musculus
tcgccatgttcacctacacattcca

SEQ ID NO: 971172 - DNA, 25 bp, Mus musculus
tcgccatgttcagctacacattcca

SEQ ID NO: 971173 - DNA, 25 bp, Mus musculus
tcgcccacagaccattggggctgct

SEQ ID NO: 971174 - DNA, 25 bp, Mus musculus
tcgcccacagacgattggggctgct

SEQ ID NO: 971175 - DNA, 25 bp, Mus musculus
tcgcccacagcacagtctgtgcgcc

SEQ ID NO: 971176 - DNA, 25 bp, Mus musculus
tcgcccacagcagagtctgtgcgcc

SEQ ID NO: 971177 - DNA, 25 bp, Mus musculus
tcgcccaggctgaaagtgagaatag

SEQ ID NO: 971178 - DNA, 25 bp, Mus musculus
tcgcccaggctgaatgtgagaatag

SEQ ID NO: 971179 - DNA, 25 bp, Mus musculus
tcgcccatctaaacatgccttgaac

SEQ ID NO: 971180 - DNA, 25 bp, Mus musculus
tcgcccatctaaacttgccttgaac

SEQ ID NO: 971181 - DNA, 25 bp, Mus musculus
tcgccccctgccaggtgatgctttt

SEQ ID NO: 971182 - DNA, 25 bp, Mus musculus
tcgccccctggcaggtgatgctttt

SEQ ID NO: 971183 - DNA, 25 bp, Mus musculus
tcgcccctgaagatggagagaagag

SEQ ID NO: 971184 - DNA, 25 bp, Mus musculus
tcgcccctgaagttggagagaagag

SEQ ID NO: 971185 - DNA, 25 bp, Mus musculus
tcgccctccagacgtgcctggagtt

SEQ ID NO: 971186 - DNA, 25 bp, Mus musculus
tcgccctccagaggtgcctggagtt

SEQ ID NO: 971187 - DNA, 25 bp, Mus musculus
tcgccctccctgagtcttggcatgg

SEQ ID NO: 971188 - DNA, 25 bp, Mus musculus
tcgccctccctgtgtcttggcatgg

SEQ ID NO: 971189 - DNA, 25 bp, Mus musculus
tcgccctcggcttccagcagaagac

SEQ ID NO: 971190 - DNA, 25 bp, Mus musculus
tcgccctcgggttccagcagaagac

SEQ ID NO: 971191 - DNA, 25 bp, Mus musculus
tcgccctctcaacctcagccttttc

SEQ ID NO: 971192 - DNA, 25 bp, Mus musculus
tcgccctctcaagctcagccttttc

SEQ ID NO: 971193 - DNA, 25 bp, Mus musculus
tcgccctggtggcgttggtggctgt

SEQ ID NO: 971194 - DNA, 25 bp, Mus musculus
tcgccctggtggctccaagtacagc

SEQ ID NO: 971195 - DNA, 25 bp, Mus musculus
tcgccctggtggggttggtggctgt

SEQ ID NO: 971196 - DNA, 25 bp, Mus musculus
tcgccctggtgggtccaagtacagc

SEQ ID NO: 971197 - DNA, 25 bp, Mus musculus
tcgccgacaggacctacgagaggtt

SEQ ID NO: 971198 - DNA, 25 bp, Mus musculus
tcgccgacaggacgcgacccagtgg

SEQ ID NO: 971199 - DNA, 25 bp, Mus musculus
tcgccgacaggagctacgagaggtt

SEQ ID NO: 971200 - DNA, 25 bp, Mus musculus
tcgccgacaggaggcgacccagtgg

SEQ ID NO: 971201 - DNA, 25 bp, Mus musculus
tcgccgatgatcttcgttttgagtt

SEQ ID NO: 971202 - DNA, 25 bp, Mus musculus
tcgccgatgatcttggttttgagtt

SEQ ID NO: 971203 - DNA, 25 bp, Mus musculus
tcgccgcaagagccttgagatgctc

SEQ ID NO: 971204 - DNA, 25 bp, Mus musculus
tcgccgcaagaggcttgagatgctc

SEQ ID NO: 971205 - DNA, 25 bp, Mus musculus
tcgccgccacagagttctgtccttg

SEQ ID NO: 971206 - DNA, 25 bp, Mus musculus
tcgccgccacagtgttctgtccttg

SEQ ID NO: 971207 - DNA, 25 bp, Mus musculus
tcgccgccatggagtcctccacctt

SEQ ID NO: 971208 - DNA, 25 bp, Mus musculus
tcgccgccatggtgtcctccacctt

SEQ ID NO: 971209 - DNA, 25 bp, Mus musculus
tcgccgccttcactcactgcaccgc

SEQ ID NO: 971210 - DNA, 25 bp, Mus musculus
tcgccgccttcagtcactgcaccgc

SEQ ID NO: 971211 - DNA, 25 bp, Mus musculus
tcgcctacgactcacatgtccctgg

SEQ ID NO: 971212 - DNA, 25 bp, Mus musculus
tcgcctacgactcagatgtccctgg

SEQ ID NO: 971213 - DNA, 25 bp, Mus musculus
tcgcctaggcagcaaatatgttatt

SEQ ID NO: 971214 - DNA, 25 bp, Mus musculus
tcgcctaggcaggaaatatgttatt

SEQ ID NO: 971215 - DNA, 25 bp, Mus musculus
tcgcctccagcacggccctggtcaa

SEQ ID NO: 971216 - DNA, 25 bp, Mus musculus
tcgcctccagcagggccctggtcaa

SEQ ID NO: 971217 - DNA, 25 bp, Mus musculus
tcgcctccagcccagcagcaacatg

SEQ ID NO: 971218 - DNA, 25 bp, Mus musculus
tcgcctccagcctatttaagagtgg

SEQ ID NO: 971219 - DNA, 25 bp, Mus musculus
tcgcctccaggccagcagcaacatg

SEQ ID NO: 971220 - DNA, 25 bp, Mus musculus
tcgcctccaggctatttaagagtgg

SEQ ID NO: 971221 - DNA, 25 bp, Mus musculus
tcgcctctcaagcatagacattagc

SEQ ID NO: 971222 - DNA, 25 bp, Mus musculus
tcgcctctcaaggatagacattagc

SEQ ID NO: 971223 - DNA, 25 bp, Mus musculus
tcgcctgatgattttttgggtcgga

SEQ ID NO: 971224 - DNA, 25 bp, Mus musculus
tcgcctgatgtttttttgggtcgga

SEQ ID NO: 971225 - DNA, 25 bp, Mus musculus
tcgcctgcagagaggaagacgactg

SEQ ID NO: 971226 - DNA, 25 bp, Mus musculus
tcgcctgcagcatactttggaacaa

SEQ ID NO: 971227 - DNA, 25 bp, Mus musculus
tcgcctgcagcgcatggaacaagat

SEQ ID NO: 971228 - DNA, 25 bp, Mus musculus
tcgcctgcagcgtgagttggtgaaa

SEQ ID NO: 971229 - DNA, 25 bp, Mus musculus
tcgcctgcagctgattttcgatata

SEQ ID NO: 971230 - DNA, 25 bp, Mus musculus
tcgcctgcagctgtctaagcactgg

SEQ ID NO: 971231 - DNA, 25 bp, Mus musculus
tcgcctgcaggatactttggaacaa

SEQ ID NO: 971232 - DNA, 25 bp, Mus musculus
tcgcctgcagggcatggaacaagat

SEQ ID NO: 971233 - DNA, 25 bp, Mus musculus
tcgcctgcagggtgagttggtgaaa

SEQ ID NO: 971234 - DNA, 25 bp, Mus musculus
tcgcctgcaggtgattttcgatata

SEQ ID NO: 971235 - DNA, 25 bp, Mus musculus
tcgcctgcaggtgtctaagcactgg

SEQ ID NO: 971236 - DNA, 25 bp, Mus musculus
tcgcctgcagtgaggaagacgactg

SEQ ID NO: 971237 - DNA, 25 bp, Mus musculus
tcgcctgttgaacgtttaccaggca

SEQ ID NO: 971238 - DNA, 25 bp, Mus musculus
tcgcctgttgaaggtttaccaggca

SEQ ID NO: 971239 - DNA, 25 bp, Mus musculus
tcgccttcaccacggatgactctgt

SEQ ID NO: 971240 - DNA, 25 bp, Mus musculus
tcgccttcaccagggatgactctgt

SEQ ID NO: 971241 - DNA, 25 bp, Mus musculus
tcgccttcagcacaggtgcagcagt

SEQ ID NO: 971242 - DNA, 25 bp, Mus musculus
tcgccttcagctgcagcagtgaaca

SEQ ID NO: 971243 - DNA, 25 bp, Mus musculus
tcgccttcagcttgcaggaacccaa

SEQ ID NO: 971244 - DNA, 25 bp, Mus musculus
tcgccttcaggacaggtgcagcagt

SEQ ID NO: 971245 - DNA, 25 bp, Mus musculus
tcgccttcaggtgcagcagtgaaca

SEQ ID NO: 971246 - DNA, 25 bp, Mus musculus
tcgccttcaggttgcaggaacccaa

SEQ ID NO: 971247 - DNA, 25 bp, Mus musculus
tcgccttccttcaggagaatattgg

SEQ ID NO: 971248 - DNA, 25 bp, Mus musculus
tcgccttccttctggagaatattgg

SEQ ID NO: 971249 - DNA, 25 bp, Mus musculus
tcgcgatatgctctgaaccacccgg

SEQ ID NO: 971250 - DNA, 25 bp, Mus musculus
tcgcgatatgctgtgaaccacccgg

SEQ ID NO: 971251 - DNA, 25 bp, Mus musculus
tcgcgattatcacaatccctctgcg

SEQ ID NO: 971252 - DNA, 25 bp, Mus musculus
tcgcgattatcacagtccagtagag

SEQ ID NO: 971253 - DNA, 25 bp, Mus musculus
tcgcgattatcagaatccctctgcg

SEQ ID NO: 971254 - DNA, 25 bp, Mus musculus
tcgcgattatcagagtccagtagag

SEQ ID NO: 971255 - DNA, 25 bp, Mus musculus
tcgcgcacagcattacatcttctac

SEQ ID NO: 971256 - DNA, 25 bp, Mus musculus
tcgcgcacagcccctaccgtggacc

SEQ ID NO: 971257 - DNA, 25 bp, Mus musculus
tcgcgcacaggattacatcttctac

SEQ ID NO: 971258 - DNA, 25 bp, Mus musculus
tcgcgcacaggccctaccgtggacc

SEQ ID NO: 971259 - DNA, 25 bp, Mus musculus
tcgcgccagcaagccgtggggcagg

SEQ ID NO: 971260 - DNA, 25 bp, Mus musculus
tcgcgccagcaagcggtggggcagg

SEQ ID NO: 971261 - DNA, 25 bp, Mus musculus
tcgcggagagcgctcccgtaggcct

SEQ ID NO: 971262 - DNA, 25 bp, Mus musculus
tcgcggagagcggtcccgtaggcct

SEQ ID NO: 971263 - DNA, 25 bp, Mus musculus
tcgcgggcttcacgtagaagccact

SEQ ID NO: 971264 - DNA, 25 bp, Mus musculus
tcgcgggcttcacgtgaggatccca

SEQ ID NO: 971265 - DNA, 25 bp, Mus musculus
tcgcgggcttcactgctggaggagg

SEQ ID NO: 971266 - DNA, 25 bp, Mus musculus
tcgcgggcttcaggtagaagccact

SEQ ID NO: 971267 - DNA, 25 bp, Mus musculus
tcgcgggcttcaggtgaggatccca

SEQ ID NO: 971268 - DNA, 25 bp, Mus musculus
tcgcgggcttcagtgctggaggagg

SEQ ID NO: 971269 - DNA, 25 bp, Mus musculus
tcgcggtcaatgctcagcaagatcc

SEQ ID NO: 971270 - DNA, 25 bp, Mus musculus
tcgcggtcaatggtcagcaagatcc

SEQ ID NO: 971271 - DNA, 25 bp, Mus musculus
tcgcgtcacgctcttgttgcagcat

SEQ ID NO: 971272 - DNA, 25 bp, Mus musculus
tcgcgtcacggtcttgttgcagcat

SEQ ID NO: 971273 - DNA, 25 bp, Mus musculus
tcgctatttgcaccaccacattaaa

SEQ ID NO: 971274 - DNA, 25 bp, Mus musculus
tcgctatttgcagcaccacattaaa

SEQ ID NO: 971275 - DNA, 25 bp, Mus musculus
tcgctcaaccagaacatggaggtgc

SEQ ID NO: 971276 - DNA, 25 bp, Mus musculus
tcgctcaaccagaagatggaggtgc

SEQ ID NO: 971277 - DNA, 25 bp, Mus musculus
tcgctcccgcctcgcgttgctgttc

SEQ ID NO: 971278 - DNA, 25 bp, Mus musculus
tcgctcccgcctcgggttgctgttc

SEQ ID NO: 971279 - DNA, 25 bp, Mus musculus
tcgctcggagatcgcttttgtggct

SEQ ID NO: 971280 - DNA, 25 bp, Mus musculus
tcgctcggagatcgtatacttgaag

SEQ ID NO: 971281 - DNA, 25 bp, Mus musculus
tcgctcggagatggcttttgtggct

SEQ ID NO: 971282 - DNA, 25 bp, Mus musculus
tcgctcggagatggtatacttgaag

SEQ ID NO: 971283 - DNA, 25 bp, Mus musculus
tcgctctggagccagctggtcatgc

SEQ ID NO: 971284 - DNA, 25 bp, Mus musculus
tcgctctggagcgagctggtcatgc

SEQ ID NO: 971285 - DNA, 25 bp, Mus musculus
tcgctgaaaaccttcgggatgtcca

SEQ ID NO: 971286 - DNA, 25 bp, Mus musculus
tcgctgaaaaccttggggatgtcca

SEQ ID NO: 971287 - DNA, 25 bp, Mus musculus
tcgctgacccagctcaaggagctgg

SEQ ID NO: 971288 - DNA, 25 bp, Mus musculus
tcgctgacccaggtcaaggagctgg

SEQ ID NO: 971289 - DNA, 25 bp, Mus musculus
tcgctgccagcggggcaacaatgcg

SEQ ID NO: 971290 - DNA, 25 bp, Mus musculus
tcgctgccaggggggcaacaatgcg

SEQ ID NO: 971291 - DNA, 25 bp, Mus musculus
tcgctgcggagacacgttgcagaat

SEQ ID NO: 971292 - DNA, 25 bp, Mus musculus
tcgctgcggagacaggttgcagaat

SEQ ID NO: 971293 - DNA, 25 bp, Mus musculus
tcgctgctatagccatgaaagaagt

SEQ ID NO: 971294 - DNA, 25 bp, Mus musculus
tcgctgctatagcctactattggaa

SEQ ID NO: 971295 - DNA, 25 bp, Mus musculus
tcgctgctataggcatgaaagaagt

SEQ ID NO: 971296 - DNA, 25 bp, Mus musculus
tcgctgctataggctactattggaa

SEQ ID NO: 971297 - DNA, 25 bp, Mus musculus
tcgctggacgtgctcgagcaacgac

SEQ ID NO: 971298 - DNA, 25 bp, Mus musculus
tcgctggacgtgctggagcaacgac

SEQ ID NO: 971299 - DNA, 25 bp, Mus musculus
tcgctggtttgccctccctccaaca

SEQ ID NO: 971300 - DNA, 25 bp, Mus musculus
tcgctggtttgcgctccctccaaca

SEQ ID NO: 971301 - DNA, 25 bp, Mus musculus
tcgctgtaaagacgcccttcctagg

SEQ ID NO: 971302 - DNA, 25 bp, Mus musculus
tcgctgtaaagaggcccttcctagg

SEQ ID NO: 971303 - DNA, 25 bp, Mus musculus
tcgctgtggcactgcgcctagcgac

SEQ ID NO: 971304 - DNA, 25 bp, Mus musculus
tcgctgtggcactgggcctagcgac

SEQ ID NO: 971305 - DNA, 25 bp, Mus musculus
tcgctgttactaaacgatgactatg

SEQ ID NO: 971306 - DNA, 25 bp, Mus musculus
tcgctgttactaaaggatgactatg

SEQ ID NO: 971307 - DNA, 25 bp, Mus musculus
tcgcttaccgataccgcaggtggaa

SEQ ID NO: 971308 - DNA, 25 bp, Mus musculus
tcgcttaccgctggaagcttggaga

SEQ ID NO: 971309 - DNA, 25 bp, Mus musculus
tcgcttaccggtggaagcttggaga

SEQ ID NO: 971310 - DNA, 25 bp, Mus musculus
tcgcttaccgttaccgcaggtggaa

SEQ ID NO: 971311 - DNA, 25 bp, Mus musculus
tcgcttcaggtgagccctttaccct

SEQ ID NO: 971312 - DNA, 25 bp, Mus musculus
tcgcttcaggtgaggcctttaccct

SEQ ID NO: 971313 - DNA, 25 bp, Mus musculus
tcgcttcctcaacctgagtcctgag

SEQ ID NO: 971314 - DNA, 25 bp, Mus musculus
tcgcttcctcaagctgagtcctgag

SEQ ID NO: 971315 - DNA, 25 bp, Mus musculus
tcgcttcgggactacctccccggga

SEQ ID NO: 971316 - DNA, 25 bp, Mus musculus
tcgcttcgggactagctccccggga

SEQ ID NO: 971317 - DNA, 25 bp, Mus musculus
tcgctttcaactctatggtcttggg

SEQ ID NO: 971318 - DNA, 25 bp, Mus musculus
tcgctttcaactgtatggtcttggg

SEQ ID NO: 971319 - DNA, 25 bp, Mus musculus
tcggaacaggcaaatgggaagacat

SEQ ID NO: 971320 - DNA, 25 bp, Mus musculus
tcggaacagggaaatgggaagacat

SEQ ID NO: 971321 - DNA, 25 bp, Mus musculus
tcggaacagttgattatttatgtga

SEQ ID NO: 971322 - DNA, 25 bp, Mus musculus
tcggaacagttgtttatttatgtga

SEQ ID NO: 971323 - DNA, 25 bp, Mus musculus
tcggaacgtgaacacgtggttggac

SEQ ID NO: 971324 - DNA, 25 bp, Mus musculus
tcggaacgtgaacaggtggttggac

SEQ ID NO: 971325 - DNA, 25 bp, Mus musculus
tcggaagcaccgaggaacaccaggg

SEQ ID NO: 971326 - DNA, 25 bp, Mus musculus
tcggaagcaccgtggaacaccaggg

SEQ ID NO: 971327 - DNA, 25 bp, Mus musculus
tcggaagcagagatggctatgaacg

SEQ ID NO: 971328 - DNA, 25 bp, Mus musculus
tcggaagcagagttggctatgaacg

SEQ ID NO: 971329 - DNA, 25 bp, Mus musculus
tcggaaggagctcactggccaatca

SEQ ID NO: 971330 - DNA, 25 bp, Mus musculus
tcggaaggagctgactggccaatca

SEQ ID NO: 971331 - DNA, 25 bp, Mus musculus
tcggaccatgcaaaaacatcgcccc

SEQ ID NO: 971332 - DNA, 25 bp, Mus musculus
tcggaccatgcaaatacatcgcccc

SEQ ID NO: 971333 - DNA, 25 bp, Mus musculus
tcggacccagccccaaaaggagcac

SEQ ID NO: 971334 - DNA, 25 bp, Mus musculus
tcggacccaggcccaaaaggagcac

SEQ ID NO: 971335 - DNA, 25 bp, Mus musculus
tcggacctggacataagggctaaat

SEQ ID NO: 971336 - DNA, 25 bp, Mus musculus
tcggacctggatgctaaaaggattc

SEQ ID NO: 971337 - DNA, 25 bp, Mus musculus
tcggacctggtcataagggctaaat

SEQ ID NO: 971338 - DNA, 25 bp, Mus musculus
tcggacctggttgctaaaaggattc

SEQ ID NO: 971339 - DNA, 25 bp, Mus musculus
tcggacgtagaacgcctctttgaca

SEQ ID NO: 971340 - DNA, 25 bp, Mus musculus
tcggacgtagaaggcctctttgaca

SEQ ID NO: 971341 - DNA, 25 bp, Mus musculus
tcggagaatgggcacgtggcactga

SEQ ID NO: 971342 - DNA, 25 bp, Mus musculus
tcggagaatgggcacttgttacagg

SEQ ID NO: 971343 - DNA, 25 bp, Mus musculus
tcggagaatgggcaggtggcactga

SEQ ID NO: 971344 - DNA, 25 bp, Mus musculus
tcggagaatgggcagttgttacagg

SEQ ID NO: 971345 - DNA, 25 bp, Mus musculus
tcggagaggtggaacaccatgtcta

SEQ ID NO: 971346 - DNA, 25 bp, Mus musculus
tcggagaggtggaagaccatgtcta

SEQ ID NO: 971347 - DNA, 25 bp, Mus musculus
tcggagagtgcaacagtggtcccca

SEQ ID NO: 971348 - DNA, 25 bp, Mus musculus
tcggagagtggaacagtggtcccca

SEQ ID NO: 971349 - DNA, 25 bp, Mus musculus
tcggagcagctgaaaagcttgaagt

SEQ ID NO: 971350 - DNA, 25 bp, Mus musculus
tcggagcagctgtaaagcttgaagt

SEQ ID NO: 971351 - DNA, 25 bp, Mus musculus
tcggagccgcagcagttgccccaga

SEQ ID NO: 971352 - DNA, 25 bp, Mus musculus
tcggagccgcaggagttgccccaga

SEQ ID NO: 971353 - DNA, 25 bp, Mus musculus
tcggagccttcacgacgatttattc

SEQ ID NO: 971354 - DNA, 25 bp, Mus musculus
tcggagccttcaggacgatttattc

SEQ ID NO: 971355 - DNA, 25 bp, Mus musculus
tcggagcgaccgcgtcatgtaggaa

SEQ ID NO: 971356 - DNA, 25 bp, Mus musculus
tcggagcgaccgggtcatgtaggaa

SEQ ID NO: 971357 - DNA, 25 bp, Mus musculus
tcggaggctccgaggaacactcggg

SEQ ID NO: 971358 - DNA, 25 bp, Mus musculus
tcggaggctccgtggaacactcggg

SEQ ID NO: 971359 - DNA, 25 bp, Mus musculus
tcggatccagcccctggggcttcat

SEQ ID NO: 971360 - DNA, 25 bp, Mus musculus
tcggatccaggccctggggcttcat

SEQ ID NO: 971361 - DNA, 25 bp, Mus musculus
tcggatcgcctgcacagaggaagac

SEQ ID NO: 971362 - DNA, 25 bp, Mus musculus
tcggatcgcctgcacggtgagttgg

SEQ ID NO: 971363 - DNA, 25 bp, Mus musculus
tcggatcgcctgcagagaggaagac

SEQ ID NO: 971364 - DNA, 25 bp, Mus musculus
tcggatcgcctgcagggtgagttgg

SEQ ID NO: 971365 - DNA, 25 bp, Mus musculus
tcggatctttcacggatactccttc

SEQ ID NO: 971366 - DNA, 25 bp, Mus musculus
tcggatctttcagggatactccttc

SEQ ID NO: 971367 - DNA, 25 bp, Mus musculus
tcggatgactgaaaactacttaaaa

SEQ ID NO: 971368 - DNA, 25 bp, Mus musculus
tcggatgactgaaatctacttaaaa

SEQ ID NO: 971369 - DNA, 25 bp, Mus musculus
tcggatggaaaaccacctggatgct

SEQ ID NO: 971370 - DNA, 25 bp, Mus musculus
tcggatggaaaagcacctggatgct

SEQ ID NO: 971371 - DNA, 25 bp, Mus musculus
tcggattaagatccttgccactgct

SEQ ID NO: 971372 - DNA, 25 bp, Mus musculus
tcggattaagttccttgccactgct

SEQ ID NO: 971373 - DNA, 25 bp, Mus musculus
tcggattctgaactcagacatgatg

SEQ ID NO: 971374 - DNA, 25 bp, Mus musculus
tcggattctgaagtcagacatgatg

SEQ ID NO: 971375 - DNA, 25 bp, Mus musculus
tcggattgcagccacgtatggtgtg

SEQ ID NO: 971376 - DNA, 25 bp, Mus musculus
tcggattgcagccaggtatggtgtg

SEQ ID NO: 971377 - DNA, 25 bp, Mus musculus
tcggcaaactcttattatcaactct

SEQ ID NO: 971378 - DNA, 25 bp, Mus musculus
tcggcaaactgttattatcaactct

SEQ ID NO: 971379 - DNA, 25 bp, Mus musculus
tcggcaaggggacactggccaatca

SEQ ID NO: 971380 - DNA, 25 bp, Mus musculus
tcggcaaggggagactggccaatca

SEQ ID NO: 971381 - DNA, 25 bp, Mus musculus
tcggcaatacagcccgcctggccat

SEQ ID NO: 971382 - DNA, 25 bp, Mus musculus
tcggcaatacaggccgcctggccat

SEQ ID NO: 971383 - DNA, 25 bp, Mus musculus
tcggcacaatcacagccttggctgt

SEQ ID NO: 971384 - DNA, 25 bp, Mus musculus
tcggcacaatcagagccttggctgt

SEQ ID NO: 971385 - DNA, 25 bp, Mus musculus
tcggcagaagagcaggctccgcccc

SEQ ID NO: 971386 - DNA, 25 bp, Mus musculus
tcggcagaagtgcaggctccgcccc

SEQ ID NO: 971387 - DNA, 25 bp, Mus musculus
tcggcagctcagctgcctggtcata

SEQ ID NO: 971388 - DNA, 25 bp, Mus musculus
tcggcagctcaggtgcctggtcata

SEQ ID NO: 971389 - DNA, 25 bp, Mus musculus
tcggcagtggcgcacgatggcgcag

SEQ ID NO: 971390 - DNA, 25 bp, Mus musculus
tcggcagtggcgcacttttactttc

SEQ ID NO: 971391 - DNA, 25 bp, Mus musculus
tcggcagtggcgcaggatggcgcag

SEQ ID NO: 971392 - DNA, 25 bp, Mus musculus
tcggcagtggcgcagttttactttc

SEQ ID NO: 971393 - DNA, 25 bp, Mus musculus
tcggcatcagaacggccggtttgtg

SEQ ID NO: 971394 - DNA, 25 bp, Mus musculus
tcggcatcagtacggccggtttgtg

SEQ ID NO: 971395 - DNA, 25 bp, Mus musculus
tcggcatggcgacgtatgttttgga

SEQ ID NO: 971396 - DNA, 25 bp, Mus musculus
tcggcatggcgaggtatgttttgga

SEQ ID NO: 971397 - DNA, 25 bp, Mus musculus
tcggcatgttcgagtggacaaatgt

SEQ ID NO: 971398 - DNA, 25 bp, Mus musculus
tcggcatgttcgtgtggacaaatgt

SEQ ID NO: 971399 - DNA, 25 bp, Mus musculus
tcggccaaccagcgtttctctgtcc

SEQ ID NO: 971400 - DNA, 25 bp, Mus musculus
tcggccaaccagggtttctctgtcc

SEQ ID NO: 971401 - DNA, 25 bp, Mus musculus
tcggccagagagcccggggcccgcc

SEQ ID NO: 971402 - DNA, 25 bp, Mus musculus
tcggccagagaggccggggcccgcc

SEQ ID NO: 971403 - DNA, 25 bp, Mus musculus
tcggccagagcattactcactgtgg

SEQ ID NO: 971404 - DNA, 25 bp, Mus musculus
tcggccagaggattactcactgtgg

SEQ ID NO: 971405 - DNA, 25 bp, Mus musculus
tcggccagccagctatgcactcaca

SEQ ID NO: 971406 - DNA, 25 bp, Mus musculus
tcggccagccaggtatgcactcaca

SEQ ID NO: 971407 - DNA, 25 bp, Mus musculus
tcggccagtgagaacggatattact

SEQ ID NO: 971408 - DNA, 25 bp, Mus musculus
tcggccagtgagaagggatattact

SEQ ID NO: 971409 - DNA, 25 bp, Mus musculus
tcggcccaaagacatgaagttggcg

SEQ ID NO: 971410 - DNA, 25 bp, Mus musculus
tcggcccaaagagatgaagttggcg

SEQ ID NO: 971411 - DNA, 25 bp, Mus musculus
tcggccccaacgatagtagcccagc

SEQ ID NO: 971412 - DNA, 25 bp, Mus musculus
tcggccccaacgattgtagcccagc

SEQ ID NO: 971413 - DNA, 25 bp, Mus musculus
tcggcccgggccagcagggcgggag

SEQ ID NO: 971414 - DNA, 25 bp, Mus musculus
tcggcccggggcagcagggcgggag

SEQ ID NO: 971415 - DNA, 25 bp, Mus musculus
tcggccctggcagacgtcgcatctc

SEQ ID NO: 971416 - DNA, 25 bp, Mus musculus
tcggccctggcagaggtcgcatctc

SEQ ID NO: 971417 - DNA, 25 bp, Mus musculus
tcggccgtttccaccgaagatgcta

SEQ ID NO: 971418 - DNA, 25 bp, Mus musculus
tcggccgtttccacggaagatgcta

SEQ ID NO: 971419 - DNA, 25 bp, Mus musculus
tcggcctcaaccccctgaagaatgc

SEQ ID NO: 971420 - DNA, 25 bp, Mus musculus
tcggcctcaagcccctgaagaatgc

SEQ ID NO: 971421 - DNA, 25 bp, Mus musculus
tcggcctcagctttgaagctggctc

SEQ ID NO: 971422 - DNA, 25 bp, Mus musculus
tcggcctcaggtttgaagctggctc

SEQ ID NO: 971423 - DNA, 25 bp, Mus musculus
tcggcctggcacatgccctggtgga

SEQ ID NO: 971424 - DNA, 25 bp, Mus musculus
tcggcctggcacttgccctggtgga

SEQ ID NO: 971425 - DNA, 25 bp, Mus musculus
tcggcgccgtgacattcgcgcagag

SEQ ID NO: 971426 - DNA, 25 bp, Mus musculus
tcggcgccgtgagattcgcgcagag

SEQ ID NO: 971427 - DNA, 25 bp, Mus musculus
tcggcggaacagctaattgctggct

SEQ ID NO: 971428 - DNA, 25 bp, Mus musculus
tcggcggaacaggtaattgctggct

SEQ ID NO: 971429 - DNA, 25 bp, Mus musculus
tcggcggacgcgctccgaggatctg

SEQ ID NO: 971430 - DNA, 25 bp, Mus musculus
tcggcggacgcgctgcgaggatctg

SEQ ID NO: 971431 - DNA, 25 bp, Mus musculus
tcggcggggacacatctcaagacca

SEQ ID NO: 971432 - DNA, 25 bp, Mus musculus
tcggcggggacagatctcaagacca

SEQ ID NO: 971433 - DNA, 25 bp, Mus musculus
tcggctcattgacgtgaatgggcag

SEQ ID NO: 971434 - DNA, 25 bp, Mus musculus
tcggctcattgaggtgaatgggcag

SEQ ID NO: 971435 - DNA, 25 bp, Mus musculus
tcggctccaaagtccgtttctgtat

SEQ ID NO: 971436 - DNA, 25 bp, Mus musculus
tcggctccaaagtcggtttctgtat

SEQ ID NO: 971437 - DNA, 25 bp, Mus musculus
tcggctccgcgggcagaggaaatat

SEQ ID NO: 971438 - DNA, 25 bp, Mus musculus
tcggctccgcgggctgaggaaatat

SEQ ID NO: 971439 - DNA, 25 bp, Mus musculus
tcggctgaaaagcttctccatggtg

SEQ ID NO: 971440 - DNA, 25 bp, Mus musculus
tcggctgaaaaggttctccatggtg

SEQ ID NO: 971441 - DNA, 25 bp, Mus musculus
tcggctgaaccacatgtcagtgcct

SEQ ID NO: 971442 - DNA, 25 bp, Mus musculus
tcggctgaaccagatgtcagtgcct

SEQ ID NO: 971443 - DNA, 25 bp, Mus musculus
tcggctgaggagcccaccatggcag

SEQ ID NO: 971444 - DNA, 25 bp, Mus musculus
tcggctgaggaggccaccatggcag

SEQ ID NO: 971445 - DNA, 25 bp, Mus musculus
tcggctgcagatcgcaacgagcgac

SEQ ID NO: 971446 - DNA, 25 bp, Mus musculus
tcggctgcagttcgcaacgagcgac

SEQ ID NO: 971447 - DNA, 25 bp, Mus musculus
tcggctgcccggccctgactaccag

SEQ ID NO: 971448 - DNA, 25 bp, Mus musculus
tcggctgcccgggcctgactaccag

SEQ ID NO: 971449 - DNA, 25 bp, Mus musculus
tcggctgcgtcaatctgacacagtg

SEQ ID NO: 971450 - DNA, 25 bp, Mus musculus
tcggctgcgtcaatgtgacacagtg

SEQ ID NO: 971451 - DNA, 25 bp, Mus musculus
tcggctgggaaacgttgcagactgg

SEQ ID NO: 971452 - DNA, 25 bp, Mus musculus
tcggctgggaaaggttgcagactgg

SEQ ID NO: 971453 - DNA, 25 bp, Mus musculus
tcggctgtcagacactatgaaatcc

SEQ ID NO: 971454 - DNA, 25 bp, Mus musculus
tcggctgtcagagactatgaaatcc

SEQ ID NO: 971455 - DNA, 25 bp, Mus musculus
tcggcttcagatatttatcaacaac

SEQ ID NO: 971456 - DNA, 25 bp, Mus musculus
tcggcttcagttatttatcaacaac

SEQ ID NO: 971457 - DNA, 25 bp, Mus musculus
tcggcttcctgacatgaagaaactg

SEQ ID NO: 971458 - DNA, 25 bp, Mus musculus
tcggcttcctgagatgaagaaactg

SEQ ID NO: 971459 - DNA, 25 bp, Mus musculus
tcggcttccttaagacagatgggag

SEQ ID NO: 971460 - DNA, 25 bp, Mus musculus
tcggcttccttatgacagatgggag

SEQ ID NO: 971461 - DNA, 25 bp, Mus musculus
tcggcttcggactatacctggagca

SEQ ID NO: 971462 - DNA, 25 bp, Mus musculus
tcggcttcggtctatacctggagca

SEQ ID NO: 971463 - DNA, 25 bp, Mus musculus
tcggctttgacacctgcaggtcctg

SEQ ID NO: 971464 - DNA, 25 bp, Mus musculus
tcggctttgacagctgcaggtcctg

SEQ ID NO: 971465 - DNA, 25 bp, Mus musculus
tcggctttgcaacgatggagtcaac

SEQ ID NO: 971466 - DNA, 25 bp, Mus musculus
tcggctttgcaaggatggagtcaac

SEQ ID NO: 971467 - DNA, 25 bp, Mus musculus
tcggctttgtaaagagctgtcggct

SEQ ID NO: 971468 - DNA, 25 bp, Mus musculus
tcggctttgttaagagctgtcggct

SEQ ID NO: 971469 - DNA, 25 bp, Mus musculus
tcgggaaccagaccctggtcaacga

SEQ ID NO: 971470 - DNA, 25 bp, Mus musculus
tcgggaaccagagcctggtcaacga

SEQ ID NO: 971471 - DNA, 25 bp, Mus musculus
tcgggaagagcgccaccaggagtac

SEQ ID NO: 971472 - DNA, 25 bp, Mus musculus
tcgggaagagggccaccaggagtac

SEQ ID NO: 971473 - DNA, 25 bp, Mus musculus
tcgggaagccccagcctgtgatggt

SEQ ID NO: 971474 - DNA, 25 bp, Mus musculus
tcgggaagcccctgcctgtgatggt

SEQ ID NO: 971475 - DNA, 25 bp, Mus musculus
tcgggacaggagccgtccagagatc

SEQ ID NO: 971476 - DNA, 25 bp, Mus musculus
tcgggacaggaggcgtccagagatc

SEQ ID NO: 971477 - DNA, 25 bp, Mus musculus
tcgggaccagcatgaggctgtagag

SEQ ID NO: 971478 - DNA, 25 bp, Mus musculus
tcgggaccaggatgaggctgtagag

SEQ ID NO: 971479 - DNA, 25 bp, Mus musculus
tcgggacgcactggatatggttatc

SEQ ID NO: 971480 - DNA, 25 bp, Mus musculus
tcgggacgcagtggatatggttatc

SEQ ID NO: 971481 - DNA, 25 bp, Mus musculus
tcgggactagctccccgggatgcgg

SEQ ID NO: 971482 - DNA, 25 bp, Mus musculus
tcgggactaggtccccgggatgcgg

SEQ ID NO: 971483 - DNA, 25 bp, Mus musculus
tcgggagaggtgaactgggatgcct

SEQ ID NO: 971484 - DNA, 25 bp, Mus musculus
tcgggagaggtgaagtgggatgcct

SEQ ID NO: 971485 - DNA, 25 bp, Mus musculus
tcgggagcagaacttccgcctgaag

SEQ ID NO: 971486 - DNA, 25 bp, Mus musculus
tcgggagcagaagttccgcctgaag

SEQ ID NO: 971487 - DNA, 25 bp, Mus musculus
tcgggagcagctgatatatcccctg

SEQ ID NO: 971488 - DNA, 25 bp, Mus musculus
tcgggagcaggtgatatatcccctg

SEQ ID NO: 971489 - DNA, 25 bp, Mus musculus
tcgggagcgggagaagtatgacaac

SEQ ID NO: 971490 - DNA, 25 bp, Mus musculus
tcgggagcgggagatgtatgacaac

SEQ ID NO: 971491 - DNA, 25 bp, Mus musculus
tcgggaggcagacgctggccttgaa

SEQ ID NO: 971492 - DNA, 25 bp, Mus musculus
tcgggaggcagaggctggccttgaa

SEQ ID NO: 971493 - DNA, 25 bp, Mus musculus
tcgggatgtcaacatggtgaagaaa

SEQ ID NO: 971494 - DNA, 25 bp, Mus musculus
tcgggatgtcaagatggtgaagaaa

SEQ ID NO: 971495 - DNA, 25 bp, Mus musculus
tcgggatgtgggcccaactcccatg

SEQ ID NO: 971496 - DNA, 25 bp, Mus musculus
tcgggatgtggggccaactcccatg

SEQ ID NO: 971497 - DNA, 25 bp, Mus musculus
tcgggcactgagcaccagttttgtg

SEQ ID NO: 971498 - DNA, 25 bp, Mus musculus
tcgggcactgtgcaccagttttgtg

SEQ ID NO: 971499 - DNA, 25 bp, Mus musculus
tcgggccaagctccagtacatgatg

SEQ ID NO: 971500 - DNA, 25 bp, Mus musculus
tcgggccaaggtccagtacatgatg

SEQ ID NO: 971501 - DNA, 25 bp, Mus musculus
tcgggcccagctctccagtctaacg

SEQ ID NO: 971502 - DNA, 25 bp, Mus musculus
tcgggcccaggtctccagtctaacg

SEQ ID NO: 971503 - DNA, 25 bp, Mus musculus
tcgggccgagagaccgtggcggact

SEQ ID NO: 971504 - DNA, 25 bp, Mus musculus
tcgggccgagtgaccgtggcggact

SEQ ID NO: 971505 - DNA, 25 bp, Mus musculus
tcgggcggcccacggcggcaccttg

SEQ ID NO: 971506 - DNA, 25 bp, Mus musculus
tcgggcggcccagggcggcaccttg

SEQ ID NO: 971507 - DNA, 25 bp, Mus musculus
tcgggctcagtgcatgagacccttt

SEQ ID NO: 971508 - DNA, 25 bp, Mus musculus
tcgggctcagtgcttgttgacctcc

SEQ ID NO: 971509 - DNA, 25 bp, Mus musculus
tcgggctcagtggatgagacccttt

SEQ ID NO: 971510 - DNA, 25 bp, Mus musculus
tcgggctcagtggttgttgacctcc

SEQ ID NO: 971511 - DNA, 25 bp, Mus musculus
tcgggctctgtacgttgtgaaccat

SEQ ID NO: 971512 - DNA, 25 bp, Mus musculus
tcgggctctgtaggttgtgaaccat

SEQ ID NO: 971513 - DNA, 25 bp, Mus musculus
tcgggctgccaactgcccttcacag

SEQ ID NO: 971514 - DNA, 25 bp, Mus musculus
tcgggctgccaagtgcccttcacag

SEQ ID NO: 971515 - DNA, 25 bp, Mus musculus
tcgggcttggagcgctttgggggct

SEQ ID NO: 971516 - DNA, 25 bp, Mus musculus
tcgggcttggagcggtttgggggct

SEQ ID NO: 971517 - DNA, 25 bp, Mus musculus
tcggggactggaaacatggagccag

SEQ ID NO: 971518 - DNA, 25 bp, Mus musculus
tcggggactggaaagatggagccag

SEQ ID NO: 971519 - DNA, 25 bp, Mus musculus
tcggggagaagagaccccttcgaga

SEQ ID NO: 971520 - DNA, 25 bp, Mus musculus
tcggggagaagagagcccttcgaga

SEQ ID NO: 971521 - DNA, 25 bp, Mus musculus
tcggggagagagagcggtggaagat

SEQ ID NO: 971522 - DNA, 25 bp, Mus musculus
tcggggagagagaggggtggaagat

SEQ ID NO: 971523 - DNA, 25 bp, Mus musculus
tcggggatcagccacattttggatt

SEQ ID NO: 971524 - DNA, 25 bp, Mus musculus
tcggggatcagccagattttggatt

SEQ ID NO: 971525 - DNA, 25 bp, Mus musculus
tcggggcagaagagattgtggatgg

SEQ ID NO: 971526 - DNA, 25 bp, Mus musculus
tcggggcagaagtgattgtggatgg

SEQ ID NO: 971527 - DNA, 25 bp, Mus musculus
tcggggctgacacatcaacttatga

SEQ ID NO: 971528 - DNA, 25 bp, Mus musculus
tcggggctgacagatcaacttatga

SEQ ID NO: 971529 - DNA, 25 bp, Mus musculus
tcgggggcacatcacacccctatgt

SEQ ID NO: 971530 - DNA, 25 bp, Mus musculus
tcgggggcacatcagacccctatgt

SEQ ID NO: 971531 - DNA, 25 bp, Mus musculus
tcgggggcccagaacgctgagaccg

SEQ ID NO: 971532 - DNA, 25 bp, Mus musculus
tcgggggcccagaaggctgagaccg

SEQ ID NO: 971533 - DNA, 25 bp, Mus musculus
tcggggtctgtgccaattctagctg

SEQ ID NO: 971534 - DNA, 25 bp, Mus musculus
tcggggtctgtggcaattctagctg

SEQ ID NO: 971535 - DNA, 25 bp, Mus musculus
tcggggtttgccagaagagaaggag

SEQ ID NO: 971536 - DNA, 25 bp, Mus musculus
tcggggtttgcctgaagagaaggag

SEQ ID NO: 971537 - DNA, 25 bp, Mus musculus
tcgggtcatggaaaaatgggcttag

SEQ ID NO: 971538 - DNA, 25 bp, Mus musculus
tcgggtcatggaaatatgggcttag

SEQ ID NO: 971539 - DNA, 25 bp, Mus musculus
tcgggtctgtggatcatgaccacaa

SEQ ID NO: 971540 - DNA, 25 bp, Mus musculus
tcgggtctgtggatgatgaccacaa

SEQ ID NO: 971541 - DNA, 25 bp, Mus musculus
tcgggtgcccagcatcgatccgtat

SEQ ID NO: 971542 - DNA, 25 bp, Mus musculus
tcgggtgcccaggatcgatccgtat

SEQ ID NO: 971543 - DNA, 25 bp, Mus musculus
tcgggtgtccctcacgtggcccctt

SEQ ID NO: 971544 - DNA, 25 bp, Mus musculus
tcgggtgtccctcactcgagccccg

SEQ ID NO: 971545 - DNA, 25 bp, Mus musculus
tcgggtgtccctcaggtggcccctt

SEQ ID NO: 971546 - DNA, 25 bp, Mus musculus
tcgggtgtccctcagtcgagccccg

SEQ ID NO: 971547 - DNA, 25 bp, Mus musculus
tcgggtgtgcataccggtcggttgt

SEQ ID NO: 971548 - DNA, 25 bp, Mus musculus
tcgggtgtgcatacgggtcggttgt

SEQ ID NO: 971549 - DNA, 25 bp, Mus musculus
tcgggttcttcacctcctggagaaa

SEQ ID NO: 971550 - DNA, 25 bp, Mus musculus
tcgggttcttcagctcctggagaaa

SEQ ID NO: 971551 - DNA, 25 bp, Mus musculus
tcgggttgagcctcgcctgtgcaat

SEQ ID NO: 971552 - DNA, 25 bp, Mus musculus
tcgggttgaggctcgcctgtgcaat

SEQ ID NO: 971553 - DNA, 25 bp, Mus musculus
tcgggtttagcctgccatatgttca

SEQ ID NO: 971554 - DNA, 25 bp, Mus musculus
tcgggtttaggctgccatatgttca

SEQ ID NO: 971555 - DNA, 25 bp, Mus musculus
tcggtcacagctatcatggctgggt

SEQ ID NO: 971556 - DNA, 25 bp, Mus musculus
tcggtcacaggtatcatggctgggt

SEQ ID NO: 971557 - DNA, 25 bp, Mus musculus
tcggtccagcagatcaaagaggaaa

SEQ ID NO: 971558 - DNA, 25 bp, Mus musculus
tcggtccagcagttcaaagaggaaa

SEQ ID NO: 971559 - DNA, 25 bp, Mus musculus
tcggtcccgaagcagctatgatgac

SEQ ID NO: 971560 - DNA, 25 bp, Mus musculus
tcggtcccgaagctatgatgaccat

SEQ ID NO: 971561 - DNA, 25 bp, Mus musculus
tcggtcccgaaggagctatgatgac

SEQ ID NO: 971562 - DNA, 25 bp, Mus musculus
tcggtcccgaaggtatgatgaccat

SEQ ID NO: 971563 - DNA, 25 bp, Mus musculus
tcggtctctgacagtcctcctacag

SEQ ID NO: 971564 - DNA, 25 bp, Mus musculus
tcggtctctgactgtcctcctacag

SEQ ID NO: 971565 - DNA, 25 bp, Mus musculus
tcggtcttcctatcaaacaagatta

SEQ ID NO: 971566 - DNA, 25 bp, Mus musculus
tcggtcttcctatctaacaagatta

SEQ ID NO: 971567 - DNA, 25 bp, Mus musculus
tcggtgatggaagcaacagaagaaa

SEQ ID NO: 971568 - DNA, 25 bp, Mus musculus
tcggtgatggcaacagaagaaaagg

SEQ ID NO: 971569 - DNA, 25 bp, Mus musculus
tcggtgatgggaacagaagaaaagg

SEQ ID NO: 971570 - DNA, 25 bp, Mus musculus
tcggtgatggtagcaacagaagaaa

SEQ ID NO: 971571 - DNA, 25 bp, Mus musculus
tcggtgcaagaaagctgtagtagaa

SEQ ID NO: 971572 - DNA, 25 bp, Mus musculus
tcggtgcaagcagaaagctgtagta

SEQ ID NO: 971573 - DNA, 25 bp, Mus musculus
tcggtgcaaggagaaagctgtagta

SEQ ID NO: 971574 - DNA, 25 bp, Mus musculus
tcggtgcaagtaagctgtagtagaa

SEQ ID NO: 971575 - DNA, 25 bp, Mus musculus
tcggtgctggtgcgggaagaactgt

SEQ ID NO: 971576 - DNA, 25 bp, Mus musculus
tcggtgctggtgggggaagaactgt

SEQ ID NO: 971577 - DNA, 25 bp, Mus musculus
tcggtggaagatctgttgagtttgg

SEQ ID NO: 971578 - DNA, 25 bp, Mus musculus
tcggtggaagttctgttgagtttgg

SEQ ID NO: 971579 - DNA, 25 bp, Mus musculus
tcggtggcgtagccctgggctgctt

SEQ ID NO: 971580 - DNA, 25 bp, Mus musculus
tcggtggcgtaggcctgggctgctt

SEQ ID NO: 971581 - DNA, 25 bp, Mus musculus
tcggtggctcagcaggtgggtttca

SEQ ID NO: 971582 - DNA, 25 bp, Mus musculus
tcggtggctcaggaggtgggtttca

SEQ ID NO: 971583 - DNA, 25 bp, Mus musculus
tcggtgggcaaacgcaagagaatat

SEQ ID NO: 971584 - DNA, 25 bp, Mus musculus
tcggtgggcaaaggcaagagaatat

SEQ ID NO: 971585 - DNA, 25 bp, Mus musculus
tcggtgtctcggccttctgggcctt

SEQ ID NO: 971586 - DNA, 25 bp, Mus musculus
tcggtgtctcgggcttctgggcctt

SEQ ID NO: 971587 - DNA, 25 bp, Mus musculus
tcggttacagacactgaccagagaa

SEQ ID NO: 971588 - DNA, 25 bp, Mus musculus
tcggttacagtcactgaccagagaa

SEQ ID NO: 971589 - DNA, 25 bp, Mus musculus
tcggttctggcgcgattcctctgcg

SEQ ID NO: 971590 - DNA, 25 bp, Mus musculus
tcggttctggcgctccggcactcag

SEQ ID NO: 971591 - DNA, 25 bp, Mus musculus
tcggttctggcgggattcctctgcg

SEQ ID NO: 971592 - DNA, 25 bp, Mus musculus
tcggttctggcggtccggcactcag

SEQ ID NO: 971593 - DNA, 25 bp, Mus musculus
tcggttgccatacacgtgtctagga

SEQ ID NO: 971594 - DNA, 25 bp, Mus musculus
tcggttgccatacaggtgtctagga

SEQ ID NO: 971595 - DNA, 25 bp, Mus musculus
tcggttgtgaagcgagtgagaaaaa

SEQ ID NO: 971596 - DNA, 25 bp, Mus musculus
tcggttgtgaagggagtgagaaaaa

SEQ ID NO: 971597 - DNA, 25 bp, Mus musculus
tcggtttatcatcacaccaagctgg

SEQ ID NO: 971598 - DNA, 25 bp, Mus musculus
tcggtttatcatgacaccaagctgg

SEQ ID NO: 971599 - DNA, 25 bp, Mus musculus
tcgtaaagaatgaacgaataacagc

SEQ ID NO: 971600 - DNA, 25 bp, Mus musculus
tcgtaaagaatgaaggaataacagc

SEQ ID NO: 971601 - DNA, 25 bp, Mus musculus
tcgtaaagagaagtataatgccgac

SEQ ID NO: 971602 - DNA, 25 bp, Mus musculus
tcgtaaagagaataatgccgactac

SEQ ID NO: 971603 - DNA, 25 bp, Mus musculus
tcgtaaagagtagtataatgccgac

SEQ ID NO: 971604 - DNA, 25 bp, Mus musculus
tcgtaaagagtataatgccgactac

SEQ ID NO: 971605 - DNA, 25 bp, Mus musculus
tcgtaacaataacctcatcaaacgg

SEQ ID NO: 971606 - DNA, 25 bp, Mus musculus
tcgtaacaataagctcatcaaacgg

SEQ ID NO: 971607 - DNA, 25 bp, Mus musculus
tcgtaatagggacgcgtctgcctga

SEQ ID NO: 971608 - DNA, 25 bp, Mus musculus
tcgtaatagggacgggtctgcctga

SEQ ID NO: 971609 - DNA, 25 bp, Mus musculus
tcgtacgacaaaccagacgtcatag

SEQ ID NO: 971610 - DNA, 25 bp, Mus musculus
tcgtacgacaaagcagacgtcatag

SEQ ID NO: 971611 - DNA, 25 bp, Mus musculus
tcgtactcagaaacgaaagctgcag

SEQ ID NO: 971612 - DNA, 25 bp, Mus musculus
tcgtactcagtaacgaaagctgcag

SEQ ID NO: 971613 - DNA, 25 bp, Mus musculus
tcgtagaagtggagattgaaggtga

SEQ ID NO: 971614 - DNA, 25 bp, Mus musculus
tcgtagaagtggtgattgaaggtga

SEQ ID NO: 971615 - DNA, 25 bp, Mus musculus
tcgtaggcagagggctcattggtcg

SEQ ID NO: 971616 - DNA, 25 bp, Mus musculus
tcgtaggcagtgggctcattggtcg

SEQ ID NO: 971617 - DNA, 25 bp, Mus musculus
tcgtcaaatcagagaagggaataca

SEQ ID NO: 971618 - DNA, 25 bp, Mus musculus
tcgtcaaatcagagtagggaataca

SEQ ID NO: 971619 - DNA, 25 bp, Mus musculus
tcgtcaacctaacccctgacaagtc

SEQ ID NO: 971620 - DNA, 25 bp, Mus musculus
tcgtcaacctaagccctgacaagtc

SEQ ID NO: 971621 - DNA, 25 bp, Mus musculus
tcgtcaagtactcgttgggtggtcc

SEQ ID NO: 971622 - DNA, 25 bp, Mus musculus
tcgtcaagtactcgtttacaggaac

SEQ ID NO: 971623 - DNA, 25 bp, Mus musculus
tcgtcaagtactggttgggtggtcc

SEQ ID NO: 971624 - DNA, 25 bp, Mus musculus
tcgtcaagtactggtttacaggaac

SEQ ID NO: 971625 - DNA, 25 bp, Mus musculus
tcgtcacagagaaccagaaaacagc

SEQ ID NO: 971626 - DNA, 25 bp, Mus musculus
tcgtcacagagaacgagaaaacagc

SEQ ID NO: 971627 - DNA, 25 bp, Mus musculus
tcgtcaccagaactataatcaagag

SEQ ID NO: 971628 - DNA, 25 bp, Mus musculus
tcgtcaccagtactataatcaagag

SEQ ID NO: 971629 - DNA, 25 bp, Mus musculus
tcgtcacccacaccaatgagaggta

SEQ ID NO: 971630 - DNA, 25 bp, Mus musculus
tcgtcacccacagcaatgagaggta

SEQ ID NO: 971631 - DNA, 25 bp, Mus musculus
tcgtcagaaaagccgagtcttcagt

SEQ ID NO: 971632 - DNA, 25 bp, Mus musculus
tcgtcagaaaaggcgagtcttcagt

SEQ ID NO: 971633 - DNA, 25 bp, Mus musculus
tcgtcagaagagaagacgccagcaa

SEQ ID NO: 971634 - DNA, 25 bp, Mus musculus
tcgtcagaagagcagtccaaaatcg

SEQ ID NO: 971635 - DNA, 25 bp, Mus musculus
tcgtcagaagaggagtccaaaatcg

SEQ ID NO: 971636 - DNA, 25 bp, Mus musculus
tcgtcagaagagtagacgccagcaa

SEQ ID NO: 971637 - DNA, 25 bp, Mus musculus
tcgtcatgaccaaacgcttggacac

SEQ ID NO: 971638 - DNA, 25 bp, Mus musculus
tcgtcatgaccaaaggcttggacac

SEQ ID NO: 971639 - DNA, 25 bp, Mus musculus
tcgtcatgagatcaaggacaccttc

SEQ ID NO: 971640 - DNA, 25 bp, Mus musculus
tcgtcatgagttcaaggacaccttc

SEQ ID NO: 971641 - DNA, 25 bp, Mus musculus
tcgtcattcttctgctcatcgttgt

SEQ ID NO: 971642 - DNA, 25 bp, Mus musculus
tcgtcattcttctggtcatcgttgt

SEQ ID NO: 971643 - DNA, 25 bp, Mus musculus
tcgtccaatatcatcgggggatatc

SEQ ID NO: 971644 - DNA, 25 bp, Mus musculus
tcgtccaatatcatggggggatatc

SEQ ID NO: 971645 - DNA, 25 bp, Mus musculus
tcgtccagccgtcacgtaaaaactg

SEQ ID NO: 971646 - DNA, 25 bp, Mus musculus
tcgtccagccgtcaggtaaaaactg

SEQ ID NO: 971647 - DNA, 25 bp, Mus musculus
tcgtccagtatacggagaagctggg

SEQ ID NO: 971648 - DNA, 25 bp, Mus musculus
tcgtccagtatagggagaagctggg

SEQ ID NO: 971649 - DNA, 25 bp, Mus musculus
tcgtccccggaccgagctgaagaag

SEQ ID NO: 971650 - DNA, 25 bp, Mus musculus
tcgtccccggacggagctgaagaag

SEQ ID NO: 971651 - DNA, 25 bp, Mus musculus
tcgtcccctcagcatcgccacgact

SEQ ID NO: 971652 - DNA, 25 bp, Mus musculus
tcgtcccctcaggatcgccacgact

SEQ ID NO: 971653 - DNA, 25 bp, Mus musculus
tcgtccctgcggcaccctgctggga

SEQ ID NO: 971654 - DNA, 25 bp, Mus musculus
tcgtccctgcgggaccctgctggga

SEQ ID NO: 971655 - DNA, 25 bp, Mus musculus
tcgtccgtggagcttgtcagagaat

SEQ ID NO: 971656 - DNA, 25 bp, Mus musculus
tcgtccgtggaggttgtcagagaat

SEQ ID NO: 971657 - DNA, 25 bp, Mus musculus
tcgtcctcatttatcatcccataaa

SEQ ID NO: 971658 - DNA, 25 bp, Mus musculus
tcgtcctcatttatgatcccataaa

SEQ ID NO: 971659 - DNA, 25 bp, Mus musculus
tcgtcctgcgctctttgagcgctgc

SEQ ID NO: 971660 - DNA, 25 bp, Mus musculus
tcgtcctgcgctgtttgagcgctgc

SEQ ID NO: 971661 - DNA, 25 bp, Mus musculus
tcgtcgcctgcacgatactttggaa

SEQ ID NO: 971662 - DNA, 25 bp, Mus musculus
tcgtcgcctgcacgtgattttcgat

SEQ ID NO: 971663 - DNA, 25 bp, Mus musculus
tcgtcgcctgcacgtgtctaagcac

SEQ ID NO: 971664 - DNA, 25 bp, Mus musculus
tcgtcgcctgcaggatactttggaa

SEQ ID NO: 971665 - DNA, 25 bp, Mus musculus
tcgtcgcctgcaggtgattttcgat

SEQ ID NO: 971666 - DNA, 25 bp, Mus musculus
tcgtcgcctgcaggtgtctaagcac

SEQ ID NO: 971667 - DNA, 25 bp, Mus musculus
tcgtcggcatcacaacggccggttt

SEQ ID NO: 971668 - DNA, 25 bp, Mus musculus
tcgtcggcatcagaacggccggttt

SEQ ID NO: 971669 - DNA, 25 bp, Mus musculus
tcgtcggctgaaaacgttctccatg

SEQ ID NO: 971670 - DNA, 25 bp, Mus musculus
tcgtcggctgaaaaggttctccatg

SEQ ID NO: 971671 - DNA, 25 bp, Mus musculus
tcgtcgtcagcttgacaaaagtaag

SEQ ID NO: 971672 - DNA, 25 bp, Mus musculus
tcgtcgtcaggttgacaaaagtaag

SEQ ID NO: 971673 - DNA, 25 bp, Mus musculus
tcgtcgtccgctccagaaatcttga

SEQ ID NO: 971674 - DNA, 25 bp, Mus musculus
tcgtcgtccggtccagaaatcttga

SEQ ID NO: 971675 - DNA, 25 bp, Mus musculus
tcgtcgtcgtcccctccagaaatct

SEQ ID NO: 971676 - DNA, 25 bp, Mus musculus
tcgtcgtcgtccgctccagaaatct

SEQ ID NO: 971677 - DNA, 25 bp, Mus musculus
tcgtctatctcaccggccctggaag

SEQ ID NO: 971678 - DNA, 25 bp, Mus musculus
tcgtctatctcagcggccctggaag

SEQ ID NO: 971679 - DNA, 25 bp, Mus musculus
tcgtctccaagaatcgtcctggcac

SEQ ID NO: 971680 - DNA, 25 bp, Mus musculus
tcgtctccaagaatggtcctggcac

SEQ ID NO: 971681 - DNA, 25 bp, Mus musculus
tcgtctgcaagactgtgttctcttg

SEQ ID NO: 971682 - DNA, 25 bp, Mus musculus
tcgtctgcaagagtgtgttctcttg

SEQ ID NO: 971683 - DNA, 25 bp, Mus musculus
tcgtctggaatacggaaaaccgagc

SEQ ID NO: 971684 - DNA, 25 bp, Mus musculus
tcgtctggaatagggaaaaccgagc

SEQ ID NO: 971685 - DNA, 25 bp, Mus musculus
tcgtctgtcctgagtgaaactggtt

SEQ ID NO: 971686 - DNA, 25 bp, Mus musculus
tcgtctgtcctgtgtgaaactggtt

SEQ ID NO: 971687 - DNA, 25 bp, Mus musculus
tcgtcttgcctgcaaggaagcggtg

SEQ ID NO: 971688 - DNA, 25 bp, Mus musculus
tcgtcttgcctgcatggaagcggtg

SEQ ID NO: 971689 - DNA, 25 bp, Mus musculus
tcgtgaaaaacaatcggttgatcag

SEQ ID NO: 971690 - DNA, 25 bp, Mus musculus
tcgtgaaaaacaatgggttgatcag

SEQ ID NO: 971691 - DNA, 25 bp, Mus musculus
tcgtgaatcctcttcgttcagacaa

SEQ ID NO: 971692 - DNA, 25 bp, Mus musculus
tcgtgaatcctcttggttcagacaa

SEQ ID NO: 971693 - DNA, 25 bp, Mus musculus
tcgtgagccattagactaggaccca

SEQ ID NO: 971694 - DNA, 25 bp, Mus musculus
tcgtgagccatttgactaggaccca

SEQ ID NO: 971695 - DNA, 25 bp, Mus musculus
tcgtgagtaaacaacaattcctcag

SEQ ID NO: 971696 - DNA, 25 bp, Mus musculus
tcgtgagtaaacaagaattcctcag

SEQ ID NO: 971697 - DNA, 25 bp, Mus musculus
tcgtgatgggcttttggccagacgt

SEQ ID NO: 971698 - DNA, 25 bp, Mus musculus
tcgtgatggggttttggccagacgt

SEQ ID NO: 971699 - DNA, 25 bp, Mus musculus
tcgtgatttccactccctgcagggc

SEQ ID NO: 971700 - DNA, 25 bp, Mus musculus
tcgtgatttccagtccctgcagggc

SEQ ID NO: 971701 - DNA, 25 bp, Mus musculus
tcgtgcatgcagatggatgatgtaa

SEQ ID NO: 971702 - DNA, 25 bp, Mus musculus
tcgtgcatgcagttggatgatgtaa

SEQ ID NO: 971703 - DNA, 25 bp, Mus musculus
tcgtgcctctcatgcgggttggggt

SEQ ID NO: 971704 - DNA, 25 bp, Mus musculus
tcgtgcctctcatgggggttggggt

SEQ ID NO: 971705 - DNA, 25 bp, Mus musculus
tcgtgcgtggacctgaacgagtgca

SEQ ID NO: 971706 - DNA, 25 bp, Mus musculus
tcgtgcgtggtcctgaacgagtgca

SEQ ID NO: 971707 - DNA, 25 bp, Mus musculus
tcgtggaacagatgcgttgcaaaca

SEQ ID NO: 971708 - DNA, 25 bp, Mus musculus
tcgtggaacagatgggttgcaaaca

SEQ ID NO: 971709 - DNA, 25 bp, Mus musculus
tcgtggacttgtcgggccccctggc

SEQ ID NO: 971710 - DNA, 25 bp, Mus musculus
tcgtggacttgtggggccccctggc

SEQ ID NO: 971711 - DNA, 25 bp, Mus musculus
tcgtggaggatgggcattgcaaaca

SEQ ID NO: 971712 - DNA, 25 bp, Mus musculus
tcgtggaggatggggattgcaaaca

SEQ ID NO: 971713 - DNA, 25 bp, Mus musculus
tcgtggatttccaggcagtagaggc

SEQ ID NO: 971714 - DNA, 25 bp, Mus musculus
tcgtggatttccaggccgtggtatt

SEQ ID NO: 971715 - DNA, 25 bp, Mus musculus
tcgtggatttcctggcagtagaggc

SEQ ID NO: 971716 - DNA, 25 bp, Mus musculus
tcgtggatttcctggccgtggtatt

SEQ ID NO: 971717 - DNA, 25 bp, Mus musculus
tcgtggcagcagatacgtgtgagga

SEQ ID NO: 971718 - DNA, 25 bp, Mus musculus
tcgtggcagcagttacgtgtgagga

SEQ ID NO: 971719 - DNA, 25 bp, Mus musculus
tcgtggctagaactcatccactggg

SEQ ID NO: 971720 - DNA, 25 bp, Mus musculus
tcgtggctagaactgatccactggg

SEQ ID NO: 971721 - DNA, 25 bp, Mus musculus
tcgtggctggatcccgtggacacac

SEQ ID NO: 971722 - DNA, 25 bp, Mus musculus
tcgtggctggatccctaccccaagt

SEQ ID NO: 971723 - DNA, 25 bp, Mus musculus
tcgtggctggatccctattcttgtt

SEQ ID NO: 971724 - DNA, 25 bp, Mus musculus
tcgtggctggatccggtggacacac

SEQ ID NO: 971725 - DNA, 25 bp, Mus musculus
tcgtggctggatccgtaccccaagt

SEQ ID NO: 971726 - DNA, 25 bp, Mus musculus
tcgtggctggatccgtattcttgtt

SEQ ID NO: 971727 - DNA, 25 bp, Mus musculus
tcgtgggagcagcttccttcggagt

SEQ ID NO: 971728 - DNA, 25 bp, Mus musculus
tcgtgggagcaggttccttcggagt

SEQ ID NO: 971729 - DNA, 25 bp, Mus musculus
tcgtgggcgccccgcgcagcaagca

SEQ ID NO: 971730 - DNA, 25 bp, Mus musculus
tcgtgggcgcccggcgcagcaagca

SEQ ID NO: 971731 - DNA, 25 bp, Mus musculus
tcgtggtcactgccgccaatagcgg

SEQ ID NO: 971732 - DNA, 25 bp, Mus musculus
tcgtggtcactggcgccaatagcgg

SEQ ID NO: 971733 - DNA, 25 bp, Mus musculus
tcgtggtttactcttctcttactgt

SEQ ID NO: 971734 - DNA, 25 bp, Mus musculus
tcgtggtttactgttctcttactgt

SEQ ID NO: 971735 - DNA, 25 bp, Mus musculus
tcgtgtacagcgtgaagttgattcc

SEQ ID NO: 971736 - DNA, 25 bp, Mus musculus
tcgtgtacagggtgaagttgattcc

SEQ ID NO: 971737 - DNA, 25 bp, Mus musculus
tcgtgtccggccctccaacccacaa

SEQ ID NO: 971738 - DNA, 25 bp, Mus musculus
tcgtgtccgggcctccaacccacaa

SEQ ID NO: 971739 - DNA, 25 bp, Mus musculus
tcgtgtgcagccagtcaggggagac

SEQ ID NO: 971740 - DNA, 25 bp, Mus musculus
tcgtgtgcaggcagtcaggggagac

SEQ ID NO: 971741 - DNA, 25 bp, Mus musculus
tcgtgtgcctgagccgaggactggc

SEQ ID NO: 971742 - DNA, 25 bp, Mus musculus
tcgtgtgcctgagccggctagctgt

SEQ ID NO: 971743 - DNA, 25 bp, Mus musculus
tcgtgtgcctgagcggaggactggc

SEQ ID NO: 971744 - DNA, 25 bp, Mus musculus
tcgtgtgcctgagcgggctagctgt

SEQ ID NO: 971745 - DNA, 25 bp, Mus musculus
tcgtgtgcggagcacgatctgattt

SEQ ID NO: 971746 - DNA, 25 bp, Mus musculus
tcgtgtgcggattcctttgtttctt

SEQ ID NO: 971747 - DNA, 25 bp, Mus musculus
tcgtgtgcggccatttcagggaaga

SEQ ID NO: 971748 - DNA, 25 bp, Mus musculus
tcgtgtgcgggcatttcagggaaga

SEQ ID NO: 971749 - DNA, 25 bp, Mus musculus
tcgtgtgcggtgcacgatctgattt

SEQ ID NO: 971750 - DNA, 25 bp, Mus musculus
tcgtgtgcggtttcctttgtttctt

SEQ ID NO: 971751 - DNA, 25 bp, Mus musculus
tcgtgtgtctcgctaacatttgccg

SEQ ID NO: 971752 - DNA, 25 bp, Mus musculus
tcgtgtgtctcggtaacatttgccg

SEQ ID NO: 971753 - DNA, 25 bp, Mus musculus
tcgtgttaaacccatcttcggagga

SEQ ID NO: 971754 - DNA, 25 bp, Mus musculus
tcgtgttaaaccgatcttcggagga

SEQ ID NO: 971755 - DNA, 25 bp, Mus musculus
tcgttaatcagcaacatggaagccc

SEQ ID NO: 971756 - DNA, 25 bp, Mus musculus
tcgttaatcagcaagatggaagccc

SEQ ID NO: 971757 - DNA, 25 bp, Mus musculus
tcgttaggatcgcaccagagtatat

SEQ ID NO: 971758 - DNA, 25 bp, Mus musculus
tcgttaggatcggaccagagtatat

SEQ ID NO: 971759 - DNA, 25 bp, Mus musculus
tcgttcaaccgggacaggtctgctc

SEQ ID NO: 971760 - DNA, 25 bp, Mus musculus
tcgttcaaccgggaccaggaggaca

SEQ ID NO: 971761 - DNA, 25 bp, Mus musculus
tcgttcaaccgggaccattctcaga

SEQ ID NO: 971762 - DNA, 25 bp, Mus musculus
tcgttcaaccgggagaggtctgctc

SEQ ID NO: 971763 - DNA, 25 bp, Mus musculus
tcgttcaaccgggagcaggaggaca

SEQ ID NO: 971764 - DNA, 25 bp, Mus musculus
tcgttcaaccgggagcattctcaga

SEQ ID NO: 971765 - DNA, 25 bp, Mus musculus
tcgttcactccaatgatggcactca

SEQ ID NO: 971766 - DNA, 25 bp, Mus musculus
tcgttcactccattgatggcactca

SEQ ID NO: 971767 - DNA, 25 bp, Mus musculus
tcgttcctcaagatggccgactctg

SEQ ID NO: 971768 - DNA, 25 bp, Mus musculus
tcgttcctcaagttggccgactctg

SEQ ID NO: 971769 - DNA, 25 bp, Mus musculus
tcgttcgagctacgcatggtggtga

SEQ ID NO: 971770 - DNA, 25 bp, Mus musculus
tcgttcgagctaggcatggtggtga

SEQ ID NO: 971771 - DNA, 25 bp, Mus musculus
tcgttctacagaagaccattgacta

SEQ ID NO: 971772 - DNA, 25 bp, Mus musculus
tcgttctacagaagtccattgacta

SEQ ID NO: 971773 - DNA, 25 bp, Mus musculus
tcgttctcacctttcgtattgtcct

SEQ ID NO: 971774 - DNA, 25 bp, Mus musculus
tcgttctcacctttggtattgtcct

SEQ ID NO: 971775 - DNA, 25 bp, Mus musculus
tcgttctcgggcaacgacttagcat

SEQ ID NO: 971776 - DNA, 25 bp, Mus musculus
tcgttctcgggcaaggacttagcat

SEQ ID NO: 971777 - DNA, 25 bp, Mus musculus
tcgttctgaccacagccaaaagaat

SEQ ID NO: 971778 - DNA, 25 bp, Mus musculus
tcgttctgaccagagccaaaagaat

SEQ ID NO: 971779 - DNA, 25 bp, Mus musculus
tcgttctgattgaaccctgctgcaa

SEQ ID NO: 971780 - DNA, 25 bp, Mus musculus
tcgttctgattgaagcctgctgcaa

SEQ ID NO: 971781 - DNA, 25 bp, Mus musculus
tcgttcttccagccaaggacccctg

SEQ ID NO: 971782 - DNA, 25 bp, Mus musculus
tcgttcttccaggcaaggacccctg

SEQ ID NO: 971783 - DNA, 25 bp, Mus musculus
tcgttgacagatatgacgtggtgtt

SEQ ID NO: 971784 - DNA, 25 bp, Mus musculus
tcgttgacagttatgacgtggtgtt

SEQ ID NO: 971785 - DNA, 25 bp, Mus musculus
tcgttgcccagaacctgtgggccga

SEQ ID NO: 971786 - DNA, 25 bp, Mus musculus
tcgttgcccagatcctgtgggccga

SEQ ID NO: 971787 - DNA, 25 bp, Mus musculus
tcgttttataagagagcagtatttc

SEQ ID NO: 971788 - DNA, 25 bp, Mus musculus
tcgttttataagtgagcagtatttc

SEQ ID NO: 971789 - DNA, 25 bp, Mus musculus
tcgttttcacagcggccgatcaaca

SEQ ID NO: 971790 - DNA, 25 bp, Mus musculus
tcgttttcacaggggccgatcaaca

SEQ ID NO: 971791 - DNA, 25 bp, Mus musculus
tcgttttccctctacttgtgagcgg

SEQ ID NO: 971792 - DNA, 25 bp, Mus musculus
tcgttttccctctagttgtgagcgg

SEQ ID NO: 971793 - DNA, 25 bp, Mus musculus
tctaaaaaccacttctgaaactgct

SEQ ID NO: 971794 - DNA, 25 bp, Mus musculus
tctaaaaacctcttctgaaactgct

SEQ ID NO: 971795 - DNA, 25 bp, Mus musculus
tctaaaaactcaagatgtggagtac

SEQ ID NO: 971796 - DNA, 25 bp, Mus musculus
tctaaaaactcatgatgtggagtac

SEQ ID NO: 971797 - DNA, 25 bp, Mus musculus
tctaaaacagagcctccccactatc

SEQ ID NO: 971798 - DNA, 25 bp, Mus musculus
tctaaaacagtgcctccccactatc

SEQ ID NO: 971799 - DNA, 25 bp, Mus musculus
tctaaacaagacgggccgcattgac

SEQ ID NO: 971800 - DNA, 25 bp, Mus musculus
tctaaacaagtcgggccgcattgac

SEQ ID NO: 971801 - DNA, 25 bp, Mus musculus
tctaaacaatcaccccaggagttaa

SEQ ID NO: 971802 - DNA, 25 bp, Mus musculus
tctaaacaatcagcccaggagttaa

SEQ ID NO: 971803 - DNA, 25 bp, Mus musculus
tctaaagagaagaccaacttctccc

SEQ ID NO: 971804 - DNA, 25 bp, Mus musculus
tctaaagagaagtccaacttctccc

SEQ ID NO: 971805 - DNA, 25 bp, Mus musculus
tctaaagggctcacattcatctatg

SEQ ID NO: 971806 - DNA, 25 bp, Mus musculus
tctaaagggctctcattcatctatg

SEQ ID NO: 971807 - DNA, 25 bp, Mus musculus
tctaaatgataacaatggcacacga

SEQ ID NO: 971808 - DNA, 25 bp, Mus musculus
tctaaatgataacgaacatgacatt

SEQ ID NO: 971809 - DNA, 25 bp, Mus musculus
tctaaatgataagaatggcacacga

SEQ ID NO: 971810 - DNA, 25 bp, Mus musculus
tctaaatgataaggaacatgacatt

SEQ ID NO: 971811 - DNA, 25 bp, Mus musculus
tctaacactgctgaatatgtaatca

SEQ ID NO: 971812 - DNA, 25 bp, Mus musculus
tctaacactggtgaatatgtaatca

SEQ ID NO: 971813 - DNA, 25 bp, Mus musculus
tctaacagagctaccttaatggagc

SEQ ID NO: 971814 - DNA, 25 bp, Mus musculus
tctaacagaggtaccttaatggagc

SEQ ID NO: 971815 - DNA, 25 bp, Mus musculus
tctaacatcacacattgctgaaaga

SEQ ID NO: 971816 - DNA, 25 bp, Mus musculus
tctaacatcacagattgctgaaaga

SEQ ID NO: 971817 - DNA, 25 bp, Mus musculus
tctaaccagcagatagtctacatgg

SEQ ID NO: 971818 - DNA, 25 bp, Mus musculus
tctaaccagctccacttgagcagcg

SEQ ID NO: 971819 - DNA, 25 bp, Mus musculus
tctaaccagctcgacttgagcagcg

SEQ ID NO: 971820 - DNA, 25 bp, Mus musculus
tctaaccagctgatagtctacatgg

SEQ ID NO: 971821 - DNA, 25 bp, Mus musculus
tctaacctgcatcccagcctatgac

SEQ ID NO: 971822 - DNA, 25 bp, Mus musculus
tctaacctgcatgccagcctatgac

SEQ ID NO: 971823 - DNA, 25 bp, Mus musculus
tctaacctggagaatgccctggact

SEQ ID NO: 971824 - DNA, 25 bp, Mus musculus
tctaacctggagtatgccctggact

SEQ ID NO: 971825 - DNA, 25 bp, Mus musculus
tctaactttaagcacatgtactgga

SEQ ID NO: 971826 - DNA, 25 bp, Mus musculus
tctaactttaaggacatgtactgga

SEQ ID NO: 971827 - DNA, 25 bp, Mus musculus
tctaagaaagcttgtgatcagctgt

SEQ ID NO: 971828 - DNA, 25 bp, Mus musculus
tctaagaaaggttgtgatcagctgt

SEQ ID NO: 971829 - DNA, 25 bp, Mus musculus
tctaagaagatgatctatttccagc

SEQ ID NO: 971830 - DNA, 25 bp, Mus musculus
tctaagaagatgttctatttccagc

SEQ ID NO: 971831 - DNA, 25 bp, Mus musculus
tctaagagctggaaaatcaactaaa

SEQ ID NO: 971832 - DNA, 25 bp, Mus musculus
tctaagagctggtaaatcaactaaa

SEQ ID NO: 971833 - DNA, 25 bp, Mus musculus
tctaagccagatccttccacacaaa

SEQ ID NO: 971834 - DNA, 25 bp, Mus musculus
tctaagccagcttgccatgaagtgt

SEQ ID NO: 971835 - DNA, 25 bp, Mus musculus
tctaagccaggttgccatgaagtgt

SEQ ID NO: 971836 - DNA, 25 bp, Mus musculus
tctaagccagttccttccacacaaa

SEQ ID NO: 971837 - DNA, 25 bp, Mus musculus
tctaagcttacacgagtgccaggag

SEQ ID NO: 971838 - DNA, 25 bp, Mus musculus
tctaagcttacaggagtgccaggag

SEQ ID NO: 971839 - DNA, 25 bp, Mus musculus
tctaaggaggagaacatttcagagt

SEQ ID NO: 971840 - DNA, 25 bp, Mus musculus
tctaaggaggagtacatttcagagt

SEQ ID NO: 971841 - DNA, 25 bp, Mus musculus
tctaaggattcacgctaaaaccgac

SEQ ID NO: 971842 - DNA, 25 bp, Mus musculus
tctaaggattcaggctaaaaccgac

SEQ ID NO: 971843 - DNA, 25 bp, Mus musculus
tctaaggcagagctgctgctgtccc

SEQ ID NO: 971844 - DNA, 25 bp, Mus musculus
tctaaggcagaggtgctgctgtccc

SEQ ID NO: 971845 - DNA, 25 bp, Mus musculus
tctaaggctttggcactaacggcca

SEQ ID NO: 971846 - DNA, 25 bp, Mus musculus
tctaaggctttggctctaacggcca

SEQ ID NO: 971847 - DNA, 25 bp, Mus musculus
tctaaggtcggacaagctctactcc

SEQ ID NO: 971848 - DNA, 25 bp, Mus musculus
tctaaggtcggacaaggaaacacag

SEQ ID NO: 971849 - DNA, 25 bp, Mus musculus
tctaaggtcggacatgctctactcc

SEQ ID NO: 971850 - DNA, 25 bp, Mus musculus
tctaaggtcggacatggaaacacag

SEQ ID NO: 971851 - DNA, 25 bp, Mus musculus
tctaagtccgagactcccaaggagc

SEQ ID NO: 971852 - DNA, 25 bp, Mus musculus
tctaagtccgagtctcccaaggagc

SEQ ID NO: 971853 - DNA, 25 bp, Mus musculus
tctaagtcgcagctagaatggatga

SEQ ID NO: 971854 - DNA, 25 bp, Mus musculus
tctaagtcgcaggtagaatggatga

SEQ ID NO: 971855 - DNA, 25 bp, Mus musculus
tctaatagacagcccaggaaacaag

SEQ ID NO: 971856 - DNA, 25 bp, Mus musculus
tctaatagacaggccaggaaacaag

SEQ ID NO: 971857 - DNA, 25 bp, Mus musculus
tctaatatgaagcaagtacttaagc

SEQ ID NO: 971858 - DNA, 25 bp, Mus musculus
tctaatatgaaggaagtacttaagc

SEQ ID NO: 971859 - DNA, 25 bp, Mus musculus
tctaatcctaaaactccacagttga

SEQ ID NO: 971860 - DNA, 25 bp, Mus musculus
tctaatcctaaatctccacagttga

SEQ ID NO: 971861 - DNA, 25 bp, Mus musculus
tctaatgaagctatttaatgatccc

SEQ ID NO: 971862 - DNA, 25 bp, Mus musculus
tctaatgaaggtatttaatgatccc

SEQ ID NO: 971863 - DNA, 25 bp, Mus musculus
tctaatgtcaagcgcctgtccggga

SEQ ID NO: 971864 - DNA, 25 bp, Mus musculus
tctaatgtcaagggcctgtccggga

SEQ ID NO: 971865 - DNA, 25 bp, Mus musculus
tctaattcagatcatgattctggaa

SEQ ID NO: 971866 - DNA, 25 bp, Mus musculus
tctaattcagttcatgattctggaa

SEQ ID NO: 971867 - DNA, 25 bp, Mus musculus
tctacaaaaagaatgaagacctgat

SEQ ID NO: 971868 - DNA, 25 bp, Mus musculus
tctacaaaaagattgaagacctgat

SEQ ID NO: 971869 - DNA, 25 bp, Mus musculus
tctacaaaagctcttcagagaagta

SEQ ID NO: 971870 - DNA, 25 bp, Mus musculus
tctacaaaagctgaagtatttgact

SEQ ID NO: 971871 - DNA, 25 bp, Mus musculus
tctacaaaaggtcttcagagaagta

SEQ ID NO: 971872 - DNA, 25 bp, Mus musculus
tctacaaaaggtgaagtatttgact

SEQ ID NO: 971873 - DNA, 25 bp, Mus musculus
tctacaaaatagagatctaatccct

SEQ ID NO: 971874 - DNA, 25 bp, Mus musculus
tctacaaaatagtgatctaatccct

SEQ ID NO: 971875 - DNA, 25 bp, Mus musculus
tctacaactgccagggtgcccagtc

SEQ ID NO: 971876 - DNA, 25 bp, Mus musculus
tctacaactggcagggtgcccagtc

SEQ ID NO: 971877 - DNA, 25 bp, Mus musculus
tctacaagatccagattcacaacgt

SEQ ID NO: 971878 - DNA, 25 bp, Mus musculus
tctacaagatccagtttcacaacgt

SEQ ID NO: 971879 - DNA, 25 bp, Mus musculus
tctacaagcaagcagttacaccctg

SEQ ID NO: 971880 - DNA, 25 bp, Mus musculus
tctacaagcaaggagttacaccctg

SEQ ID NO: 971881 - DNA, 25 bp, Mus musculus
tctacaagccagcagccatgcgagg

SEQ ID NO: 971882 - DNA, 25 bp, Mus musculus
tctacaagccaggagccatgcgagg

SEQ ID NO: 971883 - DNA, 25 bp, Mus musculus
tctacaatgaaggcctgtctgtgtc

SEQ ID NO: 971884 - DNA, 25 bp, Mus musculus
tctacaatgaaggcgtgtctgtgtc

SEQ ID NO: 971885 - DNA, 25 bp, Mus musculus
tctacacaacggattttatccttca

SEQ ID NO: 971886 - DNA, 25 bp, Mus musculus
tctacacaacggtttttatccttca

SEQ ID NO: 971887 - DNA, 25 bp, Mus musculus
tctacacaatttcggagtgagctac

SEQ ID NO: 971888 - DNA, 25 bp, Mus musculus
tctacacaatttgggagtgagctac

SEQ ID NO: 971889 - DNA, 25 bp, Mus musculus
tctacacagaagccaagcgtccacc

SEQ ID NO: 971890 - DNA, 25 bp, Mus musculus
tctacacagaagcctagcgtccacc

SEQ ID NO: 971891 - DNA, 25 bp, Mus musculus
tctacacatgatagaagatggagaa

SEQ ID NO: 971892 - DNA, 25 bp, Mus musculus
tctacacatgttagaagatggagaa

SEQ ID NO: 971893 - DNA, 25 bp, Mus musculus
tctacactgttgatggccgccccat

SEQ ID NO: 971894 - DNA, 25 bp, Mus musculus
tctacactgttgttggccgccccat

SEQ ID NO: 971895 - DNA, 25 bp, Mus musculus
tctacagaagcctgaggagctattc

SEQ ID NO: 971896 - DNA, 25 bp, Mus musculus
tctacagaaggctgaggagctattc

SEQ ID NO: 971897 - DNA, 25 bp, Mus musculus
tctacagacaagctgaccttgaaca

SEQ ID NO: 971898 - DNA, 25 bp, Mus musculus
tctacagacaaggtgaccttgaaca

SEQ ID NO: 971899 - DNA, 25 bp, Mus musculus
tctacagatgctgatggaacttgcg

SEQ ID NO: 971900 - DNA, 25 bp, Mus musculus
tctacagatggtgatggaacttgcg

SEQ ID NO: 971901 - DNA, 25 bp, Mus musculus
tctacagcagaccacgaaacataag

SEQ ID NO: 971902 - DNA, 25 bp, Mus musculus
tctacagcagaccaggaaacataag

SEQ ID NO: 971903 - DNA, 25 bp, Mus musculus
tctacagcctccagctgtcatccat

SEQ ID NO: 971904 - DNA, 25 bp, Mus musculus
tctacagcctccaggtgtcatccat

SEQ ID NO: 971905 - DNA, 25 bp, Mus musculus
tctacagctcagccgaatttcacag

SEQ ID NO: 971906 - DNA, 25 bp, Mus musculus
tctacagctcaggcgaatttcacag

SEQ ID NO: 971907 - DNA, 25 bp, Mus musculus
tctacaggaagccaaaattctgaag

SEQ ID NO: 971908 - DNA, 25 bp, Mus musculus
tctacaggaagccataattctgaag

SEQ ID NO: 971909 - DNA, 25 bp, Mus musculus
tctacaggagaagtcgtgcatggat

SEQ ID NO: 971910 - DNA, 25 bp, Mus musculus
tctacaggagaagtcgtggcctgct

SEQ ID NO: 971911 - DNA, 25 bp, Mus musculus
tctacaggagaagtggtgcatggat

SEQ ID NO: 971912 - DNA, 25 bp, Mus musculus
tctacaggagaagtggtggcctgct

SEQ ID NO: 971913 - DNA, 25 bp, Mus musculus
tctacaggcaagctgagctccacct

SEQ ID NO: 971914 - DNA, 25 bp, Mus musculus
tctacaggcaaggtgagctccacct

SEQ ID NO: 971915 - DNA, 25 bp, Mus musculus
tctacaggtacggacccgaaagtgc

SEQ ID NO: 971916 - DNA, 25 bp, Mus musculus
tctacaggtagggacccgaaagtgc

SEQ ID NO: 971917 - DNA, 25 bp, Mus musculus
tctacatcgactaccagagagatcc

SEQ ID NO: 971918 - DNA, 25 bp, Mus musculus
tctacatcgactacgagagagatcc

SEQ ID NO: 971919 - DNA, 25 bp, Mus musculus
tctacattagtgggaagcagctata

SEQ ID NO: 971920 - DNA, 25 bp, Mus musculus
tctacattagtgggtagcagctata

SEQ ID NO: 971921 - DNA, 25 bp, Mus musculus
tctacattctccatcgagcagcctg

SEQ ID NO: 971922 - DNA, 25 bp, Mus musculus
tctacattctccatggagcagcctg

SEQ ID NO: 971923 - DNA, 25 bp, Mus musculus
tctacattgcagattcatcgtgaga

SEQ ID NO: 971924 - DNA, 25 bp, Mus musculus
tctacattgcagtttcatcgtgaga

SEQ ID NO: 971925 - DNA, 25 bp, Mus musculus
tctacatttcagacatcccgcttac

SEQ ID NO: 971926 - DNA, 25 bp, Mus musculus
tctacatttcagatcctcctaccac

SEQ ID NO: 971927 - DNA, 25 bp, Mus musculus
tctacatttcagtcatcccgcttac

SEQ ID NO: 971928 - DNA, 25 bp, Mus musculus
tctacatttcagttcctcctaccac

SEQ ID NO: 971929 - DNA, 25 bp, Mus musculus
tctaccaacacaaattcagtgtagc

SEQ ID NO: 971930 - DNA, 25 bp, Mus musculus
tctaccaacacatattcagtgtagc

SEQ ID NO: 971931 - DNA, 25 bp, Mus musculus
tctaccaacgcaattgaatataaca

SEQ ID NO: 971932 - DNA, 25 bp, Mus musculus
tctaccaacggaattgaatataaca

SEQ ID NO: 971933 - DNA, 25 bp, Mus musculus
tctaccacaaatccaaatggaacat

SEQ ID NO: 971934 - DNA, 25 bp, Mus musculus
tctaccacaaatcctaatggaacat

SEQ ID NO: 971935 - DNA, 25 bp, Mus musculus
tctaccacagagaaaggcccgctta

SEQ ID NO: 971936 - DNA, 25 bp, Mus musculus
tctaccacagagactcatgttcatc

SEQ ID NO: 971937 - DNA, 25 bp, Mus musculus
tctaccacagtgaaaggcccgctta

SEQ ID NO: 971938 - DNA, 25 bp, Mus musculus
tctaccacagtgactcatgttcatc

SEQ ID NO: 971939 - DNA, 25 bp, Mus musculus
tctaccacggctcgaaactccagtc

SEQ ID NO: 971940 - DNA, 25 bp, Mus musculus
tctaccacggctggaaactccagtc

SEQ ID NO: 971941 - DNA, 25 bp, Mus musculus
tctaccactctgcacggaacatcat

SEQ ID NO: 971942 - DNA, 25 bp, Mus musculus
tctaccactctgcagggaacatcat

SEQ ID NO: 971943 - DNA, 25 bp, Mus musculus
tctaccactgcaccctctccttcct

SEQ ID NO: 971944 - DNA, 25 bp, Mus musculus
tctaccactggaccctctccttcct

SEQ ID NO: 971945 - DNA, 25 bp, Mus musculus
tctaccagagagtcttttatccagt

SEQ ID NO: 971946 - DNA, 25 bp, Mus musculus
tctaccagagtgtcttttatccagt

SEQ ID NO: 971947 - DNA, 25 bp, Mus musculus
tctaccagggcaaacggaagtttgc

SEQ ID NO: 971948 - DNA, 25 bp, Mus musculus
tctaccagggcaaagggaagtttgc

SEQ ID NO: 971949 - DNA, 25 bp, Mus musculus
tctaccagtctttacctgacctgaa

SEQ ID NO: 971950 - DNA, 25 bp, Mus musculus
tctaccagtctttagctgacctgaa

SEQ ID NO: 971951 - DNA, 25 bp, Mus musculus
tctacccacagcaaccaccctactg

SEQ ID NO: 971952 - DNA, 25 bp, Mus musculus
tctacccacagcaagcaccctactg

SEQ ID NO: 971953 - DNA, 25 bp, Mus musculus
tctaccccacataatatttcttgga

SEQ ID NO: 971954 - DNA, 25 bp, Mus musculus
tctaccccacttaatatttcttgga

SEQ ID NO: 971955 - DNA, 25 bp, Mus musculus
tctaccccagagctgtgatctcatg

SEQ ID NO: 971956 - DNA, 25 bp, Mus musculus
tctaccccagctggcagccttggct

SEQ ID NO: 971957 - DNA, 25 bp, Mus musculus
tctaccccaggtggcagccttggct

SEQ ID NO: 971958 - DNA, 25 bp, Mus musculus
tctaccccagtgctgtgatctcatg

SEQ ID NO: 971959 - DNA, 25 bp, Mus musculus
tctacccgacagacatacttcctgc

SEQ ID NO: 971960 - DNA, 25 bp, Mus musculus
tctacccgacagcgtgtgaacaaag

SEQ ID NO: 971961 - DNA, 25 bp, Mus musculus
tctacccgacagggtgtgaacaaag

SEQ ID NO: 971962 - DNA, 25 bp, Mus musculus
tctacccgacagtcatacttcctgc

SEQ ID NO: 971963 - DNA, 25 bp, Mus musculus
tctaccctgactcacgttctgcgga

SEQ ID NO: 971964 - DNA, 25 bp, Mus musculus
tctaccctgactcaggttctgcgga

SEQ ID NO: 971965 - DNA, 25 bp, Mus musculus
tctaccgaagcacagttttgccgaa

SEQ ID NO: 971966 - DNA, 25 bp, Mus musculus
tctaccgaagcagagttttgccgaa

SEQ ID NO: 971967 - DNA, 25 bp, Mus musculus
tctaccgcaacgaggtctccattga

SEQ ID NO: 971968 - DNA, 25 bp, Mus musculus
tctaccgcaacgtggtctccattga

SEQ ID NO: 971969 - DNA, 25 bp, Mus musculus
tctaccgggctacgttttatgcagc

SEQ ID NO: 971970 - DNA, 25 bp, Mus musculus
tctaccgggctaggttttatgcagc

SEQ ID NO: 971971 - DNA, 25 bp, Mus musculus
tctaccgtagcccacaaaaatatga

SEQ ID NO: 971972 - DNA, 25 bp, Mus musculus
tctaccgtagcccacagcaagtccc

SEQ ID NO: 971973 - DNA, 25 bp, Mus musculus
tctaccgtagcccagaaaaatatga

SEQ ID NO: 971974 - DNA, 25 bp, Mus musculus
tctaccgtagcccagagcaagtccc

SEQ ID NO: 971975 - DNA, 25 bp, Mus musculus
tctacctcagggcgtgggggatgtg

SEQ ID NO: 971976 - DNA, 25 bp, Mus musculus
tctacctcagggggtgggggatgtg

SEQ ID NO: 971977 - DNA, 25 bp, Mus musculus
tctacctcgcagagaggccatcgcg

SEQ ID NO: 971978 - DNA, 25 bp, Mus musculus
tctacctcgctgagaggccatcgcg

SEQ ID NO: 971979 - DNA, 25 bp, Mus musculus
tctacctgaacacggacccagaagg

SEQ ID NO: 971980 - DNA, 25 bp, Mus musculus
tctacctgaacagggacccagaagg

SEQ ID NO: 971981 - DNA, 25 bp, Mus musculus
tctacctggaagctggcttcagtaa

SEQ ID NO: 971982 - DNA, 25 bp, Mus musculus
tctacctggaaggtggcttcagtaa

SEQ ID NO: 971983 - DNA, 25 bp, Mus musculus
tctacgacaccaacctgccagatgt

SEQ ID NO: 971984 - DNA, 25 bp, Mus musculus
tctacgacacgaacctgccagatgt

SEQ ID NO: 971985 - DNA, 25 bp, Mus musculus
tctacgatacagcgtcgagatgggc

SEQ ID NO: 971986 - DNA, 25 bp, Mus musculus
tctacgatacagggtcgagatgggc

SEQ ID NO: 971987 - DNA, 25 bp, Mus musculus
tctacggagacacattctatgaatt

SEQ ID NO: 971988 - DNA, 25 bp, Mus musculus
tctacggagacagattctatgaatt

SEQ ID NO: 971989 - DNA, 25 bp, Mus musculus
tctacggcatccggagtcacctctt

SEQ ID NO: 971990 - DNA, 25 bp, Mus musculus
tctacggcatccggtgtcacctctt

SEQ ID NO: 971991 - DNA, 25 bp, Mus musculus
tctacggcggagaggaacactcggg

SEQ ID NO: 971992 - DNA, 25 bp, Mus musculus
tctacggcggagtggaacactcggg

SEQ ID NO: 971993 - DNA, 25 bp, Mus musculus
tctacgtcctcgcaggctatgatgg

SEQ ID NO: 971994 - DNA, 25 bp, Mus musculus
tctacgtcctcggaggctatgatgg

SEQ ID NO: 971995 - DNA, 25 bp, Mus musculus
tctactacacagaccccttggttcg

SEQ ID NO: 971996 - DNA, 25 bp, Mus musculus
tctactacacagtccccttggttcg

SEQ ID NO: 971997 - DNA, 25 bp, Mus musculus
tctactactgaaaaccccaagtacc

SEQ ID NO: 971998 - DNA, 25 bp, Mus musculus
tctactactgaataccccaagtacc

SEQ ID NO: 971999 - DNA, 25 bp, Mus musculus
tctactactgcgactcgtactgggt

SEQ ID NO: 972000 - DNA, 25 bp, Mus musculus
tctactactgggactcgtactgggt

SEQ ID NO: 972001 - DNA, 25 bp, Mus musculus
tctactatcacgattgtggctgagg

SEQ ID NO: 972002 - DNA, 25 bp, Mus musculus
tctactatcacgtttgtggctgagg

SEQ ID NO: 972003 - DNA, 25 bp, Mus musculus
tctactattagatgaatatgcaggt

SEQ ID NO: 972004 - DNA, 25 bp, Mus musculus
tctactattagatgtatatgcaggt

SEQ ID NO: 972005 - DNA, 25 bp, Mus musculus
tctactccagactacggaacgacac

SEQ ID NO: 972006 - DNA, 25 bp, Mus musculus
tctactccagactagggaacgacac

SEQ ID NO: 972007 - DNA, 25 bp, Mus musculus
tctactccatcaattgtagggatcc

SEQ ID NO: 972008 - DNA, 25 bp, Mus musculus
tctactccatcatttgtagggatcc

SEQ ID NO: 972009 - DNA, 25 bp, Mus musculus
tctactccggccatggtgcgagcac

SEQ ID NO: 972010 - DNA, 25 bp, Mus musculus
tctactccgggcatggtgcgagcac

SEQ ID NO: 972011 - DNA, 25 bp, Mus musculus
tctactcctcagctggaattttgga

SEQ ID NO: 972012 - DNA, 25 bp, Mus musculus
tctactcctcaggtggaattttgga

SEQ ID NO: 972013 - DNA, 25 bp, Mus musculus
tctactcctgcacactggcataaca

SEQ ID NO: 972014 - DNA, 25 bp, Mus musculus
tctactcctgcagactggcataaca

SEQ ID NO: 972015 - DNA, 25 bp, Mus musculus
tctactcctttgctgctgctgttgt

SEQ ID NO: 972016 - DNA, 25 bp, Mus musculus
tctactcctttggtgctgctgttgt

SEQ ID NO: 972017 - DNA, 25 bp, Mus musculus
tctactctaccagacagtcttttat

SEQ ID NO: 972018 - DNA, 25 bp, Mus musculus
tctactctaccagagagtcttttat

SEQ ID NO: 972019 - DNA, 25 bp, Mus musculus
tctactcttcaaaggtgtgttgtcc

SEQ ID NO: 972020 - DNA, 25 bp, Mus musculus
tctactcttcaatggtgtgttgtcc

SEQ ID NO: 972021 - DNA, 25 bp, Mus musculus
tctactcttgcttcttcattgagtc

SEQ ID NO: 972022 - DNA, 25 bp, Mus musculus
tctactcttggttcttcattgagtc

SEQ ID NO: 972023 - DNA, 25 bp, Mus musculus
tctactgcaaagattgctatgccaa

SEQ ID NO: 972024 - DNA, 25 bp, Mus musculus
tctactgcaaagtttgctatgccaa

SEQ ID NO: 972025 - DNA, 25 bp, Mus musculus
tctactggcaagctggtctacttca

SEQ ID NO: 972026 - DNA, 25 bp, Mus musculus
tctactggcaagctggtctatttca

SEQ ID NO: 972027 - DNA, 25 bp, Mus musculus
tctactggcaaggtggtctacttca

SEQ ID NO: 972028 - DNA, 25 bp, Mus musculus
tctactggcaaggtggtctatttca

SEQ ID NO: 972029 - DNA, 25 bp, Mus musculus
tctactgtcccgctgtgccagcctt

SEQ ID NO: 972030 - DNA, 25 bp, Mus musculus
tctactgtcccggtgtgccagcctt

SEQ ID NO: 972031 - DNA, 25 bp, Mus musculus
tctactgtgaagctgtggtccggtg

SEQ ID NO: 972032 - DNA, 25 bp, Mus musculus
tctactgtgaaggtgtggtccggtg

SEQ ID NO: 972033 - DNA, 25 bp, Mus musculus
tctacttacagtcgtgactccgggg

SEQ ID NO: 972034 - DNA, 25 bp, Mus musculus
tctacttacagtggtgactccgggg

SEQ ID NO: 972035 - DNA, 25 bp, Mus musculus
tctacttcaacaagagaacaatgtt

SEQ ID NO: 972036 - DNA, 25 bp, Mus musculus
tctacttcaagaagagaacaatgtt

SEQ ID NO: 972037 - DNA, 25 bp, Mus musculus
tctacttcattgatcataatacgaa

SEQ ID NO: 972038 - DNA, 25 bp, Mus musculus
tctacttcattgttcataatacgaa

SEQ ID NO: 972039 - DNA, 25 bp, Mus musculus
tctacttcttcaagcggaagcagta

SEQ ID NO: 972040 - DNA, 25 bp, Mus musculus
tctacttcttcaaggggaagcagta

SEQ ID NO: 972041 - DNA, 25 bp, Mus musculus
tctacttgagcacctattatctacg

SEQ ID NO: 972042 - DNA, 25 bp, Mus musculus
tctacttgagcagctattatctacg

SEQ ID NO: 972043 - DNA, 25 bp, Mus musculus
tctagaaaacataggagacagcttg

SEQ ID NO: 972044 - DNA, 25 bp, Mus musculus
tctagaaaaccctaatctttctgca

SEQ ID NO: 972045 - DNA, 25 bp, Mus musculus
tctagaaaacgctaatctttctgca

SEQ ID NO: 972046 - DNA, 25 bp, Mus musculus
tctagaaaacttaggagacagcttg

SEQ ID NO: 972047 - DNA, 25 bp, Mus musculus
tctagaaaagacaagagaagagagc

SEQ ID NO: 972048 - DNA, 25 bp, Mus musculus
tctagaaaagtcaagagaagagagc

SEQ ID NO: 972049 - DNA, 25 bp, Mus musculus
tctagaagagcaacaagagagtgaa

SEQ ID NO: 972050 - DNA, 25 bp, Mus musculus
tctagaagaggaacaagagagtgaa

SEQ ID NO: 972051 - DNA, 25 bp, Mus musculus
tctagaatatttattcatagaaaac

SEQ ID NO: 972052 - DNA, 25 bp, Mus musculus
tctagaatattttttcatagaaaac

SEQ ID NO: 972053 - DNA, 25 bp, Mus musculus
tctagacaagccaggttcaccggac

SEQ ID NO: 972054 - DNA, 25 bp, Mus musculus
tctagacaaggcaggttcaccggac

SEQ ID NO: 972055 - DNA, 25 bp, Mus musculus
tctagacccggcaacaaagtccatg

SEQ ID NO: 972056 - DNA, 25 bp, Mus musculus
tctagacccggcaacaccttcaaga

SEQ ID NO: 972057 - DNA, 25 bp, Mus musculus
tctagacccggcaaccagaccttca

SEQ ID NO: 972058 - DNA, 25 bp, Mus musculus
tctagacccggcaagaaagtccatg

SEQ ID NO: 972059 - DNA, 25 bp, Mus musculus
tctagacccggcaagaccttcaaga

SEQ ID NO: 972060 - DNA, 25 bp, Mus musculus
tctagacccggcaagcagaccttca

SEQ ID NO: 972061 - DNA, 25 bp, Mus musculus
tctagactttgacgaggaagaagtg

SEQ ID NO: 972062 - DNA, 25 bp, Mus musculus
tctagactttgaggaggaagaagtg

SEQ ID NO: 972063 - DNA, 25 bp, Mus musculus
tctagagaaataagtgcatgagctc

SEQ ID NO: 972064 - DNA, 25 bp, Mus musculus
tctagagaaatatgtgcatgagctc

SEQ ID NO: 972065 - DNA, 25 bp, Mus musculus
tctagagaagcagctagaagcgatc

SEQ ID NO: 972066 - DNA, 25 bp, Mus musculus
tctagagaaggagctagaagcgatc

SEQ ID NO: 972067 - DNA, 25 bp, Mus musculus
tctagaggagctcagttactacttt

SEQ ID NO: 972068 - DNA, 25 bp, Mus musculus
tctagaggaggtcagttactacttt

SEQ ID NO: 972069 - DNA, 25 bp, Mus musculus
tctagagtgctggacaataaactga

SEQ ID NO: 972070 - DNA, 25 bp, Mus musculus
tctagagtgctggagaataaactga

SEQ ID NO: 972071 - DNA, 25 bp, Mus musculus
tctagatgagatcaccgaagtggcc

SEQ ID NO: 972072 - DNA, 25 bp, Mus musculus
tctagatgagttcaccgaagtggcc

SEQ ID NO: 972073 - DNA, 25 bp, Mus musculus
tctagcattacaaggaggtgcccct

SEQ ID NO: 972074 - DNA, 25 bp, Mus musculus
tctagcattacatggaggtgcccct

SEQ ID NO: 972075 - DNA, 25 bp, Mus musculus
tctagcggccgccactctccacaga

SEQ ID NO: 972076 - DNA, 25 bp, Mus musculus
tctagcggccgccagtctccacaga

SEQ ID NO: 972077 - DNA, 25 bp, Mus musculus
tctagctgggcgaggacccgtggag

SEQ ID NO: 972078 - DNA, 25 bp, Mus musculus
tctagctgggggaggacccgtggag

SEQ ID NO: 972079 - DNA, 25 bp, Mus musculus
tctagcttgcttacaaatgcagact

SEQ ID NO: 972080 - DNA, 25 bp, Mus musculus
tctagcttgcttactaatgcagact

SEQ ID NO: 972081 - DNA, 25 bp, Mus musculus
tctaggagggctgacgtacagtcat

SEQ ID NO: 972082 - DNA, 25 bp, Mus musculus
tctaggagggctgaggtacagtcat

SEQ ID NO: 972083 - DNA, 25 bp, Mus musculus
tctaggatcttctactgaacagcgt

SEQ ID NO: 972084 - DNA, 25 bp, Mus musculus
tctaggatcttctagtgaacagcgt

SEQ ID NO: 972085 - DNA, 25 bp, Mus musculus
tctaggcaacaacgccgatgtaagc

SEQ ID NO: 972086 - DNA, 25 bp, Mus musculus
tctaggcaacaaggccgatgtaagc

SEQ ID NO: 972087 - DNA, 25 bp, Mus musculus
tctaggccctcacatcaatgatgat

SEQ ID NO: 972088 - DNA, 25 bp, Mus musculus
tctaggccctcagatcaatgatgat

SEQ ID NO: 972089 - DNA, 25 bp, Mus musculus
tctagggctctgcacgaagcctgct

SEQ ID NO: 972090 - DNA, 25 bp, Mus musculus
tctagggctctgcaggaagcctgct

SEQ ID NO: 972091 - DNA, 25 bp, Mus musculus
tctagtccctcatttgagtaacttc

SEQ ID NO: 972092 - DNA, 25 bp, Mus musculus
tctagtccctgatttgagtaacttc

SEQ ID NO: 972093 - DNA, 25 bp, Mus musculus
tctagtgcagcggatgtcactaccc

SEQ ID NO: 972094 - DNA, 25 bp, Mus musculus
tctagtgcaggggatgtcactaccc

SEQ ID NO: 972095 - DNA, 25 bp, Mus musculus
tctagtgctcttcacaatgtgaaga

SEQ ID NO: 972096 - DNA, 25 bp, Mus musculus
tctagtgctcttcagaatgtgaaga

SEQ ID NO: 972097 - DNA, 25 bp, Mus musculus
tctagtggcagccggccacgactgc

SEQ ID NO: 972098 - DNA, 25 bp, Mus musculus
tctagtggcagcgggccacgactgc

SEQ ID NO: 972099 - DNA, 25 bp, Mus musculus
tctagtgtggaaaacgtcttagatc

SEQ ID NO: 972100 - DNA, 25 bp, Mus musculus
tctagtgtggaaaaggtcttagatc

SEQ ID NO: 972101 - DNA, 25 bp, Mus musculus
tctagtgttaaaggcgcgatgggcg

SEQ ID NO: 972102 - DNA, 25 bp, Mus musculus
tctagtgttaaaggggcgatgggcg

SEQ ID NO: 972103 - DNA, 25 bp, Mus musculus
tctagttcagcccagctgctgctca

SEQ ID NO: 972104 - DNA, 25 bp, Mus musculus
tctagttcaggccagctgctgctca

SEQ ID NO: 972105 - DNA, 25 bp, Mus musculus
tctataaaagagcatgggtacacaa

SEQ ID NO: 972106 - DNA, 25 bp, Mus musculus
tctataaaagagctatatattatga

SEQ ID NO: 972107 - DNA, 25 bp, Mus musculus
tctataaaagaggatgggtacacaa

SEQ ID NO: 972108 - DNA, 25 bp, Mus musculus
tctataaaagaggtatatattatga

SEQ ID NO: 972109 - DNA, 25 bp, Mus musculus
tctataaagactaccgcggggacag

SEQ ID NO: 972110 - DNA, 25 bp, Mus musculus
tctataaagacttccgcggggacag

SEQ ID NO: 972111 - DNA, 25 bp, Mus musculus
tctataaatttgcaagagccagagg

SEQ ID NO: 972112 - DNA, 25 bp, Mus musculus
tctataaatttggaagagccagagg

SEQ ID NO: 972113 - DNA, 25 bp, Mus musculus
tctatacacagacgaccgcctgggg

SEQ ID NO: 972114 - DNA, 25 bp, Mus musculus
tctatacacagaggaccgcctgggg

SEQ ID NO: 972115 - DNA, 25 bp, Mus musculus
tctataccagaacggcttcctacca

SEQ ID NO: 972116 - DNA, 25 bp, Mus musculus
tctataccagaagggcttcctacca

SEQ ID NO: 972117 - DNA, 25 bp, Mus musculus
tctataccatgacgctcaccatcaa

SEQ ID NO: 972118 - DNA, 25 bp, Mus musculus
tctataccatgaggctcaccatcaa

SEQ ID NO: 972119 - DNA, 25 bp, Mus musculus
tctatagcagctatggaggagggcc

SEQ ID NO: 972120 - DNA, 25 bp, Mus musculus
tctatagcaggtatggaggagggcc

SEQ ID NO: 972121 - DNA, 25 bp, Mus musculus
tctatagttcagccatctactatga

SEQ ID NO: 972122 - DNA, 25 bp, Mus musculus
tctatagttcaggcatctactatga

SEQ ID NO: 972123 - DNA, 25 bp, Mus musculus
tctatatcaccaaacctgaaagggg

SEQ ID NO: 972124 - DNA, 25 bp, Mus musculus
tctatatcaccaaactcctgaaggg

SEQ ID NO: 972125 - DNA, 25 bp, Mus musculus
tctatatcaccaaagctgaaagggg

SEQ ID NO: 972126 - DNA, 25 bp, Mus musculus
tctatatcaccaaagtcctgaaggg

SEQ ID NO: 972127 - DNA, 25 bp, Mus musculus
tctatatcacggctgggactttaat

SEQ ID NO: 972128 - DNA, 25 bp, Mus musculus
tctatatcacgggtgggactttaat

SEQ ID NO: 972129 - DNA, 25 bp, Mus musculus
tctatatgagagttttggcagtgat

SEQ ID NO: 972130 - DNA, 25 bp, Mus musculus
tctatatgagtgttttggcagtgat

SEQ ID NO: 972131 - DNA, 25 bp, Mus musculus
tctatcaaagctgttcctgagcatg

SEQ ID NO: 972132 - DNA, 25 bp, Mus musculus
tctatcaaagcttgccgaggctggt

SEQ ID NO: 972133 - DNA, 25 bp, Mus musculus
tctatcaaaggtgttcctgagcatg

SEQ ID NO: 972134 - DNA, 25 bp, Mus musculus
tctatcaaaggttgccgaggctggt

SEQ ID NO: 972135 - DNA, 25 bp, Mus musculus
tctatcataccgcgacagaagagga

SEQ ID NO: 972136 - DNA, 25 bp, Mus musculus
tctatcataccgggacagaagagga

SEQ ID NO: 972137 - DNA, 25 bp, Mus musculus
tctatcctagcgactctgactgtag

SEQ ID NO: 972138 - DNA, 25 bp, Mus musculus
tctatcctagggactctgactgtag

SEQ ID NO: 972139 - DNA, 25 bp, Mus musculus
tctatctagccacggtcacagctct

SEQ ID NO: 972140 - DNA, 25 bp, Mus musculus
tctatctagccagggtcacagctct

SEQ ID NO: 972141 - DNA, 25 bp, Mus musculus
tctatctatcatctatctacctatc

SEQ ID NO: 972142 - DNA, 25 bp, Mus musculus
tctatctatcttctatctacctatc

SEQ ID NO: 972143 - DNA, 25 bp, Mus musculus
tctatctatgaacagagaaaacgtt

SEQ ID NO: 972144 - DNA, 25 bp, Mus musculus
tctatctatgtacagagaaaacgtt

SEQ ID NO: 972145 - DNA, 25 bp, Mus musculus
tctatctcagcggccctggaagact

SEQ ID NO: 972146 - DNA, 25 bp, Mus musculus
tctatctcaggggccctggaagact

SEQ ID NO: 972147 - DNA, 25 bp, Mus musculus
tctatctgccagcatttgtgaagtt

SEQ ID NO: 972148 - DNA, 25 bp, Mus musculus
tctatctgccaggatttgtgaagtt

SEQ ID NO: 972149 - DNA, 25 bp, Mus musculus
tctatgacccagccagtgatccagg

SEQ ID NO: 972150 - DNA, 25 bp, Mus musculus
tctatgacccaggcagtgatccagg

SEQ ID NO: 972151 - DNA, 25 bp, Mus musculus
tctatgagaaggcatgtaatcggct

SEQ ID NO: 972152 - DNA, 25 bp, Mus musculus
tctatgagaagggatgtaatcggct

SEQ ID NO: 972153 - DNA, 25 bp, Mus musculus
tctatgagatcaaccgtgaccattt

SEQ ID NO: 972154 - DNA, 25 bp, Mus musculus
tctatgagatcaacggtgaccattt

SEQ ID NO: 972155 - DNA, 25 bp, Mus musculus
tctatgatgtacaacatgccaattt

SEQ ID NO: 972156 - DNA, 25 bp, Mus musculus
tctatgatgttcaacatgccaattt

SEQ ID NO: 972157 - DNA, 25 bp, Mus musculus
tctatgcaaaacagcttcaccgata

SEQ ID NO: 972158 - DNA, 25 bp, Mus musculus
tctatgcaaaacctataaatcctcg

SEQ ID NO: 972159 - DNA, 25 bp, Mus musculus
tctatgcaaaacgtataaatcctcg

SEQ ID NO: 972160 - DNA, 25 bp, Mus musculus
tctatgcaaaactgcttcaccgata

SEQ ID NO: 972161 - DNA, 25 bp, Mus musculus
tctatgcacaaagacgctgccagct

SEQ ID NO: 972162 - DNA, 25 bp, Mus musculus
tctatgcacaaagaggctgccagct

SEQ ID NO: 972163 - DNA, 25 bp, Mus musculus
tctatgcagcggagcatgtggatga

SEQ ID NO: 972164 - DNA, 25 bp, Mus musculus
tctatgcagcggaggatgtggatga

SEQ ID NO: 972165 - DNA, 25 bp, Mus musculus
tctatgcattcgcgactgtgtggta

SEQ ID NO: 972166 - DNA, 25 bp, Mus musculus
tctatgcattcgggactgtgtggta

SEQ ID NO: 972167 - DNA, 25 bp, Mus musculus
tctatgccgtggacaacaattacga

SEQ ID NO: 972168 - DNA, 25 bp, Mus musculus
tctatgccgtggatgaacggggtaa

SEQ ID NO: 972169 - DNA, 25 bp, Mus musculus
tctatgccgtggtcaacaattacga

SEQ ID NO: 972170 - DNA, 25 bp, Mus musculus
tctatgccgtggttgaacggggtaa

SEQ ID NO: 972171 - DNA, 25 bp, Mus musculus
tctatgcttcagccaacagctgagg

SEQ ID NO: 972172 - DNA, 25 bp, Mus musculus
tctatgcttcaggcaacagctgagg

SEQ ID NO: 972173 - DNA, 25 bp, Mus musculus
tctatggaagctggtattaatggca

SEQ ID NO: 972174 - DNA, 25 bp, Mus musculus
tctatggaaggtggtattaatggca

SEQ ID NO: 972175 - DNA, 25 bp, Mus musculus
tctatggaccccgacgcagagtctt

SEQ ID NO: 972176 - DNA, 25 bp, Mus musculus
tctatggaccccgaggcagagtctt

SEQ ID NO: 972177 - DNA, 25 bp, Mus musculus
tctatggaccgccacgcactgggaa

SEQ ID NO: 972178 - DNA, 25 bp, Mus musculus
tctatggaccgccaggcactgggaa

SEQ ID NO: 972179 - DNA, 25 bp, Mus musculus
tctatggcacagcaccgctctgcag

SEQ ID NO: 972180 - DNA, 25 bp, Mus musculus
tctatggcacaggaccgctctgcag

SEQ ID NO: 972181 - DNA, 25 bp, Mus musculus
tctatggcacatttcatgtccatct

SEQ ID NO: 972182 - DNA, 25 bp, Mus musculus
tctatggcacatttgatgtccatct

SEQ ID NO: 972183 - DNA, 25 bp, Mus musculus
tctatggccctaaacgggttggtgc

SEQ ID NO: 972184 - DNA, 25 bp, Mus musculus
tctatggccctaaaggggttggtgc

SEQ ID NO: 972185 - DNA, 25 bp, Mus musculus
tctatggctccacatgggaatggtg

SEQ ID NO: 972186 - DNA, 25 bp, Mus musculus
tctatggctccagatgggaatggtg

SEQ ID NO: 972187 - DNA, 25 bp, Mus musculus
tctatggggaggaaccatgtaggat

SEQ ID NO: 972188 - DNA, 25 bp, Mus musculus
tctatggggaggaagcatgtaggat

SEQ ID NO: 972189 - DNA, 25 bp, Mus musculus
tctatgtcacagatgtggttccagg

SEQ ID NO: 972190 - DNA, 25 bp, Mus musculus
tctatgtcacagttgtggttccagg

SEQ ID NO: 972191 - DNA, 25 bp, Mus musculus
tctatgtcagacagggaacaacact

SEQ ID NO: 972192 - DNA, 25 bp, Mus musculus
tctatgtcagtcagggaacaacact

SEQ ID NO: 972193 - DNA, 25 bp, Mus musculus
tctattgaggcaaaagattccaggc

SEQ ID NO: 972194 - DNA, 25 bp, Mus musculus
tctattgagggaaaagattccaggc

SEQ ID NO: 972195 - DNA, 25 bp, Mus musculus
tctattggtgcaatccatgaagact

SEQ ID NO: 972196 - DNA, 25 bp, Mus musculus
tctattggtggaatccatgaagact

SEQ ID NO: 972197 - DNA, 25 bp, Mus musculus
tctattgttgaacacgtctcggtgc

SEQ ID NO: 972198 - DNA, 25 bp, Mus musculus
tctattgttgaacaggtctcggtgc

SEQ ID NO: 972199 - DNA, 25 bp, Mus musculus
tctatttaagaacagaaggtggctg

SEQ ID NO: 972200 - DNA, 25 bp, Mus musculus
tctatttaagaacatgaaaccagat

SEQ ID NO: 972201 - DNA, 25 bp, Mus musculus
tctatttaagaagagaaggtggctg

SEQ ID NO: 972202 - DNA, 25 bp, Mus musculus
tctatttaagaagatgaaaccagat

SEQ ID NO: 972203 - DNA, 25 bp, Mus musculus
tctatttctgcgttctgccagaatc

SEQ ID NO: 972204 - DNA, 25 bp, Mus musculus
tctatttctgggttctgccagaatc

SEQ ID NO: 972205 - DNA, 25 bp, Mus musculus
tctcaaaacccagacggccagtaag

SEQ ID NO: 972206 - DNA, 25 bp, Mus musculus
tctcaaaacccagagggccagtaag

SEQ ID NO: 972207 - DNA, 25 bp, Mus musculus
tctcaaaattagctgtgaacatttt

SEQ ID NO: 972208 - DNA, 25 bp, Mus musculus
tctcaaaattaggtgtgaacatttt

SEQ ID NO: 972209 - DNA, 25 bp, Mus musculus
tctcaaaattcaattgctgatagcc

SEQ ID NO: 972210 - DNA, 25 bp, Mus musculus
tctcaaaattcaatttctgttgccc

SEQ ID NO: 972211 - DNA, 25 bp, Mus musculus
tctcaaaattcatttgctgatagcc

SEQ ID NO: 972212 - DNA, 25 bp, Mus musculus
tctcaaaattcattttctgttgccc

SEQ ID NO: 972213 - DNA, 25 bp, Mus musculus
tctcaaagctccgtcagatctgcag

SEQ ID NO: 972214 - DNA, 25 bp, Mus musculus
tctcaaagctgcgtcagatctgcag

SEQ ID NO: 972215 - DNA, 25 bp, Mus musculus
tctcaaaggcagcttcggggctggc

SEQ ID NO: 972216 - DNA, 25 bp, Mus musculus
tctcaaaggcaggttcggggctggc

SEQ ID NO: 972217 - DNA, 25 bp, Mus musculus
tctcaaatccagcgacaaatttagt

SEQ ID NO: 972218 - DNA, 25 bp, Mus musculus
tctcaaatccagggacaaatttagt

SEQ ID NO: 972219 - DNA, 25 bp, Mus musculus
tctcaacaacagctattccaaagac

SEQ ID NO: 972220 - DNA, 25 bp, Mus musculus
tctcaacaacaggtattccaaagac

SEQ ID NO: 972221 - DNA, 25 bp, Mus musculus
tctcaacaagcacttggcttttact

SEQ ID NO: 972222 - DNA, 25 bp, Mus musculus
tctcaacaagccacggcagctcttt

SEQ ID NO: 972223 - DNA, 25 bp, Mus musculus
tctcaacaaggacttggcttttact

SEQ ID NO: 972224 - DNA, 25 bp, Mus musculus
tctcaacaaggcacggcagctcttt

SEQ ID NO: 972225 - DNA, 25 bp, Mus musculus
tctcaacattagctcccatttggaa

SEQ ID NO: 972226 - DNA, 25 bp, Mus musculus
tctcaacattaggtcccatttggaa

SEQ ID NO: 972227 - DNA, 25 bp, Mus musculus
tctcaacccaatcagtattttcatg

SEQ ID NO: 972228 - DNA, 25 bp, Mus musculus
tctcaacccattcagtattttcatg

SEQ ID NO: 972229 - DNA, 25 bp, Mus musculus
tctcaaccctcgactcttctgtcgg

SEQ ID NO: 972230 - DNA, 25 bp, Mus musculus
tctcaaccctcgtctcttctgtcgg

SEQ ID NO: 972231 - DNA, 25 bp, Mus musculus
tctcaactgccacaaccttgtgcgc

SEQ ID NO: 972232 - DNA, 25 bp, Mus musculus
tctcaactgccagaaccttgtgcgc

SEQ ID NO: 972233 - DNA, 25 bp, Mus musculus
tctcaactggctcatgcttgacttc

SEQ ID NO: 972234 - DNA, 25 bp, Mus musculus
tctcaactggctgatgcttgacttc

SEQ ID NO: 972235 - DNA, 25 bp, Mus musculus
tctcaagcctgccgacttgactgcg

SEQ ID NO: 972236 - DNA, 25 bp, Mus musculus
tctcaagcctgcggacttgactgcg

SEQ ID NO: 972237 - DNA, 25 bp, Mus musculus
tctcaaggcaagataggaaaaattt

SEQ ID NO: 972238 - DNA, 25 bp, Mus musculus
tctcaaggcaagttaggaaaaattt

SEQ ID NO: 972239 - DNA, 25 bp, Mus musculus
tctcacaactattgttcactctgta

SEQ ID NO: 972240 - DNA, 25 bp, Mus musculus
tctcacaacttttgttcactctgta

SEQ ID NO: 972241 - DNA, 25 bp, Mus musculus
tctcacaaggcataagcgtcttgta

SEQ ID NO: 972242 - DNA, 25 bp, Mus musculus
tctcacaagggataagcgtcttgta

SEQ ID NO: 972243 - DNA, 25 bp, Mus musculus
tctcacaatgagtcctactgaaacc

SEQ ID NO: 972244 - DNA, 25 bp, Mus musculus
tctcacaatgctctgtcagaaacga

SEQ ID NO: 972245 - DNA, 25 bp, Mus musculus
tctcacaatggtctgtcagaaacga

SEQ ID NO: 972246 - DNA, 25 bp, Mus musculus
tctcacaatgtgtcctactgaaacc

SEQ ID NO: 972247 - DNA, 25 bp, Mus musculus
tctcacacacttaactatgaagagc

SEQ ID NO: 972248 - DNA, 25 bp, Mus musculus
tctcacacacttaagtatgaagagc

SEQ ID NO: 972249 - DNA, 25 bp, Mus musculus
tctcacactcagcggacaattcaag

SEQ ID NO: 972250 - DNA, 25 bp, Mus musculus
tctcacactcaggggacaattcaag

SEQ ID NO: 972251 - DNA, 25 bp, Mus musculus
tctcacagctctcgagatggtgaaa

SEQ ID NO: 972252 - DNA, 25 bp, Mus musculus
tctcacagctctggagatggtgaaa

SEQ ID NO: 972253 - DNA, 25 bp, Mus musculus
tctcacatggagaaactgctgtcat

SEQ ID NO: 972254 - DNA, 25 bp, Mus musculus
tctcacatggagtaactgctgtcat

SEQ ID NO: 972255 - DNA, 25 bp, Mus musculus
tctcaccatagccaccacagcgctg

SEQ ID NO: 972256 - DNA, 25 bp, Mus musculus
tctcaccatagccagcacagcgctg

SEQ ID NO: 972257 - DNA, 25 bp, Mus musculus
tctcacccagcatgagtttcatcct

SEQ ID NO: 972258 - DNA, 25 bp, Mus musculus
tctcacccaggacatcttcagaaca

SEQ ID NO: 972259 - DNA, 25 bp, Mus musculus
tctcacccaggacatggagttccag

SEQ ID NO: 972260 - DNA, 25 bp, Mus musculus
tctcacccaggagatcttcagaaca

SEQ ID NO: 972261 - DNA, 25 bp, Mus musculus
tctcacccaggagatggagttccag

SEQ ID NO: 972262 - DNA, 25 bp, Mus musculus
tctcacccaggatgagtttcatcct

SEQ ID NO: 972263 - DNA, 25 bp, Mus musculus
tctcaccctacacgatagaattttt

SEQ ID NO: 972264 - DNA, 25 bp, Mus musculus
tctcaccctacaggatagaattttt

SEQ ID NO: 972265 - DNA, 25 bp, Mus musculus
tctcaccgccctgcccaggagttgg

SEQ ID NO: 972266 - DNA, 25 bp, Mus musculus
tctcaccgccgtgcccaggagttgg

SEQ ID NO: 972267 - DNA, 25 bp, Mus musculus
tctcaccggcaacgtgatgcttctt

SEQ ID NO: 972268 - DNA, 25 bp, Mus musculus
tctcaccggcaaggtgatgcttctt

SEQ ID NO: 972269 - DNA, 25 bp, Mus musculus
tctcacctacacccaatacaagcag

SEQ ID NO: 972270 - DNA, 25 bp, Mus musculus
tctcacctacaccctatacaagcag

SEQ ID NO: 972271 - DNA, 25 bp, Mus musculus
tctcacgtgcacgccagaaagccaa

SEQ ID NO: 972272 - DNA, 25 bp, Mus musculus
tctcacgtgcacgcgagaaagccaa

SEQ ID NO: 972273 - DNA, 25 bp, Mus musculus
tctcactacggacgtgcatcctgag

SEQ ID NO: 972274 - DNA, 25 bp, Mus musculus
tctcactacggaggtgcatcctgag

SEQ ID NO: 972275 - DNA, 25 bp, Mus musculus
tctcacttcaccactggagatggga

SEQ ID NO: 972276 - DNA, 25 bp, Mus musculus
tctcacttcacctctggagatggga

SEQ ID NO: 972277 - DNA, 25 bp, Mus musculus
tctcacttcgtgacatcaccgcaaa

SEQ ID NO: 972278 - DNA, 25 bp, Mus musculus
tctcacttcgtgtcatcaccgcaaa

SEQ ID NO: 972279 - DNA, 25 bp, Mus musculus
tctcagaaaatgcctcctcggtggc

SEQ ID NO: 972280 - DNA, 25 bp, Mus musculus
tctcagaaaatggctcctcggtggc

SEQ ID NO: 972281 - DNA, 25 bp, Mus musculus
tctcagaaaccaagtgcgagcgcac

SEQ ID NO: 972282 - DNA, 25 bp, Mus musculus
tctcagaaacgaagtgcgagcgcac

SEQ ID NO: 972283 - DNA, 25 bp, Mus musculus
tctcagaaggcaaatgtgccgagct

SEQ ID NO: 972284 - DNA, 25 bp, Mus musculus
tctcagaaggccaagttcgacagct

SEQ ID NO: 972285 - DNA, 25 bp, Mus musculus
tctcagaagggaaatgtgccgagct

SEQ ID NO: 972286 - DNA, 25 bp, Mus musculus
tctcagaagggcaagttcgacagct

SEQ ID NO: 972287 - DNA, 25 bp, Mus musculus
tctcagacagctgtttgcccaactc

SEQ ID NO: 972288 - DNA, 25 bp, Mus musculus
tctcagacaggtgtttgcccaactc

SEQ ID NO: 972289 - DNA, 25 bp, Mus musculus
tctcagagacaaatttggggatgct

SEQ ID NO: 972290 - DNA, 25 bp, Mus musculus
tctcagagacaattttggggatgct

SEQ ID NO: 972291 - DNA, 25 bp, Mus musculus
tctcagagacagcaaacctatttca

SEQ ID NO: 972292 - DNA, 25 bp, Mus musculus
tctcagagacaggaaacctatttca

SEQ ID NO: 972293 - DNA, 25 bp, Mus musculus
tctcagagctctggcagctcagcag

SEQ ID NO: 972294 - DNA, 25 bp, Mus musculus
tctcagagctgtggcagctcagcag

SEQ ID NO: 972295 - DNA, 25 bp, Mus musculus
tctcagcagatgatcctctaggcac

SEQ ID NO: 972296 - DNA, 25 bp, Mus musculus
tctcagcagatgttcctctaggcac

SEQ ID NO: 972297 - DNA, 25 bp, Mus musculus
tctcagcagctcccaaattcgatgg

SEQ ID NO: 972298 - DNA, 25 bp, Mus musculus
tctcagcagctcgcaaattcgatgg

SEQ ID NO: 972299 - DNA, 25 bp, Mus musculus
tctcagcagctgagtcagctgtggt

SEQ ID NO: 972300 - DNA, 25 bp, Mus musculus
tctcagcagctgtgtcagctgtggt

SEQ ID NO: 972301 - DNA, 25 bp, Mus musculus
tctcagcattagccctggttcccaa

SEQ ID NO: 972302 - DNA, 25 bp, Mus musculus
tctcagcatttgccctggttcccaa

SEQ ID NO: 972303 - DNA, 25 bp, Mus musculus
tctcagccccagctcgtgccccctt

SEQ ID NO: 972304 - DNA, 25 bp, Mus musculus
tctcagccccagctggtgccccctt

SEQ ID NO: 972305 - DNA, 25 bp, Mus musculus
tctcagcgctgacacgtacagagct

SEQ ID NO: 972306 - DNA, 25 bp, Mus musculus
tctcagcgctgacaggtacagagct

SEQ ID NO: 972307 - DNA, 25 bp, Mus musculus
tctcagctcaagcgcaaatgactca

SEQ ID NO: 972308 - DNA, 25 bp, Mus musculus
tctcagctcaagggcaaatgactca

SEQ ID NO: 972309 - DNA, 25 bp, Mus musculus
tctcagctcagcatcaaagccgggc

SEQ ID NO: 972310 - DNA, 25 bp, Mus musculus
tctcagctcagcatgaaagccgggc

SEQ ID NO: 972311 - DNA, 25 bp, Mus musculus
tctcaggaatggaacgcaaacagtt

SEQ ID NO: 972312 - DNA, 25 bp, Mus musculus
tctcaggaatggaaggcaaacagtt

SEQ ID NO: 972313 - DNA, 25 bp, Mus musculus
tctcaggaccagctagattccataa

SEQ ID NO: 972314 - DNA, 25 bp, Mus musculus
tctcaggaccaggtagattccataa

SEQ ID NO: 972315 - DNA, 25 bp, Mus musculus
tctcaggcaccacgttcctccaaca

SEQ ID NO: 972316 - DNA, 25 bp, Mus musculus
tctcaggcaccaggttcctccaaca

SEQ ID NO: 972317 - DNA, 25 bp, Mus musculus
tctcaggctctgcgagttggaaccc

SEQ ID NO: 972318 - DNA, 25 bp, Mus musculus
tctcaggctctgggagttggaaccc

SEQ ID NO: 972319 - DNA, 25 bp, Mus musculus
tctcagggaaaaccacagagctgat

SEQ ID NO: 972320 - DNA, 25 bp, Mus musculus
tctcagggaaaacgaacaccatgga

SEQ ID NO: 972321 - DNA, 25 bp, Mus musculus
tctcagggaaaagcacagagctgat

SEQ ID NO: 972322 - DNA, 25 bp, Mus musculus
tctcagggaaaaggaacaccatgga

SEQ ID NO: 972323 - DNA, 25 bp, Mus musculus
tctcagggagtgctggccgcacagc

SEQ ID NO: 972324 - DNA, 25 bp, Mus musculus
tctcagggagtggtggccgcacagc

SEQ ID NO: 972325 - DNA, 25 bp, Mus musculus
tctcaggttttgcctaccggctctc

SEQ ID NO: 972326 - DNA, 25 bp, Mus musculus
tctcaggttttggctaccggctctc

SEQ ID NO: 972327 - DNA, 25 bp, Mus musculus
tctcagtgaagactcacatactcac

SEQ ID NO: 972328 - DNA, 25 bp, Mus musculus
tctcagtgaagagtcacatactcac

SEQ ID NO: 972329 - DNA, 25 bp, Mus musculus
tctcagtgctggcttttcagagcac

SEQ ID NO: 972330 - DNA, 25 bp, Mus musculus
tctcagtgctgggttttcagagcac

SEQ ID NO: 972331 - DNA, 25 bp, Mus musculus
tctcagtggcacaatgccagctgat

SEQ ID NO: 972332 - DNA, 25 bp, Mus musculus
tctcagtggcactatgccagctgat

SEQ ID NO: 972333 - DNA, 25 bp, Mus musculus
tctcagtgtcagattctcagcaggt

SEQ ID NO: 972334 - DNA, 25 bp, Mus musculus
tctcagtgtcagtttctcagcaggt

SEQ ID NO: 972335 - DNA, 25 bp, Mus musculus
tctcataaacagatcatggaaaatg

SEQ ID NO: 972336 - DNA, 25 bp, Mus musculus
tctcataaacagttcatggaaaatg

SEQ ID NO: 972337 - DNA, 25 bp, Mus musculus
tctcatagctgtctcgtttgtggac

SEQ ID NO: 972338 - DNA, 25 bp, Mus musculus
tctcatagctgtctggtttgtggac

SEQ ID NO: 972339 - DNA, 25 bp, Mus musculus
tctcatcaaagacgtcgggttccct

SEQ ID NO: 972340 - DNA, 25 bp, Mus musculus
tctcatcaaagaggtcgggttccct

SEQ ID NO: 972341 - DNA, 25 bp, Mus musculus
tctcatcaaattcgacaagacagtg

SEQ ID NO: 972342 - DNA, 25 bp, Mus musculus
tctcatcaaattggacaagacagtg

SEQ ID NO: 972343 - DNA, 25 bp, Mus musculus
tctcatcacagccacgaagtcacct

SEQ ID NO: 972344 - DNA, 25 bp, Mus musculus
tctcatcacagccaggaagtcacct

SEQ ID NO: 972345 - DNA, 25 bp, Mus musculus
tctcatcacgctgctggcatcaagg

SEQ ID NO: 972346 - DNA, 25 bp, Mus musculus
tctcatcacggtgctggcatcaagg

SEQ ID NO: 972347 - DNA, 25 bp, Mus musculus
tctcatcagcattgacctcatcgtt

SEQ ID NO: 972348 - DNA, 25 bp, Mus musculus
tctcatcagcattgtcctcatcgtt

SEQ ID NO: 972349 - DNA, 25 bp, Mus musculus
tctcatccagctcagattgtcaagc

SEQ ID NO: 972350 - DNA, 25 bp, Mus musculus
tctcatccaggtcagattgtcaagc

SEQ ID NO: 972351 - DNA, 25 bp, Mus musculus
tctcatccagtctccaaagaactgt

SEQ ID NO: 972352 - DNA, 25 bp, Mus musculus
tctcatccagtctcgaaagaactgt

SEQ ID NO: 972353 - DNA, 25 bp, Mus musculus
tctcatccgctgagacccatgcgga

SEQ ID NO: 972354 - DNA, 25 bp, Mus musculus
tctcatccgctgagatgctggtgga

SEQ ID NO: 972355 - DNA, 25 bp, Mus musculus
tctcatccgctgtgacccatgcgga

SEQ ID NO: 972356 - DNA, 25 bp, Mus musculus
tctcatccgctgtgatgctggtgga

SEQ ID NO: 972357 - DNA, 25 bp, Mus musculus
tctcatcctcagatatcagcctgat

SEQ ID NO: 972358 - DNA, 25 bp, Mus musculus
tctcatcctcagttatcagcctgat

SEQ ID NO: 972359 - DNA, 25 bp, Mus musculus
tctcatcctgaatgcagcctggctt

SEQ ID NO: 972360 - DNA, 25 bp, Mus musculus
tctcatcctgtatgcagcctggctt

SEQ ID NO: 972361 - DNA, 25 bp, Mus musculus
tctcatctccaacttcaagtcgccg

SEQ ID NO: 972362 - DNA, 25 bp, Mus musculus
tctcatctccaagttcaagtcgccg

SEQ ID NO: 972363 - DNA, 25 bp, Mus musculus
tctcatcttgagaacccagcagtga

SEQ ID NO: 972364 - DNA, 25 bp, Mus musculus
tctcatcttgagtacccagcagtga

SEQ ID NO: 972365 - DNA, 25 bp, Mus musculus
tctcatgcagatcccagtcaagtat

SEQ ID NO: 972366 - DNA, 25 bp, Mus musculus
tctcatgcagccctatcgctggatg

SEQ ID NO: 972367 - DNA, 25 bp, Mus musculus
tctcatgcaggcctatcgctggatg

SEQ ID NO: 972368 - DNA, 25 bp, Mus musculus
tctcatgcagttcccagtcaagtat

SEQ ID NO: 972369 - DNA, 25 bp, Mus musculus
tctcatgtgcatctccatgctgtgg

SEQ ID NO: 972370 - DNA, 25 bp, Mus musculus
tctcatgtgcatcttcatgacttgc

SEQ ID NO: 972371 - DNA, 25 bp, Mus musculus
tctcatgtgcatgtccatgctgtgg

SEQ ID NO: 972372 - DNA, 25 bp, Mus musculus
tctcatgtgcatgttcatgacttgc

SEQ ID NO: 972373 - DNA, 25 bp, Mus musculus
tctcattaagctaaatgaccgtcgg

SEQ ID NO: 972374 - DNA, 25 bp, Mus musculus
tctcattaaggtaaatgaccgtcgg

SEQ ID NO: 972375 - DNA, 25 bp, Mus musculus
tctcattcctccagctacactcctc

SEQ ID NO: 972376 - DNA, 25 bp, Mus musculus
tctcattcctcctgctacactcctc

SEQ ID NO: 972377 - DNA, 25 bp, Mus musculus
tctcattctgcacggcagagtcgag

SEQ ID NO: 972378 - DNA, 25 bp, Mus musculus
tctcattctgcagggcagagtcgag

SEQ ID NO: 972379 - DNA, 25 bp, Mus musculus
tctcattgagccttatgtaaacatg

SEQ ID NO: 972380 - DNA, 25 bp, Mus musculus
tctcattgaggcttatgtaaacatg

SEQ ID NO: 972381 - DNA, 25 bp, Mus musculus
tctcatttggatcgcaccacccctg

SEQ ID NO: 972382 - DNA, 25 bp, Mus musculus
tctcatttggatggcaccacccctg

SEQ ID NO: 972383 - DNA, 25 bp, Mus musculus
tctccaaaatcaacaacacccacgc

SEQ ID NO: 972384 - DNA, 25 bp, Mus musculus
tctccaaaatcaactacacccacgc

SEQ ID NO: 972385 - DNA, 25 bp, Mus musculus
tctccaaacctcagaggccagagca

SEQ ID NO: 972386 - DNA, 25 bp, Mus musculus
tctccaaacctctgaggccagagca

SEQ ID NO: 972387 - DNA, 25 bp, Mus musculus
tctccaaattatctgccaccaaaag

SEQ ID NO: 972388 - DNA, 25 bp, Mus musculus
tctccaaattatgtgccaccaaaag

SEQ ID NO: 972389 - DNA, 25 bp, Mus musculus
tctccaaccaagccatcctcggaga

SEQ ID NO: 972390 - DNA, 25 bp, Mus musculus
tctccaaccaagctatcatgtttgt

SEQ ID NO: 972391 - DNA, 25 bp, Mus musculus
tctccaaccaaggcatcctcggaga

SEQ ID NO: 972392 - DNA, 25 bp, Mus musculus
tctccaaccaaggtatcatgtttgt

SEQ ID NO: 972393 - DNA, 25 bp, Mus musculus
tctccaacgagctacatgatcccga

SEQ ID NO: 972394 - DNA, 25 bp, Mus musculus
tctccaacgagctagatgatcccga

SEQ ID NO: 972395 - DNA, 25 bp, Mus musculus
tctccaacgtggaaccagcctgtga

SEQ ID NO: 972396 - DNA, 25 bp, Mus musculus
tctccaacgtggaacccctctgctc

SEQ ID NO: 972397 - DNA, 25 bp, Mus musculus
tctccaacgtggaagcagcctgtga

SEQ ID NO: 972398 - DNA, 25 bp, Mus musculus
tctccaacgtggaagccctctgctc

SEQ ID NO: 972399 - DNA, 25 bp, Mus musculus
tctccaagaatgctcctggcactgt

SEQ ID NO: 972400 - DNA, 25 bp, Mus musculus
tctccaagaatggtcctggcactgt

SEQ ID NO: 972401 - DNA, 25 bp, Mus musculus
tctccaagcgctcgaacttccccag

SEQ ID NO: 972402 - DNA, 25 bp, Mus musculus
tctccaagcgctggaacttccccag

SEQ ID NO: 972403 - DNA, 25 bp, Mus musculus
tctccaagtatgaaggaggagtaaa

SEQ ID NO: 972404 - DNA, 25 bp, Mus musculus
tctccaagtatgaaggaggagtaga

SEQ ID NO: 972405 - DNA, 25 bp, Mus musculus
tctccaagtatgtaggaggagtaaa

SEQ ID NO: 972406 - DNA, 25 bp, Mus musculus
tctccaagtatgtaggaggagtaga

SEQ ID NO: 972407 - DNA, 25 bp, Mus musculus
tctccaatgacaaatttgagtatct

SEQ ID NO: 972408 - DNA, 25 bp, Mus musculus
tctccaatgacatatttgagtatct

SEQ ID NO: 972409 - DNA, 25 bp, Mus musculus
tctccaatgctgctgtctctgtcaa

SEQ ID NO: 972410 - DNA, 25 bp, Mus musculus
tctccaatgctggtgtctctgtcaa

SEQ ID NO: 972411 - DNA, 25 bp, Mus musculus
tctccacaagctgctgctgctcctc

SEQ ID NO: 972412 - DNA, 25 bp, Mus musculus
tctccacaaggtgctgctgctcctc

SEQ ID NO: 972413 - DNA, 25 bp, Mus musculus
tctccacaggatggctcccagcctg

SEQ ID NO: 972414 - DNA, 25 bp, Mus musculus
tctccacaggatgggtcccagcctg

SEQ ID NO: 972415 - DNA, 25 bp, Mus musculus
tctccacagtcactggagagtcagg

SEQ ID NO: 972416 - DNA, 25 bp, Mus musculus
tctccacagtcagtggagagtcagg

SEQ ID NO: 972417 - DNA, 25 bp, Mus musculus
tctccaccaccacgtttcctgctga

SEQ ID NO: 972418 - DNA, 25 bp, Mus musculus
tctccaccaccaggtttcctgctga

SEQ ID NO: 972419 - DNA, 25 bp, Mus musculus
tctccaccagcacatggatttgatt

SEQ ID NO: 972420 - DNA, 25 bp, Mus musculus
tctccaccaggacatggatttgatt

SEQ ID NO: 972421 - DNA, 25 bp, Mus musculus
tctccacctccactggtgtcttcca

SEQ ID NO: 972422 - DNA, 25 bp, Mus musculus
tctccacctccagtggtgtcttcca

SEQ ID NO: 972423 - DNA, 25 bp, Mus musculus
tctccacgaacaagtgcaccaggga

SEQ ID NO: 972424 - DNA, 25 bp, Mus musculus
tctccacgaacatgtgcaccaggga

SEQ ID NO: 972425 - DNA, 25 bp, Mus musculus
tctccactgcaacgaccgctactcc

SEQ ID NO: 972426 - DNA, 25 bp, Mus musculus
tctccactgcaaggaccgctactcc

SEQ ID NO: 972427 - DNA, 25 bp, Mus musculus
tctccacttccgccctggaggtgta

SEQ ID NO: 972428 - DNA, 25 bp, Mus musculus
tctccacttccggcctggaggtgta

SEQ ID NO: 972429 - DNA, 25 bp, Mus musculus
tctccagaagaggaggaggtggaaa

SEQ ID NO: 972430 - DNA, 25 bp, Mus musculus
tctccagaagctagtgtctcgctgc

SEQ ID NO: 972431 - DNA, 25 bp, Mus musculus
tctccagaaggtagtgtctcgctgc

SEQ ID NO: 972432 - DNA, 25 bp, Mus musculus
tctccagaagtggaggaggtggaaa

SEQ ID NO: 972433 - DNA, 25 bp, Mus musculus
tctccagacatgcagacaacagctt

SEQ ID NO: 972434 - DNA, 25 bp, Mus musculus
tctccagacatggagacaacagctt

SEQ ID NO: 972435 - DNA, 25 bp, Mus musculus
tctccagacctgcctgcccagaccc

SEQ ID NO: 972436 - DNA, 25 bp, Mus musculus
tctccagacctggctgcccagaccc

SEQ ID NO: 972437 - DNA, 25 bp, Mus musculus
tctccagcagaactaaagaacgctt

SEQ ID NO: 972438 - DNA, 25 bp, Mus musculus
tctccagcagaagtaaagaacgctt

SEQ ID NO: 972439 - DNA, 25 bp, Mus musculus
tctccagcagcaagagccagaggga

SEQ ID NO: 972440 - DNA, 25 bp, Mus musculus
tctccagcagcacccaacctcctgc

SEQ ID NO: 972441 - DNA, 25 bp, Mus musculus
tctccagcagctcaatgagacatgt

SEQ ID NO: 972442 - DNA, 25 bp, Mus musculus
tctccagcagctcattgagacatgt

SEQ ID NO: 972443 - DNA, 25 bp, Mus musculus
tctccagcaggaagagccagaggga

SEQ ID NO: 972444 - DNA, 25 bp, Mus musculus
tctccagcaggacccaacctcctgc

SEQ ID NO: 972445 - DNA, 25 bp, Mus musculus
tctccagccaaatctggcaccaatt

SEQ ID NO: 972446 - DNA, 25 bp, Mus musculus
tctccagccacgctgcttctgatgc

SEQ ID NO: 972447 - DNA, 25 bp, Mus musculus
tctccagccactgaggatcccattt

SEQ ID NO: 972448 - DNA, 25 bp, Mus musculus
tctccagccaggctgcttctgatgc

SEQ ID NO: 972449 - DNA, 25 bp, Mus musculus
tctccagccagtgaggatcccattt

SEQ ID NO: 972450 - DNA, 25 bp, Mus musculus
tctccagccatatctggcaccaatt

SEQ ID NO: 972451 - DNA, 25 bp, Mus musculus
tctccagcggctgaaactgaatcac

SEQ ID NO: 972452 - DNA, 25 bp, Mus musculus
tctccagcggctgatactgaatcac

SEQ ID NO: 972453 - DNA, 25 bp, Mus musculus
tctccaggaaagatattctgaaaga

SEQ ID NO: 972454 - DNA, 25 bp, Mus musculus
tctccaggaaagttattctgaaaga

SEQ ID NO: 972455 - DNA, 25 bp, Mus musculus
tctccaggaagccacgtctttggcc

SEQ ID NO: 972456 - DNA, 25 bp, Mus musculus
tctccaggaagccaggtctttggcc

SEQ ID NO: 972457 - DNA, 25 bp, Mus musculus
tctccaggctctacttctgttcata

SEQ ID NO: 972458 - DNA, 25 bp, Mus musculus
tctccaggctctcggaccctgaaag

SEQ ID NO: 972459 - DNA, 25 bp, Mus musculus
tctccaggctctgggaccctgaaag

SEQ ID NO: 972460 - DNA, 25 bp, Mus musculus
tctccaggctcttcttctgttcata

SEQ ID NO: 972461 - DNA, 25 bp, Mus musculus
tctccagtaaacccagtgatcaggt

SEQ ID NO: 972462 - DNA, 25 bp, Mus musculus
tctccagtaaaccctgtgatcaggt

SEQ ID NO: 972463 - DNA, 25 bp, Mus musculus
tctccagttatgcttctccagggca

SEQ ID NO: 972464 - DNA, 25 bp, Mus musculus
tctccagttatggttctccagggca

SEQ ID NO: 972465 - DNA, 25 bp, Mus musculus
tctccatcaatacacgtccaaaagg

SEQ ID NO: 972466 - DNA, 25 bp, Mus musculus
tctccatcaatacaggtccaaaagg

SEQ ID NO: 972467 - DNA, 25 bp, Mus musculus
tctccatcagaatccaagagaaaag

SEQ ID NO: 972468 - DNA, 25 bp, Mus musculus
tctccatcagcgcatccagagacgg

SEQ ID NO: 972469 - DNA, 25 bp, Mus musculus
tctccatcagctttctttcttgttc

SEQ ID NO: 972470 - DNA, 25 bp, Mus musculus
tctccatcagggcatccagagacgg

SEQ ID NO: 972471 - DNA, 25 bp, Mus musculus
tctccatcaggtttctttcttgttc

SEQ ID NO: 972472 - DNA, 25 bp, Mus musculus
tctccatcagtatccaagagaaaag

SEQ ID NO: 972473 - DNA, 25 bp, Mus musculus
tctccatcggatacagtagcgtaag

SEQ ID NO: 972474 - DNA, 25 bp, Mus musculus
tctccatcggttacagtagcgtaag

SEQ ID NO: 972475 - DNA, 25 bp, Mus musculus
tctccatctatacatcttaccaata

SEQ ID NO: 972476 - DNA, 25 bp, Mus musculus
tctccatctatacgattcatgaata

SEQ ID NO: 972477 - DNA, 25 bp, Mus musculus
tctccatctatagatcttaccaata

SEQ ID NO: 972478 - DNA, 25 bp, Mus musculus
tctccatctataggattcatgaata

SEQ ID NO: 972479 - DNA, 25 bp, Mus musculus
tctccatctgcaaaagttcctttta

SEQ ID NO: 972480 - DNA, 25 bp, Mus musculus
tctccatctggaaaagttcctttta

SEQ ID NO: 972481 - DNA, 25 bp, Mus musculus
tctccatggacacactacagatgct

SEQ ID NO: 972482 - DNA, 25 bp, Mus musculus
tctccatggacagactacagatgct

SEQ ID NO: 972483 - DNA, 25 bp, Mus musculus
tctcccaaaaagactcctcatcttg

SEQ ID NO: 972484 - DNA, 25 bp, Mus musculus
tctcccaaaaagtctcctcatcttg

SEQ ID NO: 972485 - DNA, 25 bp, Mus musculus
tctcccaaagagagtccctccagta

SEQ ID NO: 972486 - DNA, 25 bp, Mus musculus
tctcccaaagagtgtccctccagta

SEQ ID NO: 972487 - DNA, 25 bp, Mus musculus
tctcccaatgccagtgcggccgcgg

SEQ ID NO: 972488 - DNA, 25 bp, Mus musculus
tctcccaatgcctgtgcggccgcgg

SEQ ID NO: 972489 - DNA, 25 bp, Mus musculus
tctcccacagaaatcctgcacaatg

SEQ ID NO: 972490 - DNA, 25 bp, Mus musculus
tctcccacagaaatgctgcacaatg

SEQ ID NO: 972491 - DNA, 25 bp, Mus musculus
tctcccaccgagatatgaatcaaat

SEQ ID NO: 972492 - DNA, 25 bp, Mus musculus
tctcccaccgtgatatgaatcaaat

SEQ ID NO: 972493 - DNA, 25 bp, Mus musculus
tctcccacgtcactcctaggaaagg

SEQ ID NO: 972494 - DNA, 25 bp, Mus musculus
tctcccacgtcagtcctaggaaagg

SEQ ID NO: 972495 - DNA, 25 bp, Mus musculus
tctcccactctcctcggctgcaact

SEQ ID NO: 972496 - DNA, 25 bp, Mus musculus
tctcccactctcctgggctgcaact

SEQ ID NO: 972497 - DNA, 25 bp, Mus musculus
tctcccagatcgcacctacagaacc

SEQ ID NO: 972498 - DNA, 25 bp, Mus musculus
tctcccagatcgcagctacagaacc

SEQ ID NO: 972499 - DNA, 25 bp, Mus musculus
tctcccattgggctgtacacatctg

SEQ ID NO: 972500 - DNA, 25 bp, Mus musculus
tctcccattggggtgtacacatctg

SEQ ID NO: 972501 - DNA, 25 bp, Mus musculus
tctccccaagacacagacgtgttct

SEQ ID NO: 972502 - DNA, 25 bp, Mus musculus
tctccccaagacactgacgtgttct

SEQ ID NO: 972503 - DNA, 25 bp, Mus musculus
tctccccgagattctgaagtatgtg

SEQ ID NO: 972504 - DNA, 25 bp, Mus musculus
tctccccgagtttctgaagtatgtg

SEQ ID NO: 972505 - DNA, 25 bp, Mus musculus
tctcccctctcttgcaggtgcaatt

SEQ ID NO: 972506 - DNA, 25 bp, Mus musculus
tctcccctctcttggaggtgcaatt

SEQ ID NO: 972507 - DNA, 25 bp, Mus musculus
tctcccgctgcacgtggaaagcaag

SEQ ID NO: 972508 - DNA, 25 bp, Mus musculus
tctcccgctgcaggtggaaagcaag

SEQ ID NO: 972509 - DNA, 25 bp, Mus musculus
tctcccggctctgtcgtgccttagc

SEQ ID NO: 972510 - DNA, 25 bp, Mus musculus
tctcccggctctgtggtgccttagc

SEQ ID NO: 972511 - DNA, 25 bp, Mus musculus
tctcccgtggtgcgaaagaaaaagt

SEQ ID NO: 972512 - DNA, 25 bp, Mus musculus
tctcccgtggtgcgtaagaaaaagt

SEQ ID NO: 972513 - DNA, 25 bp, Mus musculus
tctccctacccacccacttgaacct

SEQ ID NO: 972514 - DNA, 25 bp, Mus musculus
tctccctacccagccacttgaacct

SEQ ID NO: 972515 - DNA, 25 bp, Mus musculus
tctccctggcattacggcaggctgg

SEQ ID NO: 972516 - DNA, 25 bp, Mus musculus
tctccctggcattactacactgtag

SEQ ID NO: 972517 - DNA, 25 bp, Mus musculus
tctccctggcattagggcaggctgg

SEQ ID NO: 972518 - DNA, 25 bp, Mus musculus
tctccctggcattagtacactgtag

SEQ ID NO: 972519 - DNA, 25 bp, Mus musculus
tctcccttaatgctgtctccaagcc

SEQ ID NO: 972520 - DNA, 25 bp, Mus musculus
tctcccttaatggtgtctccaagcc

SEQ ID NO: 972521 - DNA, 25 bp, Mus musculus
tctccgagagagcaatcaactatga

SEQ ID NO: 972522 - DNA, 25 bp, Mus musculus
tctccgagagtgcaatcaactatga

SEQ ID NO: 972523 - DNA, 25 bp, Mus musculus
tctccgaggagctaatcagtgagat

SEQ ID NO: 972524 - DNA, 25 bp, Mus musculus
tctccgaggagctaattctgaagtc

SEQ ID NO: 972525 - DNA, 25 bp, Mus musculus
tctccgaggagctattcagtgagat

SEQ ID NO: 972526 - DNA, 25 bp, Mus musculus
tctccgaggagctatttctgaagtc

SEQ ID NO: 972527 - DNA, 25 bp, Mus musculus
tctccgatccaacacaccctcagga

SEQ ID NO: 972528 - DNA, 25 bp, Mus musculus
tctccgatccaacagaccctcagga

SEQ ID NO: 972529 - DNA, 25 bp, Mus musculus
tctccgcagcagattacaatctgta

SEQ ID NO: 972530 - DNA, 25 bp, Mus musculus
tctccgcagcagcatgagccggcag

SEQ ID NO: 972531 - DNA, 25 bp, Mus musculus
tctccgcagcaggatgagccggcag

SEQ ID NO: 972532 - DNA, 25 bp, Mus musculus
tctccgcagcagtttacaatctgta

SEQ ID NO: 972533 - DNA, 25 bp, Mus musculus
tctccgcccacacagatgagccgcc

SEQ ID NO: 972534 - DNA, 25 bp, Mus musculus
tctccgcccacagagatgagccgcc

SEQ ID NO: 972535 - DNA, 25 bp, Mus musculus
tctccgctcaaacgttgatgaagct

SEQ ID NO: 972536 - DNA, 25 bp, Mus musculus
tctccgctcaaaggttgatgaagct

SEQ ID NO: 972537 - DNA, 25 bp, Mus musculus
tctccgtaagatcggaaatccacag

SEQ ID NO: 972538 - DNA, 25 bp, Mus musculus
tctccgtaagatgggaaatccacag

SEQ ID NO: 972539 - DNA, 25 bp, Mus musculus
tctccgtgactgactcatctgaagg

SEQ ID NO: 972540 - DNA, 25 bp, Mus musculus
tctccgtgactgtctcatctgaagg

SEQ ID NO: 972541 - DNA, 25 bp, Mus musculus
tctccgttgtctcagctaccaaggg

SEQ ID NO: 972542 - DNA, 25 bp, Mus musculus
tctccgttgtctctaccaagggggt

SEQ ID NO: 972543 - DNA, 25 bp, Mus musculus
tctccgttgtctgagctaccaaggg

SEQ ID NO: 972544 - DNA, 25 bp, Mus musculus
tctccgttgtctgtaccaagggggt

SEQ ID NO: 972545 - DNA, 25 bp, Mus musculus
tctcctaaagagctcagcttggact

SEQ ID NO: 972546 - DNA, 25 bp, Mus musculus
tctcctaaagaggtcagcttggact

SEQ ID NO: 972547 - DNA, 25 bp, Mus musculus
tctcctaaagcaactgaaccatccg

SEQ ID NO: 972548 - DNA, 25 bp, Mus musculus
tctcctaaaggaactgaaccatccg

SEQ ID NO: 972549 - DNA, 25 bp, Mus musculus
tctcctacactgcgctcctccacca

SEQ ID NO: 972550 - DNA, 25 bp, Mus musculus
tctcctacactgggctcctccacca

SEQ ID NO: 972551 - DNA, 25 bp, Mus musculus
tctcctacgtcattcgtacagccag

SEQ ID NO: 972552 - DNA, 25 bp, Mus musculus
tctcctacgtcattggtacagccag

SEQ ID NO: 972553 - DNA, 25 bp, Mus musculus
tctcctagtgagcttgtccaggtga

SEQ ID NO: 972554 - DNA, 25 bp, Mus musculus
tctcctagtgaggttgtccaggtga

SEQ ID NO: 972555 - DNA, 25 bp, Mus musculus
tctcctatccagcaggagagcattc

SEQ ID NO: 972556 - DNA, 25 bp, Mus musculus
tctcctatccaggaggagagcattc

SEQ ID NO: 972557 - DNA, 25 bp, Mus musculus
tctcctcacagacctcagcgacagc

SEQ ID NO: 972558 - DNA, 25 bp, Mus musculus
tctcctcacagagctcagcgacagc

SEQ ID NO: 972559 - DNA, 25 bp, Mus musculus
tctcctccaaaacctcaggctggct

SEQ ID NO: 972560 - DNA, 25 bp, Mus musculus
tctcctccaaaagctcaggctggct

SEQ ID NO: 972561 - DNA, 25 bp, Mus musculus
tctcctccacagcatatgggagcag

SEQ ID NO: 972562 - DNA, 25 bp, Mus musculus
tctcctccacaggatatgggagcag

SEQ ID NO: 972563 - DNA, 25 bp, Mus musculus
tctcctccagctaaaccggacagcc

SEQ ID NO: 972564 - DNA, 25 bp, Mus musculus
tctcctccaggtaaaccggacagcc

SEQ ID NO: 972565 - DNA, 25 bp, Mus musculus
tctcctccgagagacgtgccgttct

SEQ ID NO: 972566 - DNA, 25 bp, Mus musculus
tctcctccgagagaggtgccgttct

SEQ ID NO: 972567 - DNA, 25 bp, Mus musculus
tctcctccggctagttggaggtgag

SEQ ID NO: 972568 - DNA, 25 bp, Mus musculus
tctcctccggcttgttggaggtgag

SEQ ID NO: 972569 - DNA, 25 bp, Mus musculus
tctcctcctgtccaccaaatctccc

SEQ ID NO: 972570 - DNA, 25 bp, Mus musculus
tctcctcctgtccagcaaatctccc

SEQ ID NO: 972571 - DNA, 25 bp, Mus musculus
tctcctccttggctcgcagcacaga

SEQ ID NO: 972572 - DNA, 25 bp, Mus musculus
tctcctccttggctcggaaaatgac

SEQ ID NO: 972573 - DNA, 25 bp, Mus musculus
tctcctccttggctcggggaagaac

SEQ ID NO: 972574 - DNA, 25 bp, Mus musculus
tctcctccttggctggcagcacaga

SEQ ID NO: 972575 - DNA, 25 bp, Mus musculus
tctcctccttggctgggaaaatgac

SEQ ID NO: 972576 - DNA, 25 bp, Mus musculus
tctcctccttggctgggggaagaac

SEQ ID NO: 972577 - DNA, 25 bp, Mus musculus
tctcctcggcccggcgcagcagggc

SEQ ID NO: 972578 - DNA, 25 bp, Mus musculus
tctcctcggcccggggcagcagggc

SEQ ID NO: 972579 - DNA, 25 bp, Mus musculus
tctcctctaacacgtaccagctcca

SEQ ID NO: 972580 - DNA, 25 bp, Mus musculus
tctcctctaacaggtaccagctcca

SEQ ID NO: 972581 - DNA, 25 bp, Mus musculus
tctcctgaaaccgctgagaagcaga

SEQ ID NO: 972582 - DNA, 25 bp, Mus musculus
tctcctgaaagcgctgagaagcaga

SEQ ID NO: 972583 - DNA, 25 bp, Mus musculus
tctcctgaaatgcctaacatacatg

SEQ ID NO: 972584 - DNA, 25 bp, Mus musculus
tctcctgaaatggctaacatacatg

SEQ ID NO: 972585 - DNA, 25 bp, Mus musculus
tctcctgacatgaaccccccctagg

SEQ ID NO: 972586 - DNA, 25 bp, Mus musculus
tctcctgacatgaagcccccctagg

SEQ ID NO: 972587 - DNA, 25 bp, Mus musculus
tctcctgatgagatggctgctcagc

SEQ ID NO: 972588 - DNA, 25 bp, Mus musculus
tctcctgatgagttggctgctcagc

SEQ ID NO: 972589 - DNA, 25 bp, Mus musculus
tctcctgcaagccacgttttcacac

SEQ ID NO: 972590 - DNA, 25 bp, Mus musculus
tctcctgcaagccaggttttcacac

SEQ ID NO: 972591 - DNA, 25 bp, Mus musculus
tctcctgcacctgaggagcatgtcc

SEQ ID NO: 972592 - DNA, 25 bp, Mus musculus
tctcctgcacgtgaggagcatgtcc

SEQ ID NO: 972593 - DNA, 25 bp, Mus musculus
tctcctgcagctcccagagagaaac

SEQ ID NO: 972594 - DNA, 25 bp, Mus musculus
tctcctgcaggtcccagagagaaac

SEQ ID NO: 972595 - DNA, 25 bp, Mus musculus
tctcctgccacaatcaaaaccaaga

SEQ ID NO: 972596 - DNA, 25 bp, Mus musculus
tctcctgccacattcaaaaccaaga

SEQ ID NO: 972597 - DNA, 25 bp, Mus musculus
tctcctgctcagattttgatccgat

SEQ ID NO: 972598 - DNA, 25 bp, Mus musculus
tctcctgctcagtttttgatccgat

SEQ ID NO: 972599 - DNA, 25 bp, Mus musculus
tctcctggagcaatgtggcctgctg

SEQ ID NO: 972600 - DNA, 25 bp, Mus musculus
tctcctggaggaatgtggcctgctg

SEQ ID NO: 972601 - DNA, 25 bp, Mus musculus
tctcctggatgaaacataagcagtc

SEQ ID NO: 972602 - DNA, 25 bp, Mus musculus
tctcctggatgaaagataagcagtc

SEQ ID NO: 972603 - DNA, 25 bp, Mus musculus
tctcctggcattaacggctccacgg

SEQ ID NO: 972604 - DNA, 25 bp, Mus musculus
tctcctggcattaagggctccacgg

SEQ ID NO: 972605 - DNA, 25 bp, Mus musculus
tctcctggccacctccttctacaat

SEQ ID NO: 972606 - DNA, 25 bp, Mus musculus
tctcctggccacgtccttctacaat

SEQ ID NO: 972607 - DNA, 25 bp, Mus musculus
tctcctggcccaccaaccttccctg

SEQ ID NO: 972608 - DNA, 25 bp, Mus musculus
tctcctggcccaccaagcttccctg

SEQ ID NO: 972609 - DNA, 25 bp, Mus musculus
tctcctggcccaccttccctggcac

SEQ ID NO: 972610 - DNA, 25 bp, Mus musculus
tctcctggcccagcaaccttccctg

SEQ ID NO: 972611 - DNA, 25 bp, Mus musculus
tctcctggcccagcaagcttccctg

SEQ ID NO: 972612 - DNA, 25 bp, Mus musculus
tctcctggcccagcttccctggcac

SEQ ID NO: 972613 - DNA, 25 bp, Mus musculus
tctcctgtgacaagttattggatga

SEQ ID NO: 972614 - DNA, 25 bp, Mus musculus
tctcctgtgacatgttattggatga

SEQ ID NO: 972615 - DNA, 25 bp, Mus musculus
tctcctgtgccaaaaaacattgccg

SEQ ID NO: 972616 - DNA, 25 bp, Mus musculus
tctcctgtgccataaaacattgccg

SEQ ID NO: 972617 - DNA, 25 bp, Mus musculus
tctccttacacacggaggcaaggga

SEQ ID NO: 972618 - DNA, 25 bp, Mus musculus
tctccttacacagggaggcaaggga

SEQ ID NO: 972619 - DNA, 25 bp, Mus musculus
tctccttcagagaggatgccccgca

SEQ ID NO: 972620 - DNA, 25 bp, Mus musculus
tctccttcagataatgtatccatgg

SEQ ID NO: 972621 - DNA, 25 bp, Mus musculus
tctccttcagtgaggatgccccgca

SEQ ID NO: 972622 - DNA, 25 bp, Mus musculus
tctccttcagttaatgtatccatgg

SEQ ID NO: 972623 - DNA, 25 bp, Mus musculus
tctccttccaaacaggatttgttgg

SEQ ID NO: 972624 - DNA, 25 bp, Mus musculus
tctccttccaaagaggatttgttgg

SEQ ID NO: 972625 - DNA, 25 bp, Mus musculus
tctccttcccagattctgaacttct

SEQ ID NO: 972626 - DNA, 25 bp, Mus musculus
tctccttcccagtttctgaacttct

SEQ ID NO: 972627 - DNA, 25 bp, Mus musculus
tctccttcctcacctactgtgacta

SEQ ID NO: 972628 - DNA, 25 bp, Mus musculus
tctccttcctcagctactgtgacta

SEQ ID NO: 972629 - DNA, 25 bp, Mus musculus
tctccttgtccaagatcgagcggtc

SEQ ID NO: 972630 - DNA, 25 bp, Mus musculus
tctccttgtccatgatcgagcggtc

SEQ ID NO: 972631 - DNA, 25 bp, Mus musculus
tctcctttagcacaggtgcagcaat

SEQ ID NO: 972632 - DNA, 25 bp, Mus musculus
tctcctttaggacaggtgcagcaat

SEQ ID NO: 972633 - DNA, 25 bp, Mus musculus
tctcctttcaagaattacaggcccg

SEQ ID NO: 972634 - DNA, 25 bp, Mus musculus
tctcctttcaagtattacaggcccg

SEQ ID NO: 972635 - DNA, 25 bp, Mus musculus
tctcctttccacctcgtggctgagt

SEQ ID NO: 972636 - DNA, 25 bp, Mus musculus
tctcctttccacgtcgtggctgagt

SEQ ID NO: 972637 - DNA, 25 bp, Mus musculus
tctcgaagtgagctagagctcacaa

SEQ ID NO: 972638 - DNA, 25 bp, Mus musculus
tctcgaagtgaggtagagctcacaa

SEQ ID NO: 972639 - DNA, 25 bp, Mus musculus
tctcgacagcgccgagacgcgtggc

SEQ ID NO: 972640 - DNA, 25 bp, Mus musculus
tctcgacagcgcggagacgcgtggc

SEQ ID NO: 972641 - DNA, 25 bp, Mus musculus
tctcgactctccgacgattcgggtt

SEQ ID NO: 972642 - DNA, 25 bp, Mus musculus
tctcgactctccgaggattcgggtt

SEQ ID NO: 972643 - DNA, 25 bp, Mus musculus
tctcgagtagggcacgcaatggcat

SEQ ID NO: 972644 - DNA, 25 bp, Mus musculus
tctcgagtagggcaggcaatggcat

SEQ ID NO: 972645 - DNA, 25 bp, Mus musculus
tctcgatccacgacagcattcctcc

SEQ ID NO: 972646 - DNA, 25 bp, Mus musculus
tctcgatccacgtcagcattcctcc

SEQ ID NO: 972647 - DNA, 25 bp, Mus musculus
tctcgccaacagcaatataactgct

SEQ ID NO: 972648 - DNA, 25 bp, Mus musculus
tctcgccaacaggaatataactgct

SEQ ID NO: 972649 - DNA, 25 bp, Mus musculus
tctcgcctgatgattttttgggtcg

SEQ ID NO: 972650 - DNA, 25 bp, Mus musculus
tctcgcctgatgtttttttgggtcg

SEQ ID NO: 972651 - DNA, 25 bp, Mus musculus
tctcgctggtttgccctccctccaa

SEQ ID NO: 972652 - DNA, 25 bp, Mus musculus
tctcgctggtttgcgctccctccaa

SEQ ID NO: 972653 - DNA, 25 bp, Mus musculus
tctcggaagtgaactcaaagacaga

SEQ ID NO: 972654 - DNA, 25 bp, Mus musculus
tctcggaagtgatctcaaagacaga

SEQ ID NO: 972655 - DNA, 25 bp, Mus musculus
tctcggacgtagaacgcctctttga

SEQ ID NO: 972656 - DNA, 25 bp, Mus musculus
tctcggacgtagaaggcctctttga

SEQ ID NO: 972657 - DNA, 25 bp, Mus musculus
tctcggagccttcacgacgatttat

SEQ ID NO: 972658 - DNA, 25 bp, Mus musculus
tctcggagccttcaggacgatttat

SEQ ID NO: 972659 - DNA, 25 bp, Mus musculus
tctcggatgccaccggctgagctgg

SEQ ID NO: 972660 - DNA, 25 bp, Mus musculus
tctcggatgccagcggctgagctgg

SEQ ID NO: 972661 - DNA, 25 bp, Mus musculus
tctcggcagaagagcaggctccgcc

SEQ ID NO: 972662 - DNA, 25 bp, Mus musculus
tctcggcagaagtgcaggctccgcc

SEQ ID NO: 972663 - DNA, 25 bp, Mus musculus
tctcggcctccacagatccgtgaag

SEQ ID NO: 972664 - DNA, 25 bp, Mus musculus
tctcggcctccagagatccgtgaag

SEQ ID NO: 972665 - DNA, 25 bp, Mus musculus
tctcggtgccacagatgagcggcac

SEQ ID NO: 972666 - DNA, 25 bp, Mus musculus
tctcggtgccactgatgagcggcac

SEQ ID NO: 972667 - DNA, 25 bp, Mus musculus
tctcgtaacaataacctcatcaaac

SEQ ID NO: 972668 - DNA, 25 bp, Mus musculus
tctcgtaacaataagctcatcaaac

SEQ ID NO: 972669 - DNA, 25 bp, Mus musculus
tctcgtggatttccaggcagtagag

SEQ ID NO: 972670 - DNA, 25 bp, Mus musculus
tctcgtggatttccaggccgtggta

SEQ ID NO: 972671 - DNA, 25 bp, Mus musculus
tctcgtggatttcctggcagtagag

SEQ ID NO: 972672 - DNA, 25 bp, Mus musculus
tctcgtggatttcctggccgtggta

SEQ ID NO: 972673 - DNA, 25 bp, Mus musculus
tctcgttcttcactgaggatgcccc

SEQ ID NO: 972674 - DNA, 25 bp, Mus musculus
tctcgttcttcagtgaggatgcccc

SEQ ID NO: 972675 - DNA, 25 bp, Mus musculus
tctctaaagggctcacattcatcta

SEQ ID NO: 972676 - DNA, 25 bp, Mus musculus
tctctaaagggctctcattcatcta

SEQ ID NO: 972677 - DNA, 25 bp, Mus musculus
tctctaaccagctccacttgagcag

SEQ ID NO: 972678 - DNA, 25 bp, Mus musculus
tctctaaccagctcgacttgagcag

SEQ ID NO: 972679 - DNA, 25 bp, Mus musculus
tctctacaggtacggacccgaaagt

SEQ ID NO: 972680 - DNA, 25 bp, Mus musculus
tctctacaggtagggacccgaaagt

SEQ ID NO: 972681 - DNA, 25 bp, Mus musculus
tctctaccaacgcaattgaatataa

SEQ ID NO: 972682 - DNA, 25 bp, Mus musculus
tctctaccaacggaattgaatataa

SEQ ID NO: 972683 - DNA, 25 bp, Mus musculus
tctctaccagctctgtcacctaaag

SEQ ID NO: 972684 - DNA, 25 bp, Mus musculus
tctctaccaggtctgtcacctaaag

SEQ ID NO: 972685 - DNA, 25 bp, Mus musculus
tctctacctcagggcgtgggggatg

SEQ ID NO: 972686 - DNA, 25 bp, Mus musculus
tctctacctcagggggtgggggatg

SEQ ID NO: 972687 - DNA, 25 bp, Mus musculus
tctctacctgcacgcagcctgatct

SEQ ID NO: 972688 - DNA, 25 bp, Mus musculus
tctctacctgcaggcagcctgatct

SEQ ID NO: 972689 - DNA, 25 bp, Mus musculus
tctctactcttcaaaggtgtgttgt

SEQ ID NO: 972690 - DNA, 25 bp, Mus musculus
tctctactcttcaatggtgtgttgt

SEQ ID NO: 972691 - DNA, 25 bp, Mus musculus
tctctactgcctacaagaagactca

SEQ ID NO: 972692 - DNA, 25 bp, Mus musculus
tctctactgcctatgtgaaaacgtc

SEQ ID NO: 972693 - DNA, 25 bp, Mus musculus
tctctactgcgtacaagaagactca

SEQ ID NO: 972694 - DNA, 25 bp, Mus musculus
tctctactgcgtatgtgaaaacgtc

SEQ ID NO: 972695 - DNA, 25 bp, Mus musculus
tctctagcctaacttctgagaagtc

SEQ ID NO: 972696 - DNA, 25 bp, Mus musculus
tctctagcctaagttctgagaagtc

SEQ ID NO: 972697 - DNA, 25 bp, Mus musculus
tctctagctgaactgagcaaaccaa

SEQ ID NO: 972698 - DNA, 25 bp, Mus musculus
tctctagctgaagtgagcaaaccaa

SEQ ID NO: 972699 - DNA, 25 bp, Mus musculus
tctctatcaaagcttgccgaggctg

SEQ ID NO: 972700 - DNA, 25 bp, Mus musculus
tctctatcaaaggttgccgaggctg

SEQ ID NO: 972701 - DNA, 25 bp, Mus musculus
tctctatgctgtcgtttgccactag

SEQ ID NO: 972702 - DNA, 25 bp, Mus musculus
tctctatgctgtggtttgccactag

SEQ ID NO: 972703 - DNA, 25 bp, Mus musculus
tctctcaatgctgtatgcccagctg

SEQ ID NO: 972704 - DNA, 25 bp, Mus musculus
tctctcaatggtgtatgcccagctg

SEQ ID NO: 972705 - DNA, 25 bp, Mus musculus
tctctcacactcagcggacaattca

SEQ ID NO: 972706 - DNA, 25 bp, Mus musculus
tctctcacactcaggggacaattca

SEQ ID NO: 972707 - DNA, 25 bp, Mus musculus
tctctcactgatgattccttcagga

SEQ ID NO: 972708 - DNA, 25 bp, Mus musculus
tctctcactgttgattccttcagga

SEQ ID NO: 972709 - DNA, 25 bp, Mus musculus
tctctcagcgcatctcctccctcac

SEQ ID NO: 972710 - DNA, 25 bp, Mus musculus
tctctcagcggatctcctccctcac

SEQ ID NO: 972711 - DNA, 25 bp, Mus musculus
tctctcaggcaccacgttcctccaa

SEQ ID NO: 972712 - DNA, 25 bp, Mus musculus
tctctcaggcaccaggttcctccaa

SEQ ID NO: 972713 - DNA, 25 bp, Mus musculus
tctctcatcaaagacgtcgggttcc

SEQ ID NO: 972714 - DNA, 25 bp, Mus musculus
tctctcatcaaagaggtcgggttcc

SEQ ID NO: 972715 - DNA, 25 bp, Mus musculus
tctctcatgctacttcagcaatcag

SEQ ID NO: 972716 - DNA, 25 bp, Mus musculus
tctctcatgctagttcagcaatcag

SEQ ID NO: 972717 - DNA, 25 bp, Mus musculus
tctctccacttgcggggatcggatg

SEQ ID NO: 972718 - DNA, 25 bp, Mus musculus
tctctccacttggggggatcggatg

SEQ ID NO: 972719 - DNA, 25 bp, Mus musculus
tctctccagccaaatctggcaccaa

SEQ ID NO: 972720 - DNA, 25 bp, Mus musculus
tctctccagccacgatgtgatggtg

SEQ ID NO: 972721 - DNA, 25 bp, Mus musculus
tctctccagccacgctgcttctgat

SEQ ID NO: 972722 - DNA, 25 bp, Mus musculus
tctctccagccactgaggatcccat

SEQ ID NO: 972723 - DNA, 25 bp, Mus musculus
tctctccagccaggatgtgatggtg

SEQ ID NO: 972724 - DNA, 25 bp, Mus musculus
tctctccagccaggctgcttctgat

SEQ ID NO: 972725 - DNA, 25 bp, Mus musculus
tctctccagccagtgaggatcccat

SEQ ID NO: 972726 - DNA, 25 bp, Mus musculus
tctctccagccatatctggcaccaa

SEQ ID NO: 972727 - DNA, 25 bp, Mus musculus
tctctccaggaccgcacaaaaggac

SEQ ID NO: 972728 - DNA, 25 bp, Mus musculus
tctctccaggacggcacaaaaggac

SEQ ID NO: 972729 - DNA, 25 bp, Mus musculus
tctctccatcagctttctttcttgt

SEQ ID NO: 972730 - DNA, 25 bp, Mus musculus
tctctccatcaggtttctttcttgt

SEQ ID NO: 972731 - DNA, 25 bp, Mus musculus
tctctccccaagactgacttggaca

SEQ ID NO: 972732 - DNA, 25 bp, Mus musculus
tctctccccatgactgacttggaca

SEQ ID NO: 972733 - DNA, 25 bp, Mus musculus
tctctccgctcaaacgttgatgaag

SEQ ID NO: 972734 - DNA, 25 bp, Mus musculus
tctctccgctcaaaggttgatgaag

SEQ ID NO: 972735 - DNA, 25 bp, Mus musculus
tctctcctaactcgtcagtaccatg

SEQ ID NO: 972736 - DNA, 25 bp, Mus musculus
tctctcctaactggtcagtaccatg

SEQ ID NO: 972737 - DNA, 25 bp, Mus musculus
tctctcctggccacctccttctaca

SEQ ID NO: 972738 - DNA, 25 bp, Mus musculus
tctctcctggccacgtccttctaca

SEQ ID NO: 972739 - DNA, 25 bp, Mus musculus
tctctcggaagtgaactcaaagaca

SEQ ID NO: 972740 - DNA, 25 bp, Mus musculus
tctctcggaagtgatctcaaagaca

SEQ ID NO: 972741 - DNA, 25 bp, Mus musculus
tctctcgtggaacgtgaagccgtcc

SEQ ID NO: 972742 - DNA, 25 bp, Mus musculus
tctctcgtggaaggtgaagccgtcc

SEQ ID NO: 972743 - DNA, 25 bp, Mus musculus
tctctctagcctaacttctgagaag

SEQ ID NO: 972744 - DNA, 25 bp, Mus musculus
tctctctagcctaagttctgagaag

SEQ ID NO: 972745 - DNA, 25 bp, Mus musculus
tctctctcagagaaacgggagaatg

SEQ ID NO: 972746 - DNA, 25 bp, Mus musculus
tctctctcagcacgccgctttgttg

SEQ ID NO: 972747 - DNA, 25 bp, Mus musculus
tctctctcagcaggccgctttgttg

SEQ ID NO: 972748 - DNA, 25 bp, Mus musculus
tctctctcagtgaaacgggagaatg

SEQ ID NO: 972749 - DNA, 25 bp, Mus musculus
tctctctccacttgcggggatcgga

SEQ ID NO: 972750 - DNA, 25 bp, Mus musculus
tctctctccacttggggggatcgga

SEQ ID NO: 972751 - DNA, 25 bp, Mus musculus
tctctctctccacataatctggagg

SEQ ID NO: 972752 - DNA, 25 bp, Mus musculus
tctctctctccagataatctggagg

SEQ ID NO: 972753 - DNA, 25 bp, Mus musculus
tctctctctctccacataatctgga

SEQ ID NO: 972754 - DNA, 25 bp, Mus musculus
tctctctctctccagataatctgga

SEQ ID NO: 972755 - DNA, 25 bp, Mus musculus
tctctctctgaggaggtgaagccgg

SEQ ID NO: 972756 - DNA, 25 bp, Mus musculus
tctctctctggcctcgtttgctact

SEQ ID NO: 972757 - DNA, 25 bp, Mus musculus
tctctctctggcctggtttgctact

SEQ ID NO: 972758 - DNA, 25 bp, Mus musculus
tctctctctgtggaggtgaagccgg

SEQ ID NO: 972759 - DNA, 25 bp, Mus musculus
tctctctggcagcgatggaagactg

SEQ ID NO: 972760 - DNA, 25 bp, Mus musculus
tctctctggcagggatggaagactg

SEQ ID NO: 972761 - DNA, 25 bp, Mus musculus
tctctctggcctcgtttgctactgg

SEQ ID NO: 972762 - DNA, 25 bp, Mus musculus
tctctctggcctggtttgctactgg

SEQ ID NO: 972763 - DNA, 25 bp, Mus musculus
tctctctgtaaactgaaggatacaa

SEQ ID NO: 972764 - DNA, 25 bp, Mus musculus
tctctctgtaaagtgaaggatacaa

SEQ ID NO: 972765 - DNA, 25 bp, Mus musculus
tctctcttacagatcaagatcttag

SEQ ID NO: 972766 - DNA, 25 bp, Mus musculus
tctctcttacagccactacagactc

SEQ ID NO: 972767 - DNA, 25 bp, Mus musculus
tctctcttacaggcactacagactc

SEQ ID NO: 972768 - DNA, 25 bp, Mus musculus
tctctcttacagttcaagatcttag

SEQ ID NO: 972769 - DNA, 25 bp, Mus musculus
tctctcttccaattcgtctgattgt

SEQ ID NO: 972770 - DNA, 25 bp, Mus musculus
tctctcttccaattggtctgattgt

SEQ ID NO: 972771 - DNA, 25 bp, Mus musculus
tctctgaaagatctcctgtctatct

SEQ ID NO: 972772 - DNA, 25 bp, Mus musculus
tctctgaaagttctcctgtctatct

SEQ ID NO: 972773 - DNA, 25 bp, Mus musculus
tctctgacagctgtccccagaactg

SEQ ID NO: 972774 - DNA, 25 bp, Mus musculus
tctctgacaggtgtccccagaactg

SEQ ID NO: 972775 - DNA, 25 bp, Mus musculus
tctctgacctcacacatgccacgcc

SEQ ID NO: 972776 - DNA, 25 bp, Mus musculus
tctctgacctcacagatgccacgcc

SEQ ID NO: 972777 - DNA, 25 bp, Mus musculus
tctctgatattacggaggtgcccct

SEQ ID NO: 972778 - DNA, 25 bp, Mus musculus
tctctgatattagggaggtgcccct

SEQ ID NO: 972779 - DNA, 25 bp, Mus musculus
tctctgcaagagctttgcggtgagc

SEQ ID NO: 972780 - DNA, 25 bp, Mus musculus
tctctgcaagaggtttgcggtgagc

SEQ ID NO: 972781 - DNA, 25 bp, Mus musculus
tctctgcaatataacgcacaatgga

SEQ ID NO: 972782 - DNA, 25 bp, Mus musculus
tctctgcaatataaggcacaatgga

SEQ ID NO: 972783 - DNA, 25 bp, Mus musculus
tctctgcagtcctatggggcatgga

SEQ ID NO: 972784 - DNA, 25 bp, Mus musculus
tctctgcagtgctatggggcatgga

SEQ ID NO: 972785 - DNA, 25 bp, Mus musculus
tctctgccagctttgtttactagcg

SEQ ID NO: 972786 - DNA, 25 bp, Mus musculus
tctctgccaggtttgtttactagcg

SEQ ID NO: 972787 - DNA, 25 bp, Mus musculus
tctctgccgccacgtcctcagatga

SEQ ID NO: 972788 - DNA, 25 bp, Mus musculus
tctctgccgccaggtcctcagatga

SEQ ID NO: 972789 - DNA, 25 bp, Mus musculus
tctctgcctaagcggcagactccta

SEQ ID NO: 972790 - DNA, 25 bp, Mus musculus
tctctgcctaaggggcagactccta

SEQ ID NO: 972791 - DNA, 25 bp, Mus musculus
tctctgcctgttattgagccacgtg

SEQ ID NO: 972792 - DNA, 25 bp, Mus musculus
tctctgcctgtttttgagccacgtg

SEQ ID NO: 972793 - DNA, 25 bp, Mus musculus
tctctgcgaaaaagcgatgactgag

SEQ ID NO: 972794 - DNA, 25 bp, Mus musculus
tctctgcgaaaaagggatgactgag

SEQ ID NO: 972795 - DNA, 25 bp, Mus musculus
tctctgctattgcacaggtggcttt

SEQ ID NO: 972796 - DNA, 25 bp, Mus musculus
tctctgctattgcacgtttcctggc

SEQ ID NO: 972797 - DNA, 25 bp, Mus musculus
tctctgctattgcagaggtggcttt

SEQ ID NO: 972798 - DNA, 25 bp, Mus musculus
tctctgctattgcaggtttcctggc

SEQ ID NO: 972799 - DNA, 25 bp, Mus musculus
tctctgctggcggcagctcacagct

SEQ ID NO: 972800 - DNA, 25 bp, Mus musculus
tctctgctgggggcagctcacagct

SEQ ID NO: 972801 - DNA, 25 bp, Mus musculus
tctctgcttgagcaagaagctcact

SEQ ID NO: 972802 - DNA, 25 bp, Mus musculus
tctctgcttgaggaagaagctcact

SEQ ID NO: 972803 - DNA, 25 bp, Mus musculus
tctctggaacatgacagcgccaagg

SEQ ID NO: 972804 - DNA, 25 bp, Mus musculus
tctctggaacatgagagcgccaagg

SEQ ID NO: 972805 - DNA, 25 bp, Mus musculus
tctctggaagacctagtcactcgag

SEQ ID NO: 972806 - DNA, 25 bp, Mus musculus
tctctggaagagttcaagatttttt

SEQ ID NO: 972807 - DNA, 25 bp, Mus musculus
tctctggaagattaggtcagagacc

SEQ ID NO: 972808 - DNA, 25 bp, Mus musculus
tctctggaagtcctagtcactcgag

SEQ ID NO: 972809 - DNA, 25 bp, Mus musculus
tctctggaagtgttcaagatttttt

SEQ ID NO: 972810 - DNA, 25 bp, Mus musculus
tctctggaagtttaggtcagagacc

SEQ ID NO: 972811 - DNA, 25 bp, Mus musculus
tctctggatcctacattcattactt

SEQ ID NO: 972812 - DNA, 25 bp, Mus musculus
tctctggatccttcattcattactt

SEQ ID NO: 972813 - DNA, 25 bp, Mus musculus
tctctggcaaggcttgtgtaaatct

SEQ ID NO: 972814 - DNA, 25 bp, Mus musculus
tctctggcaagggttgtgtaaatct

SEQ ID NO: 972815 - DNA, 25 bp, Mus musculus
tctctggcagaacccctgtgatgac

SEQ ID NO: 972816 - DNA, 25 bp, Mus musculus
tctctggcagcgatggaagactgtg

SEQ ID NO: 972817 - DNA, 25 bp, Mus musculus
tctctggcagctcaagtccgggaca

SEQ ID NO: 972818 - DNA, 25 bp, Mus musculus
tctctggcagggatggaagactgtg

SEQ ID NO: 972819 - DNA, 25 bp, Mus musculus
tctctggcaggtcaagtccgggaca

SEQ ID NO: 972820 - DNA, 25 bp, Mus musculus
tctctggcagtacccctgtgatgac

SEQ ID NO: 972821 - DNA, 25 bp, Mus musculus
tctctgggctgacgaaattcaagct

SEQ ID NO: 972822 - DNA, 25 bp, Mus musculus
tctctgggctgaggaaattcaagct

SEQ ID NO: 972823 - DNA, 25 bp, Mus musculus
tctctgtaaactgaaggatacaaaa

SEQ ID NO: 972824 - DNA, 25 bp, Mus musculus
tctctgtaaagtgaaggatacaaaa

SEQ ID NO: 972825 - DNA, 25 bp, Mus musculus
tctctgtaagatctccctgttcact

SEQ ID NO: 972826 - DNA, 25 bp, Mus musculus
tctctgtaagttctccctgttcact

SEQ ID NO: 972827 - DNA, 25 bp, Mus musculus
tctctgtctcagagaaatacaacaa

SEQ ID NO: 972828 - DNA, 25 bp, Mus musculus
tctctgtctcagtgaaatacaacaa

SEQ ID NO: 972829 - DNA, 25 bp, Mus musculus
tctctgtgagatcattgggcaggta

SEQ ID NO: 972830 - DNA, 25 bp, Mus musculus
tctctgtgagttcattgggcaggta

SEQ ID NO: 972831 - DNA, 25 bp, Mus musculus
tctctgtgatcgagaatggctacgt

SEQ ID NO: 972832 - DNA, 25 bp, Mus musculus
tctctgtgatcgtgaatggctacgt

SEQ ID NO: 972833 - DNA, 25 bp, Mus musculus
tctctgtgcgcgccaatacagagtg

SEQ ID NO: 972834 - DNA, 25 bp, Mus musculus
tctctgtgcgcggcaatacagagtg

SEQ ID NO: 972835 - DNA, 25 bp, Mus musculus
tctctgtggaagagacctctgctaa

SEQ ID NO: 972836 - DNA, 25 bp, Mus musculus
tctctgtggaagtgacctctgctaa

SEQ ID NO: 972837 - DNA, 25 bp, Mus musculus
tctctgtggatgagggccgggcctg

SEQ ID NO: 972838 - DNA, 25 bp, Mus musculus
tctctgtggatgtgggccgggcctg

SEQ ID NO: 972839 - DNA, 25 bp, Mus musculus
tctctgttggcgcttcacacctacc

SEQ ID NO: 972840 - DNA, 25 bp, Mus musculus
tctctgttggggcttcacacctacc

SEQ ID NO: 972841 - DNA, 25 bp, Mus musculus
tctctgtttgagagatgagccggca

SEQ ID NO: 972842 - DNA, 25 bp, Mus musculus
tctctgtttgagtgatgagccggca

SEQ ID NO: 972843 - DNA, 25 bp, Mus musculus
tctcttaaatagaatgtcaaaactg

SEQ ID NO: 972844 - DNA, 25 bp, Mus musculus
tctcttaaatagtatgtcaaaactg

SEQ ID NO: 972845 - DNA, 25 bp, Mus musculus
tctcttacagatcaagatcttagaa

SEQ ID NO: 972846 - DNA, 25 bp, Mus musculus
tctcttacagccactacagactcga

SEQ ID NO: 972847 - DNA, 25 bp, Mus musculus
tctcttacaggcactacagactcga

SEQ ID NO: 972848 - DNA, 25 bp, Mus musculus
tctcttacagttcaagatcttagaa

SEQ ID NO: 972849 - DNA, 25 bp, Mus musculus
tctcttcattgatgcgcagacacgc

SEQ ID NO: 972850 - DNA, 25 bp, Mus musculus
tctcttcattgatgggcagacacgc

SEQ ID NO: 972851 - DNA, 25 bp, Mus musculus
tctcttccaattcgtctgattgttg

SEQ ID NO: 972852 - DNA, 25 bp, Mus musculus
tctcttccaattggtctgattgttg

SEQ ID NO: 972853 - DNA, 25 bp, Mus musculus
tctcttcccccacatgcctgtcggt

SEQ ID NO: 972854 - DNA, 25 bp, Mus musculus
tctcttcccccagatgcctgtcggt

SEQ ID NO: 972855 - DNA, 25 bp, Mus musculus
tctcttcgttgacacttatgacgtg

SEQ ID NO: 972856 - DNA, 25 bp, Mus musculus
tctcttcgttgacagttatgacgtg

SEQ ID NO: 972857 - DNA, 25 bp, Mus musculus
tctcttctcccacgcaccaggtgca

SEQ ID NO: 972858 - DNA, 25 bp, Mus musculus
tctcttctcccaggcaccaggtgca

SEQ ID NO: 972859 - DNA, 25 bp, Mus musculus
tctcttcttgctgcccgtggtggtc

SEQ ID NO: 972860 - DNA, 25 bp, Mus musculus
tctcttcttggtgcccgtggtggtc

SEQ ID NO: 972861 - DNA, 25 bp, Mus musculus
tctcttctttggagctctctccagc

SEQ ID NO: 972862 - DNA, 25 bp, Mus musculus
tctcttctttggtgctctctccagc

SEQ ID NO: 972863 - DNA, 25 bp, Mus musculus
tctcttgcaaaaacagctttcgatg

SEQ ID NO: 972864 - DNA, 25 bp, Mus musculus
tctcttgcaaaaactgctttcgatg

SEQ ID NO: 972865 - DNA, 25 bp, Mus musculus
tctcttgccttgcggaaatggccat

SEQ ID NO: 972866 - DNA, 25 bp, Mus musculus
tctcttgccttggggaaatggccat

SEQ ID NO: 972867 - DNA, 25 bp, Mus musculus
tctcttgctgtgcacgcatttttgc

SEQ ID NO: 972868 - DNA, 25 bp, Mus musculus
tctcttgctgtgcaggcatttttgc

SEQ ID NO: 972869 - DNA, 25 bp, Mus musculus
tctctttcaccgatcatcgggaaag

SEQ ID NO: 972870 - DNA, 25 bp, Mus musculus
tctctttcaccgttcatcgggaaag

SEQ ID NO: 972871 - DNA, 25 bp, Mus musculus
tctctttcagaatcctgtgcgtcct

SEQ ID NO: 972872 - DNA, 25 bp, Mus musculus
tctctttcagctagagcttgagatg

SEQ ID NO: 972873 - DNA, 25 bp, Mus musculus
tctctttcaggtagagcttgagatg

SEQ ID NO: 972874 - DNA, 25 bp, Mus musculus
tctctttcagtatcctgtgcgtcct

SEQ ID NO: 972875 - DNA, 25 bp, Mus musculus
tctctttcccgcaactgtgagtgtg

SEQ ID NO: 972876 - DNA, 25 bp, Mus musculus
tctctttcccgcaagtgtgagtgtg

SEQ ID NO: 972877 - DNA, 25 bp, Mus musculus
tctctttgaaagcagaaggaatgag

SEQ ID NO: 972878 - DNA, 25 bp, Mus musculus
tctctttgaaaggagaaggaatgag

SEQ ID NO: 972879 - DNA, 25 bp, Mus musculus
tctctttgcttgaaagggcctgtgt

SEQ ID NO: 972880 - DNA, 25 bp, Mus musculus
tctctttgcttgaatgggcctgtgt

SEQ ID NO: 972881 - DNA, 25 bp, Mus musculus
tctcttttttgacattgagctcctt

SEQ ID NO: 972882 - DNA, 25 bp, Mus musculus
tctcttttttgagattgagctcctt

SEQ ID NO: 972883 - DNA, 25 bp, Mus musculus
tctgaaaacgatgatggagctggtg

SEQ ID NO: 972884 - DNA, 25 bp, Mus musculus
tctgaaaacgttgatggagctggtg

SEQ ID NO: 972885 - DNA, 25 bp, Mus musculus
tctgaaactgtaccttctttgttac

SEQ ID NO: 972886 - DNA, 25 bp, Mus musculus
tctgaaactgtagcttctttgttac

SEQ ID NO: 972887 - DNA, 25 bp, Mus musculus
tctgaaagccatgccccagagaccg

SEQ ID NO: 972888 - DNA, 25 bp, Mus musculus
tctgaaagccatgcgccagagaccg

SEQ ID NO: 972889 - DNA, 25 bp, Mus musculus
tctgaaagtgagccccgattcatca

SEQ ID NO: 972890 - DNA, 25 bp, Mus musculus
tctgaaagtgtgccccgattcatca

SEQ ID NO: 972891 - DNA, 25 bp, Mus musculus
tctgaaataatacgatttttatcaa

SEQ ID NO: 972892 - DNA, 25 bp, Mus musculus
tctgaaataataggatttttatcaa

SEQ ID NO: 972893 - DNA, 25 bp, Mus musculus
tctgaaattgtacaactgtatggag

SEQ ID NO: 972894 - DNA, 25 bp, Mus musculus
tctgaaattgtagaactgtatggag

SEQ ID NO: 972895 - DNA, 25 bp, Mus musculus
tctgaaccccagctttgaggagcca

SEQ ID NO: 972896 - DNA, 25 bp, Mus musculus
tctgaaccccaggtttgaggagcca

SEQ ID NO: 972897 - DNA, 25 bp, Mus musculus
tctgaacgaatgcaccaatgacact

SEQ ID NO: 972898 - DNA, 25 bp, Mus musculus
tctgaacgaatggaccaatgacact

SEQ ID NO: 972899 - DNA, 25 bp, Mus musculus
tctgaagaacggactgttatgttct

SEQ ID NO: 972900 - DNA, 25 bp, Mus musculus
tctgaagaacggctatggctttgtg

SEQ ID NO: 972901 - DNA, 25 bp, Mus musculus
tctgaagaacgggtatggctttgtg

SEQ ID NO: 972902 - DNA, 25 bp, Mus musculus
tctgaagaacggtctgttatgttct

SEQ ID NO: 972903 - DNA, 25 bp, Mus musculus
tctgaagaagatcacaaaatatttc

SEQ ID NO: 972904 - DNA, 25 bp, Mus musculus
tctgaagaagatcagaaaatatttc

SEQ ID NO: 972905 - DNA, 25 bp, Mus musculus
tctgaagaagctggcctttcagtgg

SEQ ID NO: 972906 - DNA, 25 bp, Mus musculus
tctgaagaaggtggcctttcagtgg

SEQ ID NO: 972907 - DNA, 25 bp, Mus musculus
tctgaagactacacagacacaaagg

SEQ ID NO: 972908 - DNA, 25 bp, Mus musculus
tctgaagactactcagacacaaagg

SEQ ID NO: 972909 - DNA, 25 bp, Mus musculus
tctgaagaggaggtgctgggcccca

SEQ ID NO: 972910 - DNA, 25 bp, Mus musculus
tctgaagaggtggtgctgggcccca

SEQ ID NO: 972911 - DNA, 25 bp, Mus musculus
tctgaaggagatcgcaattccggtc

SEQ ID NO: 972912 - DNA, 25 bp, Mus musculus
tctgaaggagatggcaattccggtc

SEQ ID NO: 972913 - DNA, 25 bp, Mus musculus
tctgaaggcctgcttctgcataagc

SEQ ID NO: 972914 - DNA, 25 bp, Mus musculus
tctgaaggcctggttctgcataagc

SEQ ID NO: 972915 - DNA, 25 bp, Mus musculus
tctgaagggtttgacagaatcgcac

SEQ ID NO: 972916 - DNA, 25 bp, Mus musculus
tctgaagggtttgagagaatcgcac

SEQ ID NO: 972917 - DNA, 25 bp, Mus musculus
tctgaagtggaactcgtaagcaata

SEQ ID NO: 972918 - DNA, 25 bp, Mus musculus
tctgaagtggaactggtaagcaata

SEQ ID NO: 972919 - DNA, 25 bp, Mus musculus
tctgaagtggatggtgctctcgtca

SEQ ID NO: 972920 - DNA, 25 bp, Mus musculus
tctgaagtggttggtgctctcgtca

SEQ ID NO: 972921 - DNA, 25 bp, Mus musculus
tctgaatcaccgagtcaaagtggac

SEQ ID NO: 972922 - DNA, 25 bp, Mus musculus
tctgaatcacctgtcgagtgtccct

SEQ ID NO: 972923 - DNA, 25 bp, Mus musculus
tctgaatcacggagtcaaagtggac

SEQ ID NO: 972924 - DNA, 25 bp, Mus musculus
tctgaatcacgtgtcgagtgtccct

SEQ ID NO: 972925 - DNA, 25 bp, Mus musculus
tctgaatctagacggtgagaaagtc

SEQ ID NO: 972926 - DNA, 25 bp, Mus musculus
tctgaatctagagggtgagaaagtc

SEQ ID NO: 972927 - DNA, 25 bp, Mus musculus
tctgaatgacagagtagacgagctt

SEQ ID NO: 972928 - DNA, 25 bp, Mus musculus
tctgaatgacagtgtagacgagctt

SEQ ID NO: 972929 - DNA, 25 bp, Mus musculus
tctgaatgtgtgcatgtgaatgagt

SEQ ID NO: 972930 - DNA, 25 bp, Mus musculus
tctgaatgtgtggatgtgaatgagt

SEQ ID NO: 972931 - DNA, 25 bp, Mus musculus
tctgaattcttgcacacacctttgt

SEQ ID NO: 972932 - DNA, 25 bp, Mus musculus
tctgaattcttgcacatccgtctac

SEQ ID NO: 972933 - DNA, 25 bp, Mus musculus
tctgaattcttgcagacacctttgt

SEQ ID NO: 972934 - DNA, 25 bp, Mus musculus
tctgaattcttgcagatccgtctac

SEQ ID NO: 972935 - DNA, 25 bp, Mus musculus
tctgacaaacaacacagtaatggca

SEQ ID NO: 972936 - DNA, 25 bp, Mus musculus
tctgacaaacaagacagtaatggca

SEQ ID NO: 972937 - DNA, 25 bp, Mus musculus
tctgacaaagccttcatgtccaagc

SEQ ID NO: 972938 - DNA, 25 bp, Mus musculus
tctgacaaaggcttcatgtccaagc

SEQ ID NO: 972939 - DNA, 25 bp, Mus musculus
tctgacaagcaaatcatcaaacttc

SEQ ID NO: 972940 - DNA, 25 bp, Mus musculus
tctgacaagcaaatgatcaaacttc

SEQ ID NO: 972941 - DNA, 25 bp, Mus musculus
tctgacaatgcaatcccgcctatga

SEQ ID NO: 972942 - DNA, 25 bp, Mus musculus
tctgacaatggaatcccgcctatga

SEQ ID NO: 972943 - DNA, 25 bp, Mus musculus
tctgacactttccgctccaccatgg

SEQ ID NO: 972944 - DNA, 25 bp, Mus musculus
tctgacactttcggctccaccatgg

SEQ ID NO: 972945 - DNA, 25 bp, Mus musculus
tctgacagtgagcttggtggggccg

SEQ ID NO: 972946 - DNA, 25 bp, Mus musculus
tctgacagtgaggttggtggggccg

SEQ ID NO: 972947 - DNA, 25 bp, Mus musculus
tctgacattgagctggataagaagg

SEQ ID NO: 972948 - DNA, 25 bp, Mus musculus
tctgacattgaggtggataagaagg

SEQ ID NO: 972949 - DNA, 25 bp, Mus musculus
tctgaccaaagaatacattccacca

SEQ ID NO: 972950 - DNA, 25 bp, Mus musculus
tctgaccaaagattacattccacca

SEQ ID NO: 972951 - DNA, 25 bp, Mus musculus
tctgaccaagctttggcctcacaag

SEQ ID NO: 972952 - DNA, 25 bp, Mus musculus
tctgaccaaggtttggcctcacaag

SEQ ID NO: 972953 - DNA, 25 bp, Mus musculus
tctgaccaccaccgcatcacggctg

SEQ ID NO: 972954 - DNA, 25 bp, Mus musculus
tctgaccaccacggcatcacggctg

SEQ ID NO: 972955 - DNA, 25 bp, Mus musculus
tctgacccagactaccttgtagctg

SEQ ID NO: 972956 - DNA, 25 bp, Mus musculus
tctgacccagtctaccttgtagctg

SEQ ID NO: 972957 - DNA, 25 bp, Mus musculus
tctgacccctaccacgagcccaaga

SEQ ID NO: 972958 - DNA, 25 bp, Mus musculus
tctgacccctaccaggagcccaaga

SEQ ID NO: 972959 - DNA, 25 bp, Mus musculus
tctgaccctgaacacacaacaggct

SEQ ID NO: 972960 - DNA, 25 bp, Mus musculus
tctgaccctgaagacacaacaggct

SEQ ID NO: 972961 - DNA, 25 bp, Mus musculus
tctgacctcacacatgccacgccca

SEQ ID NO: 972962 - DNA, 25 bp, Mus musculus
tctgacctcacagatgccacgccca

SEQ ID NO: 972963 - DNA, 25 bp, Mus musculus
tctgacctccagaaaggtgctggat

SEQ ID NO: 972964 - DNA, 25 bp, Mus musculus
tctgacctccagtaaggtgctggat

SEQ ID NO: 972965 - DNA, 25 bp, Mus musculus
tctgacgagcagcactcggtgcggc

SEQ ID NO: 972966 - DNA, 25 bp, Mus musculus
tctgacgagcaggactcggtgcggc

SEQ ID NO: 972967 - DNA, 25 bp, Mus musculus
tctgacgtgcagcctgtgatgtcac

SEQ ID NO: 972968 - DNA, 25 bp, Mus musculus
tctgacgtgcaggctgtgatgtcac

SEQ ID NO: 972969 - DNA, 25 bp, Mus musculus
tctgactctcagattcatgaagtat

SEQ ID NO: 972970 - DNA, 25 bp, Mus musculus
tctgactctcagtttcatgaagtat

SEQ ID NO: 972971 - DNA, 25 bp, Mus musculus
tctgactctgagcccgttggtattt

SEQ ID NO: 972972 - DNA, 25 bp, Mus musculus
tctgactctgaggccgttggtattt

SEQ ID NO: 972973 - DNA, 25 bp, Mus musculus
tctgactctgcacggacctctagtg

SEQ ID NO: 972974 - DNA, 25 bp, Mus musculus
tctgactctgcagggacctctagtg

SEQ ID NO: 972975 - DNA, 25 bp, Mus musculus
tctgactgcgacatttacattgttg

SEQ ID NO: 972976 - DNA, 25 bp, Mus musculus
tctgactgcgcttgaaatgggcatg

SEQ ID NO: 972977 - DNA, 25 bp, Mus musculus
tctgactgcggttgaaatgggcatg

SEQ ID NO: 972978 - DNA, 25 bp, Mus musculus
tctgactgcgtcatttacattgttg

SEQ ID NO: 972979 - DNA, 25 bp, Mus musculus
tctgactgtgagatcgcggcgcccc

SEQ ID NO: 972980 - DNA, 25 bp, Mus musculus
tctgactgtgagatggcggcgcccc

SEQ ID NO: 972981 - DNA, 25 bp, Mus musculus
tctgactgtggacgcctttgtcagc

SEQ ID NO: 972982 - DNA, 25 bp, Mus musculus
tctgactgtggaggcctttgtcagc

SEQ ID NO: 972983 - DNA, 25 bp, Mus musculus
tctgacttcgctcagccatgtcatc

SEQ ID NO: 972984 - DNA, 25 bp, Mus musculus
tctgacttcggtcagccatgtcatc

SEQ ID NO: 972985 - DNA, 25 bp, Mus musculus
tctgacttgagaaacctggggatcc

SEQ ID NO: 972986 - DNA, 25 bp, Mus musculus
tctgacttgagaaagctggggatcc

SEQ ID NO: 972987 - DNA, 25 bp, Mus musculus
tctgacttggctctgaagactgtgc

SEQ ID NO: 972988 - DNA, 25 bp, Mus musculus
tctgacttgggtctgaagactgtgc

SEQ ID NO: 972989 - DNA, 25 bp, Mus musculus
tctgactttgacctcctgactgtga

SEQ ID NO: 972990 - DNA, 25 bp, Mus musculus
tctgactttgtcctcctgactgtga

SEQ ID NO: 972991 - DNA, 25 bp, Mus musculus
tctgagaaagatcaagacagtggct

SEQ ID NO: 972992 - DNA, 25 bp, Mus musculus
tctgagaaagttcaagacagtggct

SEQ ID NO: 972993 - DNA, 25 bp, Mus musculus
tctgagaatgccacagtggccacag

SEQ ID NO: 972994 - DNA, 25 bp, Mus musculus
tctgagaatgccactgtggccacag

SEQ ID NO: 972995 - DNA, 25 bp, Mus musculus
tctgagacagcgccatctccagagt

SEQ ID NO: 972996 - DNA, 25 bp, Mus musculus
tctgagacagggccatctccagagt

SEQ ID NO: 972997 - DNA, 25 bp, Mus musculus
tctgagaccaagaacatggagaagc

SEQ ID NO: 972998 - DNA, 25 bp, Mus musculus
tctgagaccaagtacatggagaagc

SEQ ID NO: 972999 - DNA, 25 bp, Mus musculus
tctgagagagaaaaagaagcccgtg

SEQ ID NO: 973000 - DNA, 25 bp, Mus musculus
tctgagagagaaaatgaagcccgtg

SEQ ID NO: 973001 - DNA, 25 bp, Mus musculus
tctgagagagctgaaccaccaaaat

SEQ ID NO: 973002 - DNA, 25 bp, Mus musculus
tctgagagaggtgaaccaccaaaat

SEQ ID NO: 973003 - DNA, 25 bp, Mus musculus
tctgagagataacgcacctccaagt

SEQ ID NO: 973004 - DNA, 25 bp, Mus musculus
tctgagagataaggcacctccaagt

SEQ ID NO: 973005 - DNA, 25 bp, Mus musculus
tctgagatactactgaaggttaagc

SEQ ID NO: 973006 - DNA, 25 bp, Mus musculus
tctgagatactagtgaaggttaagc

SEQ ID NO: 973007 - DNA, 25 bp, Mus musculus
tctgagatcttaaacgttgccagga

SEQ ID NO: 973008 - DNA, 25 bp, Mus musculus
tctgagatcttaaaggttgccagga

SEQ ID NO: 973009 - DNA, 25 bp, Mus musculus
tctgagatgagttacaggctaacgg

SEQ ID NO: 973010 - DNA, 25 bp, Mus musculus
tctgagatgagttacgctaacggcc

SEQ ID NO: 973011 - DNA, 25 bp, Mus musculus
tctgagatgagttactttagaggct

SEQ ID NO: 973012 - DNA, 25 bp, Mus musculus
tctgagatgagttagaggctaacgg

SEQ ID NO: 973013 - DNA, 25 bp, Mus musculus
tctgagatgagttaggctaacggcc

SEQ ID NO: 973014 - DNA, 25 bp, Mus musculus
tctgagatgagttagtttagaggct

SEQ ID NO: 973015 - DNA, 25 bp, Mus musculus
tctgagcaggactcggaacccactt

SEQ ID NO: 973016 - DNA, 25 bp, Mus musculus
tctgagcaggtctcggaacccactt

SEQ ID NO: 973017 - DNA, 25 bp, Mus musculus
tctgagctcttccaacacttcgaca

SEQ ID NO: 973018 - DNA, 25 bp, Mus musculus
tctgagctcttccatcacttcgaca

SEQ ID NO: 973019 - DNA, 25 bp, Mus musculus
tctgagctgcaacataagcagacag

SEQ ID NO: 973020 - DNA, 25 bp, Mus musculus
tctgagctgcaacgaactcattata

SEQ ID NO: 973021 - DNA, 25 bp, Mus musculus
tctgagctgcaagataagcagacag

SEQ ID NO: 973022 - DNA, 25 bp, Mus musculus
tctgagctgcaaggaactcattata

SEQ ID NO: 973023 - DNA, 25 bp, Mus musculus
tctgagctggcttgctgcccattct

SEQ ID NO: 973024 - DNA, 25 bp, Mus musculus
tctgagctgggttgctgcccattct

SEQ ID NO: 973025 - DNA, 25 bp, Mus musculus
tctgaggaagagagttcccatatcc

SEQ ID NO: 973026 - DNA, 25 bp, Mus musculus
tctgaggaagagtgttcccatatcc

SEQ ID NO: 973027 - DNA, 25 bp, Mus musculus
tctgaggagatggacacatctcaag

SEQ ID NO: 973028 - DNA, 25 bp, Mus musculus
tctgaggagatggagacatctcaag

SEQ ID NO: 973029 - DNA, 25 bp, Mus musculus
tctgaggcgcggcccagcactatgg

SEQ ID NO: 973030 - DNA, 25 bp, Mus musculus
tctgaggcgcgggccagcactatgg

SEQ ID NO: 973031 - DNA, 25 bp, Mus musculus
tctgaggggaagagatgcaattcga

SEQ ID NO: 973032 - DNA, 25 bp, Mus musculus
tctgaggggaagtgatgcaattcga

SEQ ID NO: 973033 - DNA, 25 bp, Mus musculus
tctgagtcagcccacatactcccag

SEQ ID NO: 973034 - DNA, 25 bp, Mus musculus
tctgagtcaggccacatactcccag

SEQ ID NO: 973035 - DNA, 25 bp, Mus musculus
tctgagtctgaagaagacaaaggca

SEQ ID NO: 973036 - DNA, 25 bp, Mus musculus
tctgagtctgtagaagacaaaggca

SEQ ID NO: 973037 - DNA, 25 bp, Mus musculus
tctgagtgtatcccacaagaagata

SEQ ID NO: 973038 - DNA, 25 bp, Mus musculus
tctgagtgtatcgcacaagaagata

SEQ ID NO: 973039 - DNA, 25 bp, Mus musculus
tctgataaagccaactgttggattg

SEQ ID NO: 973040 - DNA, 25 bp, Mus musculus
tctgataaaggcaactgttggattg

SEQ ID NO: 973041 - DNA, 25 bp, Mus musculus
tctgataaataacagggcaatgcga

SEQ ID NO: 973042 - DNA, 25 bp, Mus musculus
tctgataaataagagggcaatgcga

SEQ ID NO: 973043 - DNA, 25 bp, Mus musculus
tctgatacagcgcggagttcagagg

SEQ ID NO: 973044 - DNA, 25 bp, Mus musculus
tctgatacagggcggagttcagagg

SEQ ID NO: 973045 - DNA, 25 bp, Mus musculus
tctgatcaacagctctccattttga

SEQ ID NO: 973046 - DNA, 25 bp, Mus musculus
tctgatcaacaggtctccattttga

SEQ ID NO: 973047 - DNA, 25 bp, Mus musculus
tctgatcagcagagtgaaatggtta

SEQ ID NO: 973048 - DNA, 25 bp, Mus musculus
tctgatcagcagtgtgaaatggtta

SEQ ID NO: 973049 - DNA, 25 bp, Mus musculus
tctgatccttcaaggcagtgaagaa

SEQ ID NO: 973050 - DNA, 25 bp, Mus musculus
tctgatccttcatggcagtgaagaa

SEQ ID NO: 973051 - DNA, 25 bp, Mus musculus
tctgatcgacctcgtccccagtctg

SEQ ID NO: 973052 - DNA, 25 bp, Mus musculus
tctgatcgacctggtccccagtctg

SEQ ID NO: 973053 - DNA, 25 bp, Mus musculus
tctgatcgtgtacacggtgaagttg

SEQ ID NO: 973054 - DNA, 25 bp, Mus musculus
tctgatcgtgtacagggtgaagttg

SEQ ID NO: 973055 - DNA, 25 bp, Mus musculus
tctgatctgagacaaactgacagtg

SEQ ID NO: 973056 - DNA, 25 bp, Mus musculus
tctgatctgagacgcctctcctgca

SEQ ID NO: 973057 - DNA, 25 bp, Mus musculus
tctgatctgagacttagaaactgac

SEQ ID NO: 973058 - DNA, 25 bp, Mus musculus
tctgatctgagagaaactgacagtg

SEQ ID NO: 973059 - DNA, 25 bp, Mus musculus
tctgatctgagaggcctctcctgca

SEQ ID NO: 973060 - DNA, 25 bp, Mus musculus
tctgatctgagagttagaaactgac

SEQ ID NO: 973061 - DNA, 25 bp, Mus musculus
tctgatctggctttggacaaagtgc

SEQ ID NO: 973062 - DNA, 25 bp, Mus musculus
tctgatctgggtttggacaaagtgc

SEQ ID NO: 973063 - DNA, 25 bp, Mus musculus
tctgatgaagcaaccacactgggtg

SEQ ID NO: 973064 - DNA, 25 bp, Mus musculus
tctgatgaagcatccacactgggtg

SEQ ID NO: 973065 - DNA, 25 bp, Mus musculus
tctgatgaccatactgtctgcctgt

SEQ ID NO: 973066 - DNA, 25 bp, Mus musculus
tctgatgaccattctgtctgcctgt

SEQ ID NO: 973067 - DNA, 25 bp, Mus musculus
tctgatgggcagcacagcgactccg

SEQ ID NO: 973068 - DNA, 25 bp, Mus musculus
tctgatgggcaggacagcgactccg

SEQ ID NO: 973069 - DNA, 25 bp, Mus musculus
tctgatggggagctgtttgcctggg

SEQ ID NO: 973070 - DNA, 25 bp, Mus musculus
tctgatggggaggtgtttgcctggg

SEQ ID NO: 973071 - DNA, 25 bp, Mus musculus
tctgattacaacatccagaaagagt

SEQ ID NO: 973072 - DNA, 25 bp, Mus musculus
tctgattacaacttccagaaagagt

SEQ ID NO: 973073 - DNA, 25 bp, Mus musculus
tctgattcctcacggcatcgtgaag

SEQ ID NO: 973074 - DNA, 25 bp, Mus musculus
tctgattcctcagggcatcgtgaag

SEQ ID NO: 973075 - DNA, 25 bp, Mus musculus
tctgattctgcttttgctattcagg

SEQ ID NO: 973076 - DNA, 25 bp, Mus musculus
tctgattctggttttgctattcagg

SEQ ID NO: 973077 - DNA, 25 bp, Mus musculus
tctgatttaaagctcatccactgga

SEQ ID NO: 973078 - DNA, 25 bp, Mus musculus
tctgatttaaaggtcatccactgga

SEQ ID NO: 973079 - DNA, 25 bp, Mus musculus
tctgcaaaaacacatgtggaaagag

SEQ ID NO: 973080 - DNA, 25 bp, Mus musculus
tctgcaaaaacagatgtggaaagag

SEQ ID NO: 973081 - DNA, 25 bp, Mus musculus
tctgcaaaaaggcgatggaattcga

SEQ ID NO: 973082 - DNA, 25 bp, Mus musculus
tctgcaaaaaggggatggaattcga

SEQ ID NO: 973083 - DNA, 25 bp, Mus musculus
tctgcaaacactgccaccaaaagcc

SEQ ID NO: 973084 - DNA, 25 bp, Mus musculus
tctgcaaacagtgccaccaaaagcc

SEQ ID NO: 973085 - DNA, 25 bp, Mus musculus
tctgcaaaccatcatctcaagacca

SEQ ID NO: 973086 - DNA, 25 bp, Mus musculus
tctgcaaaccatccctcaatctagg

SEQ ID NO: 973087 - DNA, 25 bp, Mus musculus
tctgcaaaccatgatctcaagacca

SEQ ID NO: 973088 - DNA, 25 bp, Mus musculus
tctgcaaaccatgcctcaatctagg

SEQ ID NO: 973089 - DNA, 25 bp, Mus musculus
tctgcaaatggccaaagtcctaggt

SEQ ID NO: 973090 - DNA, 25 bp, Mus musculus
tctgcaaatggcgaaagtcctaggt

SEQ ID NO: 973091 - DNA, 25 bp, Mus musculus
tctgcaacagatgtttaatgaactt

SEQ ID NO: 973092 - DNA, 25 bp, Mus musculus
tctgcaacagttgtttaatgaactt

SEQ ID NO: 973093 - DNA, 25 bp, Mus musculus
tctgcaaccaagccctttgtagatt

SEQ ID NO: 973094 - DNA, 25 bp, Mus musculus
tctgcaaccaaggcctttgtagatt

SEQ ID NO: 973095 - DNA, 25 bp, Mus musculus
tctgcaagaacacctaggctggcct

SEQ ID NO: 973096 - DNA, 25 bp, Mus musculus
tctgcaagaacagctaggctggcct

SEQ ID NO: 973097 - DNA, 25 bp, Mus musculus
tctgcaagagctttgcggtgagcat

SEQ ID NO: 973098 - DNA, 25 bp, Mus musculus
tctgcaagaggtttgcggtgagcat

SEQ ID NO: 973099 - DNA, 25 bp, Mus musculus
tctgcaagccaaccagtctctggtc

SEQ ID NO: 973100 - DNA, 25 bp, Mus musculus
tctgcaagccaagcagtctctggtc

SEQ ID NO: 973101 - DNA, 25 bp, Mus musculus
tctgcaagctggatgataaggacct

SEQ ID NO: 973102 - DNA, 25 bp, Mus musculus
tctgcaagctggttgataaggacct

SEQ ID NO: 973103 - DNA, 25 bp, Mus musculus
tctgcaaggctgagtatacagtttt

SEQ ID NO: 973104 - DNA, 25 bp, Mus musculus
tctgcaaggctgtgcgctccatagg

SEQ ID NO: 973105 - DNA, 25 bp, Mus musculus
tctgcaaggctgtgggctccatagg

SEQ ID NO: 973106 - DNA, 25 bp, Mus musculus
tctgcaaggctgtgtatacagtttt

SEQ ID NO: 973107 - DNA, 25 bp, Mus musculus
tctgcaagtgcgtgggaccatcatc

SEQ ID NO: 973108 - DNA, 25 bp, Mus musculus
tctgcaagtgggtgggaccatcatc

SEQ ID NO: 973109 - DNA, 25 bp, Mus musculus
tctgcaagttaaaacgaacttctgc

SEQ ID NO: 973110 - DNA, 25 bp, Mus musculus
tctgcaagttaaaaggaacttctgc

SEQ ID NO: 973111 - DNA, 25 bp, Mus musculus
tctgcaatataacgcacaatggaag

SEQ ID NO: 973112 - DNA, 25 bp, Mus musculus
tctgcaatataaggcacaatggaag

SEQ ID NO: 973113 - DNA, 25 bp, Mus musculus
tctgcaatcagacattttgcgtggg

SEQ ID NO: 973114 - DNA, 25 bp, Mus musculus
tctgcaatcagagattttgcgtggg

SEQ ID NO: 973115 - DNA, 25 bp, Mus musculus
tctgcacaagactccagtggaagag

SEQ ID NO: 973116 - DNA, 25 bp, Mus musculus
tctgcacaagtctccagtggaagag

SEQ ID NO: 973117 - DNA, 25 bp, Mus musculus
tctgcacagacacgagcatgcaaaa

SEQ ID NO: 973118 - DNA, 25 bp, Mus musculus
tctgcacagacaggagcatgcaaaa

SEQ ID NO: 973119 - DNA, 25 bp, Mus musculus
tctgcaccacgtcactatgattcct

SEQ ID NO: 973120 - DNA, 25 bp, Mus musculus
tctgcaccacgtcagtatgattcct

SEQ ID NO: 973121 - DNA, 25 bp, Mus musculus
tctgcaccagacccacaggctgaag

SEQ ID NO: 973122 - DNA, 25 bp, Mus musculus
tctgcaccagtcccacaggctgaag

SEQ ID NO: 973123 - DNA, 25 bp, Mus musculus
tctgcacgcctacaccttcctggtg

SEQ ID NO: 973124 - DNA, 25 bp, Mus musculus
tctgcacgcctacagcttcctggtg

SEQ ID NO: 973125 - DNA, 25 bp, Mus musculus
tctgcactcaggaacggcccctgta

SEQ ID NO: 973126 - DNA, 25 bp, Mus musculus
tctgcactcaggaagggcccctgta

SEQ ID NO: 973127 - DNA, 25 bp, Mus musculus
tctgcactctttttcgtatgatcac

SEQ ID NO: 973128 - DNA, 25 bp, Mus musculus
tctgcactctttttggtatgatcac

SEQ ID NO: 973129 - DNA, 25 bp, Mus musculus
tctgcactggacttcctgaaacctg

SEQ ID NO: 973130 - DNA, 25 bp, Mus musculus
tctgcactggacttgctgaaacctg

SEQ ID NO: 973131 - DNA, 25 bp, Mus musculus
tctgcacttagacaaagcacaatgg

SEQ ID NO: 973132 - DNA, 25 bp, Mus musculus
tctgcacttagagaaagcacaatgg

SEQ ID NO: 973133 - DNA, 25 bp, Mus musculus
tctgcacttcagaaatgctaccact

SEQ ID NO: 973134 - DNA, 25 bp, Mus musculus
tctgcacttcagctgtatggacgcc

SEQ ID NO: 973135 - DNA, 25 bp, Mus musculus
tctgcacttcaggtgtatggacgcc

SEQ ID NO: 973136 - DNA, 25 bp, Mus musculus
tctgcacttcagtaatgctaccact

SEQ ID NO: 973137 - DNA, 25 bp, Mus musculus
tctgcagagcagcacgaacctgtgt

SEQ ID NO: 973138 - DNA, 25 bp, Mus musculus
tctgcagagcagcaggaacctgtgt

SEQ ID NO: 973139 - DNA, 25 bp, Mus musculus
tctgcagataagactgtagctttat

SEQ ID NO: 973140 - DNA, 25 bp, Mus musculus
tctgcagataagtctgtagctttat

SEQ ID NO: 973141 - DNA, 25 bp, Mus musculus
tctgcagatgattgtgaacacttca

SEQ ID NO: 973142 - DNA, 25 bp, Mus musculus
tctgcagatgtttgtgaacacttca

SEQ ID NO: 973143 - DNA, 25 bp, Mus musculus
tctgcagcacagcccatccatccag

SEQ ID NO: 973144 - DNA, 25 bp, Mus musculus
tctgcagcacaggccatccatccag

SEQ ID NO: 973145 - DNA, 25 bp, Mus musculus
tctgcagcatccaggtgccgtgtta

SEQ ID NO: 973146 - DNA, 25 bp, Mus musculus
tctgcagcatcctggtgccgtgtta

SEQ ID NO: 973147 - DNA, 25 bp, Mus musculus
tctgcagctgaatgttgtatgggca

SEQ ID NO: 973148 - DNA, 25 bp, Mus musculus
tctgcagctgctcacagctctggaa

SEQ ID NO: 973149 - DNA, 25 bp, Mus musculus
tctgcagctggtcacagctctggaa

SEQ ID NO: 973150 - DNA, 25 bp, Mus musculus
tctgcagctgtatgttgtatgggca

SEQ ID NO: 973151 - DNA, 25 bp, Mus musculus
tctgcaggagcacgccaacgagggc

SEQ ID NO: 973152 - DNA, 25 bp, Mus musculus
tctgcaggagcaggccaacgagggc

SEQ ID NO: 973153 - DNA, 25 bp, Mus musculus
tctgcagtagggcctgctgaataat

SEQ ID NO: 973154 - DNA, 25 bp, Mus musculus
tctgcagtaggggctgctgaataat

SEQ ID NO: 973155 - DNA, 25 bp, Mus musculus
tctgcagtcaaaagacaaggaacag

SEQ ID NO: 973156 - DNA, 25 bp, Mus musculus
tctgcagtcaaatgacaaggaacag

SEQ ID NO: 973157 - DNA, 25 bp, Mus musculus
tctgcatcagcgcatctctcaatct

SEQ ID NO: 973158 - DNA, 25 bp, Mus musculus
tctgcatcagcggatctctcaatct

SEQ ID NO: 973159 - DNA, 25 bp, Mus musculus
tctgcatcagtgaccgtaaaccagt

SEQ ID NO: 973160 - DNA, 25 bp, Mus musculus
tctgcatcagtgacggtaaaccagt

SEQ ID NO: 973161 - DNA, 25 bp, Mus musculus
tctgcatcatggcatgtgagccagt

SEQ ID NO: 973162 - DNA, 25 bp, Mus musculus
tctgcatcatgggatgtgagccagt

SEQ ID NO: 973163 - DNA, 25 bp, Mus musculus
tctgcatccgaactcatattcctgt

SEQ ID NO: 973164 - DNA, 25 bp, Mus musculus
tctgcatccgtactcatattcctgt

SEQ ID NO: 973165 - DNA, 25 bp, Mus musculus
tctgcatctctgacctccggatccc

SEQ ID NO: 973166 - DNA, 25 bp, Mus musculus
tctgcatctctgtcctccggatccc

SEQ ID NO: 973167 - DNA, 25 bp, Mus musculus
tctgcatgttgattcaagaagctac

SEQ ID NO: 973168 - DNA, 25 bp, Mus musculus
tctgcatgttgattgaagaagctac

SEQ ID NO: 973169 - DNA, 25 bp, Mus musculus
tctgccaaagatcttgcaaagcagc

SEQ ID NO: 973170 - DNA, 25 bp, Mus musculus
tctgccaaagatgttgcaaagcagc

SEQ ID NO: 973171 - DNA, 25 bp, Mus musculus
tctgccaacaatgacgggatttcta

SEQ ID NO: 973172 - DNA, 25 bp, Mus musculus
tctgccaacattgacgggatttcta

SEQ ID NO: 973173 - DNA, 25 bp, Mus musculus
tctgccaaccatatgggaagatcgt

SEQ ID NO: 973174 - DNA, 25 bp, Mus musculus
tctgccaaccttatgggaagatcgt

SEQ ID NO: 973175 - DNA, 25 bp, Mus musculus
tctgccaatgaacagaacaagtatg

SEQ ID NO: 973176 - DNA, 25 bp, Mus musculus
tctgccaatgaagagaacaagtatg

SEQ ID NO: 973177 - DNA, 25 bp, Mus musculus
tctgccacatagaacgctctcagca

SEQ ID NO: 973178 - DNA, 25 bp, Mus musculus
tctgccacatagaaggctctcagca

SEQ ID NO: 973179 - DNA, 25 bp, Mus musculus
tctgccaccaagcacaaacagcacc

SEQ ID NO: 973180 - DNA, 25 bp, Mus musculus
tctgccaccaagcacgagattacct

SEQ ID NO: 973181 - DNA, 25 bp, Mus musculus
tctgccaccaagcagaaacagcacc

SEQ ID NO: 973182 - DNA, 25 bp, Mus musculus
tctgccaccaagcaggagattacct

SEQ ID NO: 973183 - DNA, 25 bp, Mus musculus
tctgccacgacctacgtcatgggcc

SEQ ID NO: 973184 - DNA, 25 bp, Mus musculus
tctgccacgacctaggtcatgggcc

SEQ ID NO: 973185 - DNA, 25 bp, Mus musculus
tctgccagatttaacctgggcatgt

SEQ ID NO: 973186 - DNA, 25 bp, Mus musculus
tctgccagatttaagctgggcatgt

SEQ ID NO: 973187 - DNA, 25 bp, Mus musculus
tctgccagcaagctgtagctacttc

SEQ ID NO: 973188 - DNA, 25 bp, Mus musculus
tctgccagcaaggtgtagctacttc

SEQ ID NO: 973189 - DNA, 25 bp, Mus musculus
tctgccagttcaactttatccaccg

SEQ ID NO: 973190 - DNA, 25 bp, Mus musculus
tctgccagttcatctttatccaccg

SEQ ID NO: 973191 - DNA, 25 bp, Mus musculus
tctgcccacacacggtgtgtcccca

SEQ ID NO: 973192 - DNA, 25 bp, Mus musculus
tctgcccacacacgttctgcagtac

SEQ ID NO: 973193 - DNA, 25 bp, Mus musculus
tctgcccacacagggtgtgtcccca

SEQ ID NO: 973194 - DNA, 25 bp, Mus musculus
tctgcccacacaggttctgcagtac

SEQ ID NO: 973195 - DNA, 25 bp, Mus musculus
tctgcccaccagccttggaagggag

SEQ ID NO: 973196 - DNA, 25 bp, Mus musculus
tctgcccaccaggcttggaagggag

SEQ ID NO: 973197 - DNA, 25 bp, Mus musculus
tctgcccagcagcgtgaagaggttc

SEQ ID NO: 973198 - DNA, 25 bp, Mus musculus
tctgcccagcagggtgaagaggttc

SEQ ID NO: 973199 - DNA, 25 bp, Mus musculus
tctgcccatgtgatcatgattctgg

SEQ ID NO: 973200 - DNA, 25 bp, Mus musculus
tctgcccatgtgttcatgattctgg

SEQ ID NO: 973201 - DNA, 25 bp, Mus musculus
tctgccctacagaatactgtggcac

SEQ ID NO: 973202 - DNA, 25 bp, Mus musculus
tctgccctacagtatactgtggcac

SEQ ID NO: 973203 - DNA, 25 bp, Mus musculus
tctgccctacccgactggacgcgac

SEQ ID NO: 973204 - DNA, 25 bp, Mus musculus
tctgccctacccgagtggacgcgac

SEQ ID NO: 973205 - DNA, 25 bp, Mus musculus
tctgccctagtgagagactctacac

SEQ ID NO: 973206 - DNA, 25 bp, Mus musculus
tctgccctagtgagtgactctacac

SEQ ID NO: 973207 - DNA, 25 bp, Mus musculus
tctgccctcacacacaaaggcctaa

SEQ ID NO: 973208 - DNA, 25 bp, Mus musculus
tctgccctcacacacagaggtctga

SEQ ID NO: 973209 - DNA, 25 bp, Mus musculus
tctgccctcacacacgcctaaagaa

SEQ ID NO: 973210 - DNA, 25 bp, Mus musculus
tctgccctcacacacgtttccctct

SEQ ID NO: 973211 - DNA, 25 bp, Mus musculus
tctgccctcacacagaaaggcctaa

SEQ ID NO: 973212 - DNA, 25 bp, Mus musculus
tctgccctcacacagagaggtctga

SEQ ID NO: 973213 - DNA, 25 bp, Mus musculus
tctgccctcacacaggcctaaagaa

SEQ ID NO: 973214 - DNA, 25 bp, Mus musculus
tctgccctcacacaggtttccctct

SEQ ID NO: 973215 - DNA, 25 bp, Mus musculus
tctgccctgtgactttcaggtgcca

SEQ ID NO: 973216 - DNA, 25 bp, Mus musculus
tctgccctgtgagtttcaggtgcca

SEQ ID NO: 973217 - DNA, 25 bp, Mus musculus
tctgcccttcttcactgggagtctg

SEQ ID NO: 973218 - DNA, 25 bp, Mus musculus
tctgcccttcttcagtgggagtctg

SEQ ID NO: 973219 - DNA, 25 bp, Mus musculus
tctgcccttgcacgtaaaatttgct

SEQ ID NO: 973220 - DNA, 25 bp, Mus musculus
tctgcccttgcaggtaaaatttgct

SEQ ID NO: 973221 - DNA, 25 bp, Mus musculus
tctgccctttttcgctgcagagata

SEQ ID NO: 973222 - DNA, 25 bp, Mus musculus
tctgccctttttctgccgtggtgag

SEQ ID NO: 973223 - DNA, 25 bp, Mus musculus
tctgccctttttggctgcagagata

SEQ ID NO: 973224 - DNA, 25 bp, Mus musculus
tctgccctttttgtgccgtggtgag

SEQ ID NO: 973225 - DNA, 25 bp, Mus musculus
tctgccgaatcacaggaggtcctga

SEQ ID NO: 973226 - DNA, 25 bp, Mus musculus
tctgccgaatcagaggaggtcctga

SEQ ID NO: 973227 - DNA, 25 bp, Mus musculus
tctgccgcaggacaccaccacgccc

SEQ ID NO: 973228 - DNA, 25 bp, Mus musculus
tctgccgcaggacagcaccacgccc

SEQ ID NO: 973229 - DNA, 25 bp, Mus musculus
tctgccgcatgacgtgtggtactag

SEQ ID NO: 973230 - DNA, 25 bp, Mus musculus
tctgccgcatgaggtgtggtactag

SEQ ID NO: 973231 - DNA, 25 bp, Mus musculus
tctgccgcccgaccagttgccccag

SEQ ID NO: 973232 - DNA, 25 bp, Mus musculus
tctgccgcccgagcagttgccccag

SEQ ID NO: 973233 - DNA, 25 bp, Mus musculus
tctgccgctcttcccgtccctaacc

SEQ ID NO: 973234 - DNA, 25 bp, Mus musculus
tctgccgctcttccggtccctaacc

SEQ ID NO: 973235 - DNA, 25 bp, Mus musculus
tctgccgtggcccacactatcatga

SEQ ID NO: 973236 - DNA, 25 bp, Mus musculus
tctgccgtggcccagactatcatga

SEQ ID NO: 973237 - DNA, 25 bp, Mus musculus
tctgcctaagcggcagactcctaca

SEQ ID NO: 973238 - DNA, 25 bp, Mus musculus
tctgcctaaggggcagactcctaca

SEQ ID NO: 973239 - DNA, 25 bp, Mus musculus
tctgcctacattgacatggagaact

SEQ ID NO: 973240 - DNA, 25 bp, Mus musculus
tctgcctacattgagatggagaact

SEQ ID NO: 973241 - DNA, 25 bp, Mus musculus
tctgcctaccagctgcagagcccct

SEQ ID NO: 973242 - DNA, 25 bp, Mus musculus
tctgcctaccagctggcaaaggaaa

SEQ ID NO: 973243 - DNA, 25 bp, Mus musculus
tctgcctaccaggtgcagagcccct

SEQ ID NO: 973244 - DNA, 25 bp, Mus musculus
tctgcctaccaggtggcaaaggaaa

SEQ ID NO: 973245 - DNA, 25 bp, Mus musculus
tctgcctcaaagctcattggctaag

SEQ ID NO: 973246 - DNA, 25 bp, Mus musculus
tctgcctcaaaggtcattggctaag

SEQ ID NO: 973247 - DNA, 25 bp, Mus musculus
tctgcctcggaccgaattctatcgc

SEQ ID NO: 973248 - DNA, 25 bp, Mus musculus
tctgcctcggacggaattctatcgc

SEQ ID NO: 973249 - DNA, 25 bp, Mus musculus
tctgcctcttcacgaagctgcactg

SEQ ID NO: 973250 - DNA, 25 bp, Mus musculus
tctgcctcttcaggaagctgcactg

SEQ ID NO: 973251 - DNA, 25 bp, Mus musculus
tctgcctcttcatgccggctctgcc

SEQ ID NO: 973252 - DNA, 25 bp, Mus musculus
tctgcctcttcatggcggctctgcc

SEQ ID NO: 973253 - DNA, 25 bp, Mus musculus
tctgcctgacaaatggcagcttcag

SEQ ID NO: 973254 - DNA, 25 bp, Mus musculus
tctgcctgacaaattgacatcagca

SEQ ID NO: 973255 - DNA, 25 bp, Mus musculus
tctgcctgacaattggcagcttcag

SEQ ID NO: 973256 - DNA, 25 bp, Mus musculus
tctgcctgacaatttgacatcagca

SEQ ID NO: 973257 - DNA, 25 bp, Mus musculus
tctgcctgactcagaacaggtgaga

SEQ ID NO: 973258 - DNA, 25 bp, Mus musculus
tctgcctgactcagtacaggtgaga

SEQ ID NO: 973259 - DNA, 25 bp, Mus musculus
tctgccttcctgcattcaccggcgc

SEQ ID NO: 973260 - DNA, 25 bp, Mus musculus
tctgccttcctggattcaccggcgc

SEQ ID NO: 973261 - DNA, 25 bp, Mus musculus
tctgcctttgaaacagacataatga

SEQ ID NO: 973262 - DNA, 25 bp, Mus musculus
tctgcctttgaacatgattctgtta

SEQ ID NO: 973263 - DNA, 25 bp, Mus musculus
tctgcctttgaagatgattctgtta

SEQ ID NO: 973264 - DNA, 25 bp, Mus musculus
tctgcctttgaatcagacataatga

SEQ ID NO: 973265 - DNA, 25 bp, Mus musculus
tctgcctttgggcatgtcgtcaccg

SEQ ID NO: 973266 - DNA, 25 bp, Mus musculus
tctgcctttggggatgtcgtcaccg

SEQ ID NO: 973267 - DNA, 25 bp, Mus musculus
tctgcgaaaaagcgatgactgagtg

SEQ ID NO: 973268 - DNA, 25 bp, Mus musculus
tctgcgaaaaagggatgactgagtg

SEQ ID NO: 973269 - DNA, 25 bp, Mus musculus
tctgcgaaatagacgttcgggcttg

SEQ ID NO: 973270 - DNA, 25 bp, Mus musculus
tctgcgaaatagtcgttcgggcttg

SEQ ID NO: 973271 - DNA, 25 bp, Mus musculus
tctgcgacatttcacgaacctcaag

SEQ ID NO: 973272 - DNA, 25 bp, Mus musculus
tctgcgacatttcaggaacctcaag

SEQ ID NO: 973273 - DNA, 25 bp, Mus musculus
tctgcgaccagactttataaagctg

SEQ ID NO: 973274 - DNA, 25 bp, Mus musculus
tctgcgaccagagtttataaagctg

SEQ ID NO: 973275 - DNA, 25 bp, Mus musculus
tctgcgcagaagcccgcaagccgag

SEQ ID NO: 973276 - DNA, 25 bp, Mus musculus
tctgcgcagaagccggcaagccgag

SEQ ID NO: 973277 - DNA, 25 bp, Mus musculus
tctgcgcagacacgtgtcagctgac

SEQ ID NO: 973278 - DNA, 25 bp, Mus musculus
tctgcgcagacaggtgtcagctgac

SEQ ID NO: 973279 - DNA, 25 bp, Mus musculus
tctgcgcagggacggactataggcg

SEQ ID NO: 973280 - DNA, 25 bp, Mus musculus
tctgcgcagggagggactataggcg

SEQ ID NO: 973281 - DNA, 25 bp, Mus musculus
tctgcgccagctcattgagaaggag

SEQ ID NO: 973282 - DNA, 25 bp, Mus musculus
tctgcgccaggtcattgagaaggag

SEQ ID NO: 973283 - DNA, 25 bp, Mus musculus
tctgcgccatgaaccgtttgaacgc

SEQ ID NO: 973284 - DNA, 25 bp, Mus musculus
tctgcgccatgaacggtttgaacgc

SEQ ID NO: 973285 - DNA, 25 bp, Mus musculus
tctgcgccccggcctccagcatacc

SEQ ID NO: 973286 - DNA, 25 bp, Mus musculus
tctgcgccccgggctccagcatacc

SEQ ID NO: 973287 - DNA, 25 bp, Mus musculus
tctgcgccctcacgatgactgagtg

SEQ ID NO: 973288 - DNA, 25 bp, Mus musculus
tctgcgccctcaggatgactgagtg

SEQ ID NO: 973289 - DNA, 25 bp, Mus musculus
tctgcgctggcacgttgtagatacc

SEQ ID NO: 973290 - DNA, 25 bp, Mus musculus
tctgcgctggcaggacccagggatt

SEQ ID NO: 973291 - DNA, 25 bp, Mus musculus
tctgcgctggcaggtcccagggatt

SEQ ID NO: 973292 - DNA, 25 bp, Mus musculus
tctgcgctggcaggttgtagatacc

SEQ ID NO: 973293 - DNA, 25 bp, Mus musculus
tctgcgtccgtgcccgttctgtact

SEQ ID NO: 973294 - DNA, 25 bp, Mus musculus
tctgcgtccgtgccggttctgtact

SEQ ID NO: 973295 - DNA, 25 bp, Mus musculus
tctgcgtctaaacgcttcgagtacc

SEQ ID NO: 973296 - DNA, 25 bp, Mus musculus
tctgcgtctaaaggcttcgagtacc

SEQ ID NO: 973297 - DNA, 25 bp, Mus musculus
tctgcgtctcgacacaagaccataa

SEQ ID NO: 973298 - DNA, 25 bp, Mus musculus
tctgcgtctcgacacaagaccatca

SEQ ID NO: 973299 - DNA, 25 bp, Mus musculus
tctgcgtctcgagacaagaccataa

SEQ ID NO: 973300 - DNA, 25 bp, Mus musculus
tctgcgtctcgagacaagaccatca

SEQ ID NO: 973301 - DNA, 25 bp, Mus musculus
tctgcgtgcccacggtcctgtgggc

SEQ ID NO: 973302 - DNA, 25 bp, Mus musculus
tctgcgtgcccagggtcctgtgggc

SEQ ID NO: 973303 - DNA, 25 bp, Mus musculus
tctgcgtgctcttccggaattgtgt

SEQ ID NO: 973304 - DNA, 25 bp, Mus musculus
tctgcgtgctgttccggaattgtgt

SEQ ID NO: 973305 - DNA, 25 bp, Mus musculus
tctgctacacagcctcttgccagcc

SEQ ID NO: 973306 - DNA, 25 bp, Mus musculus
tctgctacacaggctcttgccagcc

SEQ ID NO: 973307 - DNA, 25 bp, Mus musculus
tctgctactcccagcggggcctggt

SEQ ID NO: 973308 - DNA, 25 bp, Mus musculus
tctgctactcccaggggggcctggt

SEQ ID NO: 973309 - DNA, 25 bp, Mus musculus
tctgctagagaagggcaagtctgaa

SEQ ID NO: 973310 - DNA, 25 bp, Mus musculus
tctgctagagaaggtgcttcccgga

SEQ ID NO: 973311 - DNA, 25 bp, Mus musculus
tctgctagagactggctctccaagc

SEQ ID NO: 973312 - DNA, 25 bp, Mus musculus
tctgctagagctctggtgttctatt

SEQ ID NO: 973313 - DNA, 25 bp, Mus musculus
tctgctagagcttcacaacaaagag

SEQ ID NO: 973314 - DNA, 25 bp, Mus musculus
tctgctagaggtctggtgttctatt

SEQ ID NO: 973315 - DNA, 25 bp, Mus musculus
tctgctagaggttcacaacaaagag

SEQ ID NO: 973316 - DNA, 25 bp, Mus musculus
tctgctagagtagggcaagtctgaa

SEQ ID NO: 973317 - DNA, 25 bp, Mus musculus
tctgctagagtaggtgcttcccgga

SEQ ID NO: 973318 - DNA, 25 bp, Mus musculus
tctgctagagtctggctctccaagc

SEQ ID NO: 973319 - DNA, 25 bp, Mus musculus
tctgctagccaacatatcaacctga

SEQ ID NO: 973320 - DNA, 25 bp, Mus musculus
tctgctagccaacgtgctggattaa

SEQ ID NO: 973321 - DNA, 25 bp, Mus musculus
tctgctagccaagatatcaacctga

SEQ ID NO: 973322 - DNA, 25 bp, Mus musculus
tctgctagccaaggtgctggattaa

SEQ ID NO: 973323 - DNA, 25 bp, Mus musculus
tctgctatcaagctgcagagcccct

SEQ ID NO: 973324 - DNA, 25 bp, Mus musculus
tctgctatcaaggtgcagagcccct

SEQ ID NO: 973325 - DNA, 25 bp, Mus musculus
tctgctattgcacaggtggcttttg

SEQ ID NO: 973326 - DNA, 25 bp, Mus musculus
tctgctattgcacgtttcctggcag

SEQ ID NO: 973327 - DNA, 25 bp, Mus musculus
tctgctattgcagaggtggcttttg

SEQ ID NO: 973328 - DNA, 25 bp, Mus musculus
tctgctattgcaggtttcctggcag

SEQ ID NO: 973329 - DNA, 25 bp, Mus musculus
tctgctcacccacacagtgctgacc

SEQ ID NO: 973330 - DNA, 25 bp, Mus musculus
tctgctcacccacagagtgctgacc

SEQ ID NO: 973331 - DNA, 25 bp, Mus musculus
tctgctcagcagccactctctacaa

SEQ ID NO: 973332 - DNA, 25 bp, Mus musculus
tctgctcagcagcgataactctctg

SEQ ID NO: 973333 - DNA, 25 bp, Mus musculus
tctgctcagcaggcactctctacaa

SEQ ID NO: 973334 - DNA, 25 bp, Mus musculus
tctgctcagcagggataactctctg

SEQ ID NO: 973335 - DNA, 25 bp, Mus musculus
tctgctcaggccggcttcatttgga

SEQ ID NO: 973336 - DNA, 25 bp, Mus musculus
tctgctcagggcggcttcatttgga

SEQ ID NO: 973337 - DNA, 25 bp, Mus musculus
tctgctcatcatctccattcctccc

SEQ ID NO: 973338 - DNA, 25 bp, Mus musculus
tctgctcatcatctgcattcctccc

SEQ ID NO: 973339 - DNA, 25 bp, Mus musculus
tctgctccaaagagatttccgcata

SEQ ID NO: 973340 - DNA, 25 bp, Mus musculus
tctgctccaaagtgatttccgcata

SEQ ID NO: 973341 - DNA, 25 bp, Mus musculus
tctgctccagcaaggtgcagagctt

SEQ ID NO: 973342 - DNA, 25 bp, Mus musculus
tctgctccaggaaggtgcagagctt

SEQ ID NO: 973343 - DNA, 25 bp, Mus musculus
tctgctccgcgccacgctcctgctt

SEQ ID NO: 973344 - DNA, 25 bp, Mus musculus
tctgctccgcgccaggctcctgctt

SEQ ID NO: 973345 - DNA, 25 bp, Mus musculus
tctgctgatggccacactctgtttg

SEQ ID NO: 973346 - DNA, 25 bp, Mus musculus
tctgctgatggccagactctgtttg

SEQ ID NO: 973347 - DNA, 25 bp, Mus musculus
tctgctgcatcacaacctcttacat

SEQ ID NO: 973348 - DNA, 25 bp, Mus musculus
tctgctgcatcaccccagcactatg

SEQ ID NO: 973349 - DNA, 25 bp, Mus musculus
tctgctgcatcacgtaccaccagct

SEQ ID NO: 973350 - DNA, 25 bp, Mus musculus
tctgctgcatcagaacctcttacat

SEQ ID NO: 973351 - DNA, 25 bp, Mus musculus
tctgctgcatcagcccagcactatg

SEQ ID NO: 973352 - DNA, 25 bp, Mus musculus
tctgctgcatcaggtaccaccagct

SEQ ID NO: 973353 - DNA, 25 bp, Mus musculus
tctgctgccatggtagtgatggaca

SEQ ID NO: 973354 - DNA, 25 bp, Mus musculus
tctgctgccatggttgtgatggaca

SEQ ID NO: 973355 - DNA, 25 bp, Mus musculus
tctgctgctagccacctatttcttg

SEQ ID NO: 973356 - DNA, 25 bp, Mus musculus
tctgctgctagccagctatttcttg

SEQ ID NO: 973357 - DNA, 25 bp, Mus musculus
tctgctgctcataactggtatgcaa

SEQ ID NO: 973358 - DNA, 25 bp, Mus musculus
tctgctgctcataagtggtatgcaa

SEQ ID NO: 973359 - DNA, 25 bp, Mus musculus
tctgctgctgatatcccctttgatg

SEQ ID NO: 973360 - DNA, 25 bp, Mus musculus
tctgctgctgctcgaacgggttcca

SEQ ID NO: 973361 - DNA, 25 bp, Mus musculus
tctgctgctgctggaacgggttcca

SEQ ID NO: 973362 - DNA, 25 bp, Mus musculus
tctgctgctgttatcccctttgatg

SEQ ID NO: 973363 - DNA, 25 bp, Mus musculus
tctgctggaaaacaaactaagtgtt

SEQ ID NO: 973364 - DNA, 25 bp, Mus musculus
tctgctggaaaagaaactaagtgtt

SEQ ID NO: 973365 - DNA, 25 bp, Mus musculus
tctgctggaacccactgatgtctcc

SEQ ID NO: 973366 - DNA, 25 bp, Mus musculus
tctgctggaacccagtgatgtctcc

SEQ ID NO: 973367 - DNA, 25 bp, Mus musculus
tctgctggacagccaatccattccc

SEQ ID NO: 973368 - DNA, 25 bp, Mus musculus
tctgctggacaggcaatccattccc

SEQ ID NO: 973369 - DNA, 25 bp, Mus musculus
tctgctggggaccttcttcacctgc

SEQ ID NO: 973370 - DNA, 25 bp, Mus musculus
tctgctggggacgttcttcacctgc

SEQ ID NO: 973371 - DNA, 25 bp, Mus musculus
tctgctgtatggagcccagcacggc

SEQ ID NO: 973372 - DNA, 25 bp, Mus musculus
tctgctgtatggctggtctatcaca

SEQ ID NO: 973373 - DNA, 25 bp, Mus musculus
tctgctgtatgggtggtctatcaca

SEQ ID NO: 973374 - DNA, 25 bp, Mus musculus
tctgctgtatggtgcccagcacggc

SEQ ID NO: 973375 - DNA, 25 bp, Mus musculus
tctgctgtccagaacgtggggctta

SEQ ID NO: 973376 - DNA, 25 bp, Mus musculus
tctgctgtccagaaggtggggctta

SEQ ID NO: 973377 - DNA, 25 bp, Mus musculus
tctgctgtccagaggggacctccag

SEQ ID NO: 973378 - DNA, 25 bp, Mus musculus
tctgctgtccagtggggacctccag

SEQ ID NO: 973379 - DNA, 25 bp, Mus musculus
tctgcttaaaatcacgaaattttgc

SEQ ID NO: 973380 - DNA, 25 bp, Mus musculus
tctgcttaaaatcacgcagggagaa

SEQ ID NO: 973381 - DNA, 25 bp, Mus musculus
tctgcttaaaatcaggaaattttgc

SEQ ID NO: 973382 - DNA, 25 bp, Mus musculus
tctgcttaaaatcaggcagggagaa

SEQ ID NO: 973383 - DNA, 25 bp, Mus musculus
tctgcttgagcaagaagctcactat

SEQ ID NO: 973384 - DNA, 25 bp, Mus musculus
tctgcttgaggaagaagctcactat

SEQ ID NO: 973385 - DNA, 25 bp, Mus musculus
tctgcttgatctcctagaagaccct

SEQ ID NO: 973386 - DNA, 25 bp, Mus musculus
tctgcttgatgtcctagaagaccct

SEQ ID NO: 973387 - DNA, 25 bp, Mus musculus
tctgctttctctggcaatgtgattt

SEQ ID NO: 973388 - DNA, 25 bp, Mus musculus
tctgctttctctgggaatgtgattt

SEQ ID NO: 973389 - DNA, 25 bp, Mus musculus
tctggaaaacagccccacagaacat

SEQ ID NO: 973390 - DNA, 25 bp, Mus musculus
tctggaaaacaggcccacagaacat

SEQ ID NO: 973391 - DNA, 25 bp, Mus musculus
tctggaaaccagagatgggcaagtc

SEQ ID NO: 973392 - DNA, 25 bp, Mus musculus
tctggaaaccagagttgggcaagtc

SEQ ID NO: 973393 - DNA, 25 bp, Mus musculus
tctggaaaccagcaagtgagtgcct

SEQ ID NO: 973394 - DNA, 25 bp, Mus musculus
tctggaaaccagcagaacagtacgg

SEQ ID NO: 973395 - DNA, 25 bp, Mus musculus
tctggaaaccaggaagtgagtgcct

SEQ ID NO: 973396 - DNA, 25 bp, Mus musculus
tctggaaaccaggagaacagtacgg

SEQ ID NO: 973397 - DNA, 25 bp, Mus musculus
tctggaaagtgacttacatgaacat

SEQ ID NO: 973398 - DNA, 25 bp, Mus musculus
tctggaaagtgagttacatgaacat

SEQ ID NO: 973399 - DNA, 25 bp, Mus musculus
tctggaaatgccgtgatgagaggct

SEQ ID NO: 973400 - DNA, 25 bp, Mus musculus
tctggaaatggcgtgatgagaggct

SEQ ID NO: 973401 - DNA, 25 bp, Mus musculus
tctggaacagcgtcgaacctccagg

SEQ ID NO: 973402 - DNA, 25 bp, Mus musculus
tctggaacagggtcgaacctccagg

SEQ ID NO: 973403 - DNA, 25 bp, Mus musculus
tctggaacatgacagcgccaagggt

SEQ ID NO: 973404 - DNA, 25 bp, Mus musculus
tctggaacatgagagcgccaagggt

SEQ ID NO: 973405 - DNA, 25 bp, Mus musculus
tctggaatagcgaaaaccgagctgg

SEQ ID NO: 973406 - DNA, 25 bp, Mus musculus
tctggaatagggaaaaccgagctgg

SEQ ID NO: 973407 - DNA, 25 bp, Mus musculus
tctggaatcacacgccaactactgt

SEQ ID NO: 973408 - DNA, 25 bp, Mus musculus
tctggaatcacaggccaactactgt

SEQ ID NO: 973409 - DNA, 25 bp, Mus musculus
tctggaattaaacacgcatgatgca

SEQ ID NO: 973410 - DNA, 25 bp, Mus musculus
tctggaattaaacaggcatgatgca

SEQ ID NO: 973411 - DNA, 25 bp, Mus musculus
tctggaattacacggatcgcttaca

SEQ ID NO: 973412 - DNA, 25 bp, Mus musculus
tctggaattacagggatcgcttaca

SEQ ID NO: 973413 - DNA, 25 bp, Mus musculus
tctggaattccagacattaaaacta

SEQ ID NO: 973414 - DNA, 25 bp, Mus musculus
tctggaattccagagattaaaacta

SEQ ID NO: 973415 - DNA, 25 bp, Mus musculus
tctggaccagagaacaagccacagg

SEQ ID NO: 973416 - DNA, 25 bp, Mus musculus
tctggaccagagaaccagaagccac

SEQ ID NO: 973417 - DNA, 25 bp, Mus musculus
tctggaccagagaagaagccacagg

SEQ ID NO: 973418 - DNA, 25 bp, Mus musculus
tctggaccagagaagcagaagccac

SEQ ID NO: 973419 - DNA, 25 bp, Mus musculus
tctggaccagctcttagaagatgta

SEQ ID NO: 973420 - DNA, 25 bp, Mus musculus
tctggaccaggtcttagaagatgta

SEQ ID NO: 973421 - DNA, 25 bp, Mus musculus
tctggactctcacaacctcagtgca

SEQ ID NO: 973422 - DNA, 25 bp, Mus musculus
tctggactctcagaacctcagtgca

SEQ ID NO: 973423 - DNA, 25 bp, Mus musculus
tctggactggaagacggcatctgtg

SEQ ID NO: 973424 - DNA, 25 bp, Mus musculus
tctggactggaagagggcatctgtg

SEQ ID NO: 973425 - DNA, 25 bp, Mus musculus
tctggactgtcgcgccttccactac

SEQ ID NO: 973426 - DNA, 25 bp, Mus musculus
tctggactgtcgggccttccactac

SEQ ID NO: 973427 - DNA, 25 bp, Mus musculus
tctggacttgggcggacgtatgtga

SEQ ID NO: 973428 - DNA, 25 bp, Mus musculus
tctggacttggggggacgtatgtga

SEQ ID NO: 973429 - DNA, 25 bp, Mus musculus
tctggagaaaggcgcattgatgggc

SEQ ID NO: 973430 - DNA, 25 bp, Mus musculus
tctggagaaaggggcattgatgggc

SEQ ID NO: 973431 - DNA, 25 bp, Mus musculus
tctggagaacaacacttcacctttg

SEQ ID NO: 973432 - DNA, 25 bp, Mus musculus
tctggagaacaagacttcacctttg

SEQ ID NO: 973433 - DNA, 25 bp, Mus musculus
tctggagaagatgtttcgagtcaat

SEQ ID NO: 973434 - DNA, 25 bp, Mus musculus
tctggagaagattgggacttgggat

SEQ ID NO: 973435 - DNA, 25 bp, Mus musculus
tctggagaagttgtttcgagtcaat

SEQ ID NO: 973436 - DNA, 25 bp, Mus musculus
tctggagaagtttgggacttgggat

SEQ ID NO: 973437 - DNA, 25 bp, Mus musculus
tctggagacctgcatggagaaaatg

SEQ ID NO: 973438 - DNA, 25 bp, Mus musculus
tctggagacctggacgatccccagg

SEQ ID NO: 973439 - DNA, 25 bp, Mus musculus
tctggagacctggaggatccccagg

SEQ ID NO: 973440 - DNA, 25 bp, Mus musculus
tctggagacctggatggagaaaatg

SEQ ID NO: 973441 - DNA, 25 bp, Mus musculus
tctggagcagaacacaaaagaaatt

SEQ ID NO: 973442 - DNA, 25 bp, Mus musculus
tctggagcagaacgttatgttcttg

SEQ ID NO: 973443 - DNA, 25 bp, Mus musculus
tctggagcagaagacaaaagaaatt

SEQ ID NO: 973444 - DNA, 25 bp, Mus musculus
tctggagcagaaggttatgttcttg

SEQ ID NO: 973445 - DNA, 25 bp, Mus musculus
tctggagcagagccaataacttcgc

SEQ ID NO: 973446 - DNA, 25 bp, Mus musculus
tctggagcagcaccctcagggctgg

SEQ ID NO: 973447 - DNA, 25 bp, Mus musculus
tctggagcagcagcctcagggctgg

SEQ ID NO: 973448 - DNA, 25 bp, Mus musculus
tctggagcagtgccaataacttcgc

SEQ ID NO: 973449 - DNA, 25 bp, Mus musculus
tctggaggagccagcggccaagcca

SEQ ID NO: 973450 - DNA, 25 bp, Mus musculus
tctggaggagccaggggccaagcca

SEQ ID NO: 973451 - DNA, 25 bp, Mus musculus
tctggaggagctgccggggagccct

SEQ ID NO: 973452 - DNA, 25 bp, Mus musculus
tctggaggagctgttcctatatttc

SEQ ID NO: 973453 - DNA, 25 bp, Mus musculus
tctggaggaggtgccggggagccct

SEQ ID NO: 973454 - DNA, 25 bp, Mus musculus
tctggaggaggtgttcctatatttc

SEQ ID NO: 973455 - DNA, 25 bp, Mus musculus
tctggaggcaagcatggccaggcta

SEQ ID NO: 973456 - DNA, 25 bp, Mus musculus
tctggaggcaagcctatgctgtggg

SEQ ID NO: 973457 - DNA, 25 bp, Mus musculus
tctggaggcaaggatggccaggcta

SEQ ID NO: 973458 - DNA, 25 bp, Mus musculus
tctggaggcaaggctatgctgtggg

SEQ ID NO: 973459 - DNA, 25 bp, Mus musculus
tctggaggtgccgtccctacagccg

SEQ ID NO: 973460 - DNA, 25 bp, Mus musculus
tctggaggtggcgtccctacagccg

SEQ ID NO: 973461 - DNA, 25 bp, Mus musculus
tctggagtgtggcaaaatccaccta

SEQ ID NO: 973462 - DNA, 25 bp, Mus musculus
tctggagtgtgggaaaatccaccta

SEQ ID NO: 973463 - DNA, 25 bp, Mus musculus
tctggagttagccacaatggagaat

SEQ ID NO: 973464 - DNA, 25 bp, Mus musculus
tctggagttagccagaatggagaat

SEQ ID NO: 973465 - DNA, 25 bp, Mus musculus
tctggagttatttacacaagatcct

SEQ ID NO: 973466 - DNA, 25 bp, Mus musculus
tctggagttatttagacaagatcct

SEQ ID NO: 973467 - DNA, 25 bp, Mus musculus
tctggataagagtgcctcgggccca

SEQ ID NO: 973468 - DNA, 25 bp, Mus musculus
tctggataagcccacctggaagcag

SEQ ID NO: 973469 - DNA, 25 bp, Mus musculus
tctggataagcgtggtaaatctcgg

SEQ ID NO: 973470 - DNA, 25 bp, Mus musculus
tctggataagctgcttctgtgtggt

SEQ ID NO: 973471 - DNA, 25 bp, Mus musculus
tctggataaggccacctggaagcag

SEQ ID NO: 973472 - DNA, 25 bp, Mus musculus
tctggataagggtggtaaatctcgg

SEQ ID NO: 973473 - DNA, 25 bp, Mus musculus
tctggataaggtgcttctgtgtggt

SEQ ID NO: 973474 - DNA, 25 bp, Mus musculus
tctggataagtgtgcctcgggccca

SEQ ID NO: 973475 - DNA, 25 bp, Mus musculus
tctggatacccactttgcagatggc

SEQ ID NO: 973476 - DNA, 25 bp, Mus musculus
tctggatacccagtttgcagatggc

SEQ ID NO: 973477 - DNA, 25 bp, Mus musculus
tctggatcacagcagaaaataatga

SEQ ID NO: 973478 - DNA, 25 bp, Mus musculus
tctggatcacaggagaaaataatga

SEQ ID NO: 973479 - DNA, 25 bp, Mus musculus
tctggatcaccacccctccccggtt

SEQ ID NO: 973480 - DNA, 25 bp, Mus musculus
tctggatcacgacccctccccggtt

SEQ ID NO: 973481 - DNA, 25 bp, Mus musculus
tctggatcagctttaccactgcttg

SEQ ID NO: 973482 - DNA, 25 bp, Mus musculus
tctggatcaggtttaccactgcttg

SEQ ID NO: 973483 - DNA, 25 bp, Mus musculus
tctggatcctacattcattacttcc

SEQ ID NO: 973484 - DNA, 25 bp, Mus musculus
tctggatccttcattcattacttcc

SEQ ID NO: 973485 - DNA, 25 bp, Mus musculus
tctggatcgagacaaagtgcaacag

SEQ ID NO: 973486 - DNA, 25 bp, Mus musculus
tctggatcgagacggtctgtcctgt

SEQ ID NO: 973487 - DNA, 25 bp, Mus musculus
tctggatcgagagaaagtgcaacag

SEQ ID NO: 973488 - DNA, 25 bp, Mus musculus
tctggatcgagagggtctgtcctgt

SEQ ID NO: 973489 - DNA, 25 bp, Mus musculus
tctggatgaccacgtggcgctgctc

SEQ ID NO: 973490 - DNA, 25 bp, Mus musculus
tctggatgaccaggtggcgctgctc

SEQ ID NO: 973491 - DNA, 25 bp, Mus musculus
tctggatgagagggagatgagacag

SEQ ID NO: 973492 - DNA, 25 bp, Mus musculus
tctggatgagtgggagatgagacag

SEQ ID NO: 973493 - DNA, 25 bp, Mus musculus
tctggatgctgattcgatttgctat

SEQ ID NO: 973494 - DNA, 25 bp, Mus musculus
tctggatgctgattggatttgctat

SEQ ID NO: 973495 - DNA, 25 bp, Mus musculus
tctggcaaagacacagagcagatcc

SEQ ID NO: 973496 - DNA, 25 bp, Mus musculus
tctggcaaagtcacagagcagatcc

SEQ ID NO: 973497 - DNA, 25 bp, Mus musculus
tctggcaaggcttgtgtaaatctac

SEQ ID NO: 973498 - DNA, 25 bp, Mus musculus
tctggcaagggttgtgtaaatctac

SEQ ID NO: 973499 - DNA, 25 bp, Mus musculus
tctggcaattgccaaggaactgaaa

SEQ ID NO: 973500 - DNA, 25 bp, Mus musculus
tctggcaattgccatggaactgaaa

SEQ ID NO: 973501 - DNA, 25 bp, Mus musculus
tctggcacagaagctgattggcgtc

SEQ ID NO: 973502 - DNA, 25 bp, Mus musculus
tctggcacagccggagagaagcccg

SEQ ID NO: 973503 - DNA, 25 bp, Mus musculus
tctggcacagctgctttgccagata

SEQ ID NO: 973504 - DNA, 25 bp, Mus musculus
tctggcacagcttgcgagttgtaaa

SEQ ID NO: 973505 - DNA, 25 bp, Mus musculus
tctggcacaggcggagagaagcccg

SEQ ID NO: 973506 - DNA, 25 bp, Mus musculus
tctggcacaggtgctttgccagata

SEQ ID NO: 973507 - DNA, 25 bp, Mus musculus
tctggcacaggttgcgagttgtaaa

SEQ ID NO: 973508 - DNA, 25 bp, Mus musculus
tctggcacagtagctgattggcgtc

SEQ ID NO: 973509 - DNA, 25 bp, Mus musculus
tctggcactaacagaacctttagaa

SEQ ID NO: 973510 - DNA, 25 bp, Mus musculus
tctggcactaactgaacctttagaa

SEQ ID NO: 973511 - DNA, 25 bp, Mus musculus
tctggcagaaggatctctctcttgc

SEQ ID NO: 973512 - DNA, 25 bp, Mus musculus
tctggcagaaggttctctctcttgc

SEQ ID NO: 973513 - DNA, 25 bp, Mus musculus
tctggcagtagccaccccatggaag

SEQ ID NO: 973514 - DNA, 25 bp, Mus musculus
tctggcagtagccagcccatggaag

SEQ ID NO: 973515 - DNA, 25 bp, Mus musculus
tctggcatacccgacataaagacta

SEQ ID NO: 973516 - DNA, 25 bp, Mus musculus
tctggcatacccgagataaagacta

SEQ ID NO: 973517 - DNA, 25 bp, Mus musculus
tctggcatcagacctgcccagcggg

SEQ ID NO: 973518 - DNA, 25 bp, Mus musculus
tctggcatcagagctgcccagcggg

SEQ ID NO: 973519 - DNA, 25 bp, Mus musculus
tctggcatccagcacggttttctgg

SEQ ID NO: 973520 - DNA, 25 bp, Mus musculus
tctggcatccagcagggttttctgg

SEQ ID NO: 973521 - DNA, 25 bp, Mus musculus
tctggcatcgggcatgaagaccggg

SEQ ID NO: 973522 - DNA, 25 bp, Mus musculus
tctggcatcggggatgaagaccggg

SEQ ID NO: 973523 - DNA, 25 bp, Mus musculus
tctggcatgggatgcagagtctgta

SEQ ID NO: 973524 - DNA, 25 bp, Mus musculus
tctggcatgggatgcgggacagctg

SEQ ID NO: 973525 - DNA, 25 bp, Mus musculus
tctggcatgggatggagagtctgta

SEQ ID NO: 973526 - DNA, 25 bp, Mus musculus
tctggcatgggatgggggacagctg

SEQ ID NO: 973527 - DNA, 25 bp, Mus musculus
tctggccagtagatactgccttata

SEQ ID NO: 973528 - DNA, 25 bp, Mus musculus
tctggccagtagattctgccttata

SEQ ID NO: 973529 - DNA, 25 bp, Mus musculus
tctggcccataaatgctgttggctg

SEQ ID NO: 973530 - DNA, 25 bp, Mus musculus
tctggcccataattgctgttggctg

SEQ ID NO: 973531 - DNA, 25 bp, Mus musculus
tctggccgtgctcacctataccaga

SEQ ID NO: 973532 - DNA, 25 bp, Mus musculus
tctggccgtgctgacctataccaga

SEQ ID NO: 973533 - DNA, 25 bp, Mus musculus
tctggcctcccatggtgacattata

SEQ ID NO: 973534 - DNA, 25 bp, Mus musculus
tctggcctccgatggtgacattata

SEQ ID NO: 973535 - DNA, 25 bp, Mus musculus
tctggcctcgccaacagttcctcca

SEQ ID NO: 973536 - DNA, 25 bp, Mus musculus
tctggcctcgccaacgtatgtggac

SEQ ID NO: 973537 - DNA, 25 bp, Mus musculus
tctggcctcgccaagagttcctcca

SEQ ID NO: 973538 - DNA, 25 bp, Mus musculus
tctggcctcgccaaggtatgtggac

SEQ ID NO: 973539 - DNA, 25 bp, Mus musculus
tctggcctgaagcgggagcctggag

SEQ ID NO: 973540 - DNA, 25 bp, Mus musculus
tctggcctgaagggggagcctggag

SEQ ID NO: 973541 - DNA, 25 bp, Mus musculus
tctggcgacatgatatttgaaggaa

SEQ ID NO: 973542 - DNA, 25 bp, Mus musculus
tctggcgacatgttatttgaaggaa

SEQ ID NO: 973543 - DNA, 25 bp, Mus musculus
tctggcgggcaaaggtgaatgagaa

SEQ ID NO: 973544 - DNA, 25 bp, Mus musculus
tctggcgggcaaatatcgtcagatt

SEQ ID NO: 973545 - DNA, 25 bp, Mus musculus
tctggcgggcaatggtgaatgagaa

SEQ ID NO: 973546 - DNA, 25 bp, Mus musculus
tctggcgggcaattatcgtcagatt

SEQ ID NO: 973547 - DNA, 25 bp, Mus musculus
tctggctcccggctcatccactctc

SEQ ID NO: 973548 - DNA, 25 bp, Mus musculus
tctggctcccgggtcatccactctc

SEQ ID NO: 973549 - DNA, 25 bp, Mus musculus
tctggctcgaacagcagaagatgat

SEQ ID NO: 973550 - DNA, 25 bp, Mus musculus
tctggctcgaactgcagaagatgat

SEQ ID NO: 973551 - DNA, 25 bp, Mus musculus
tctggctctgtgagtccaccatagg

SEQ ID NO: 973552 - DNA, 25 bp, Mus musculus
tctggctctgtgtgtccaccatagg

SEQ ID NO: 973553 - DNA, 25 bp, Mus musculus
tctggctgtacaatggtatcaacac

SEQ ID NO: 973554 - DNA, 25 bp, Mus musculus
tctggctgtacattggtatcaacac

SEQ ID NO: 973555 - DNA, 25 bp, Mus musculus
tctggcttcctggaagtccagaagg

SEQ ID NO: 973556 - DNA, 25 bp, Mus musculus
tctggcttcctggatgtccagaagg

SEQ ID NO: 973557 - DNA, 25 bp, Mus musculus
tctggcttggccaaagctatgaaat

SEQ ID NO: 973558 - DNA, 25 bp, Mus musculus
tctggcttgggcaaagctatgaaat

SEQ ID NO: 973559 - DNA, 25 bp, Mus musculus
tctggctttcaacggaacaaagaat

SEQ ID NO: 973560 - DNA, 25 bp, Mus musculus
tctggctttcaacttgtggagctcc

SEQ ID NO: 973561 - DNA, 25 bp, Mus musculus
tctggctttcaagggaacaaagaat

SEQ ID NO: 973562 - DNA, 25 bp, Mus musculus
tctggctttcaagttgtggagctcc

SEQ ID NO: 973563 - DNA, 25 bp, Mus musculus
tctgggacaaacatcaccctgagac

SEQ ID NO: 973564 - DNA, 25 bp, Mus musculus
tctgggacaatcatcaccctgagac

SEQ ID NO: 973565 - DNA, 25 bp, Mus musculus
tctgggacctcacgtcccggaactt

SEQ ID NO: 973566 - DNA, 25 bp, Mus musculus
tctgggacctcaggtcccggaactt

SEQ ID NO: 973567 - DNA, 25 bp, Mus musculus
tctgggagaggacgcgtgagcatgc

SEQ ID NO: 973568 - DNA, 25 bp, Mus musculus
tctgggagaggacgggtgagcatgc

SEQ ID NO: 973569 - DNA, 25 bp, Mus musculus
tctgggagtaagatccttggaggag

SEQ ID NO: 973570 - DNA, 25 bp, Mus musculus
tctgggagtaagttccttggaggag

SEQ ID NO: 973571 - DNA, 25 bp, Mus musculus
tctgggatcaatgcagtgttctatt

SEQ ID NO: 973572 - DNA, 25 bp, Mus musculus
tctgggatcaatgctgtgttctatt

SEQ ID NO: 973573 - DNA, 25 bp, Mus musculus
tctgggattcagacattaggattgg

SEQ ID NO: 973574 - DNA, 25 bp, Mus musculus
tctgggattcagtcattaggattgg

SEQ ID NO: 973575 - DNA, 25 bp, Mus musculus
tctgggcacgatcatgccggcagct

SEQ ID NO: 973576 - DNA, 25 bp, Mus musculus
tctgggcacgctaataattttcaag

SEQ ID NO: 973577 - DNA, 25 bp, Mus musculus
tctgggcacggtaataattttcaag

SEQ ID NO: 973578 - DNA, 25 bp, Mus musculus
tctgggcacgttcatgccggcagct

SEQ ID NO: 973579 - DNA, 25 bp, Mus musculus
tctgggcatttgcgacacagcaggt

SEQ ID NO: 973580 - DNA, 25 bp, Mus musculus
tctgggcatttgggacacagcaggt

SEQ ID NO: 973581 - DNA, 25 bp, Mus musculus
tctgggccttcacttttgatgagat

SEQ ID NO: 973582 - DNA, 25 bp, Mus musculus
tctgggccttcagttttgatgagat

SEQ ID NO: 973583 - DNA, 25 bp, Mus musculus
tctgggcgaccgctcacttcatggg

SEQ ID NO: 973584 - DNA, 25 bp, Mus musculus
tctgggcgaccggtcacttcatggg

SEQ ID NO: 973585 - DNA, 25 bp, Mus musculus
tctgggcgatggcgcactggctcca

SEQ ID NO: 973586 - DNA, 25 bp, Mus musculus
tctgggcgatggggcactggctcca

SEQ ID NO: 973587 - DNA, 25 bp, Mus musculus
tctggggaacagactttggacttca

SEQ ID NO: 973588 - DNA, 25 bp, Mus musculus
tctggggaacagtctttggacttca

SEQ ID NO: 973589 - DNA, 25 bp, Mus musculus
tctggggaagccttggccacgaggg

SEQ ID NO: 973590 - DNA, 25 bp, Mus musculus
tctggggaagctgctgcccagacca

SEQ ID NO: 973591 - DNA, 25 bp, Mus musculus
tctggggaaggcttggccacgaggg

SEQ ID NO: 973592 - DNA, 25 bp, Mus musculus
tctggggaaggtgctgcccagacca

SEQ ID NO: 973593 - DNA, 25 bp, Mus musculus
tctggggacaaacgtggaaatggtg

SEQ ID NO: 973594 - DNA, 25 bp, Mus musculus
tctggggacaaaggtggaaatggtg

SEQ ID NO: 973595 - DNA, 25 bp, Mus musculus
tctggggacctcaacgagcgcgggc

SEQ ID NO: 973596 - DNA, 25 bp, Mus musculus
tctggggacctcaaggagcgcgggc

SEQ ID NO: 973597 - DNA, 25 bp, Mus musculus
tctggggagagacacaggaaacaac

SEQ ID NO: 973598 - DNA, 25 bp, Mus musculus
tctggggagagacagaggaaacaac

SEQ ID NO: 973599 - DNA, 25 bp, Mus musculus
tctggggatcagcattattactacc

SEQ ID NO: 973600 - DNA, 25 bp, Mus musculus
tctggggatcaggattattactacc

SEQ ID NO: 973601 - DNA, 25 bp, Mus musculus
tctgggggagcaaagaccacagttg

SEQ ID NO: 973602 - DNA, 25 bp, Mus musculus
tctgggggaggaaagaccacagttg

SEQ ID NO: 973603 - DNA, 25 bp, Mus musculus
tctgggggcaccgacgtctccagca

SEQ ID NO: 973604 - DNA, 25 bp, Mus musculus
tctgggggcaccgactcaaataatt

SEQ ID NO: 973605 - DNA, 25 bp, Mus musculus
tctgggggcaccgaggtctccagca

SEQ ID NO: 973606 - DNA, 25 bp, Mus musculus
tctgggggcaccgagtcaaataatt

SEQ ID NO: 973607 - DNA, 25 bp, Mus musculus
tctggggtggaaaagcggagactga

SEQ ID NO: 973608 - DNA, 25 bp, Mus musculus
tctggggtggaatagcggagactga

SEQ ID NO: 973609 - DNA, 25 bp, Mus musculus
tctggggtggtgaccttaaagcagc

SEQ ID NO: 973610 - DNA, 25 bp, Mus musculus
tctggggtggtgtccttaaagcagc

SEQ ID NO: 973611 - DNA, 25 bp, Mus musculus
tctgggtgtccacacgctgcggcca

SEQ ID NO: 973612 - DNA, 25 bp, Mus musculus
tctgggtgtccagacgctgcggcca

SEQ ID NO: 973613 - DNA, 25 bp, Mus musculus
tctggtaaccagagcggcggtggag

SEQ ID NO: 973614 - DNA, 25 bp, Mus musculus
tctggtaaccagtgcggcggtggag

SEQ ID NO: 973615 - DNA, 25 bp, Mus musculus
tctggtacagcaccctgacgagtca

SEQ ID NO: 973616 - DNA, 25 bp, Mus musculus
tctggtacaggaccctgacgagtca

SEQ ID NO: 973617 - DNA, 25 bp, Mus musculus
tctggtagctcacatctttggtttg

SEQ ID NO: 973618 - DNA, 25 bp, Mus musculus
tctggtagctcagatctttggtttg

SEQ ID NO: 973619 - DNA, 25 bp, Mus musculus
tctggtcatgccacgaacctctcac

SEQ ID NO: 973620 - DNA, 25 bp, Mus musculus
tctggtcatggcacgaacctctcac

SEQ ID NO: 973621 - DNA, 25 bp, Mus musculus
tctggtcgagcaagatgggctcctg

SEQ ID NO: 973622 - DNA, 25 bp, Mus musculus
tctggtcgaggaagatgggctcctg

SEQ ID NO: 973623 - DNA, 25 bp, Mus musculus
tctggtcgttcgcagttttaatgtg

SEQ ID NO: 973624 - DNA, 25 bp, Mus musculus
tctggtcgttcggagttttaatgtg

SEQ ID NO: 973625 - DNA, 25 bp, Mus musculus
tctggtgaagacctacggacatatc

SEQ ID NO: 973626 - DNA, 25 bp, Mus musculus
tctggtgaagacgtacggacatatc

SEQ ID NO: 973627 - DNA, 25 bp, Mus musculus
tctggtgaagattatgggacagtcg

SEQ ID NO: 973628 - DNA, 25 bp, Mus musculus
tctggtgaagtttatgggacagtcg

SEQ ID NO: 973629 - DNA, 25 bp, Mus musculus
tctggtgcagctagagcagctgtat

SEQ ID NO: 973630 - DNA, 25 bp, Mus musculus
tctggtgcaggtagagcagctgtat

SEQ ID NO: 973631 - DNA, 25 bp, Mus musculus
tctggtgtacagagggcggcccatc

SEQ ID NO: 973632 - DNA, 25 bp, Mus musculus
tctggtgtacagtgggcggcccatc

SEQ ID NO: 973633 - DNA, 25 bp, Mus musculus
tctggtgtaccgcgaccagaataag

SEQ ID NO: 973634 - DNA, 25 bp, Mus musculus
tctggtgtaccgggaccagaataag

SEQ ID NO: 973635 - DNA, 25 bp, Mus musculus
tctggtgtagcgaaagaccacacac

SEQ ID NO: 973636 - DNA, 25 bp, Mus musculus
tctggtgtagggaaagaccacacac

SEQ ID NO: 973637 - DNA, 25 bp, Mus musculus
tctggtgtggcaatttttggaccat

SEQ ID NO: 973638 - DNA, 25 bp, Mus musculus
tctggtgtggcactagaaacagata

SEQ ID NO: 973639 - DNA, 25 bp, Mus musculus
tctggtgtggcagtagaaacagata

SEQ ID NO: 973640 - DNA, 25 bp, Mus musculus
tctggtgtggcattttttggaccat

SEQ ID NO: 973641 - DNA, 25 bp, Mus musculus
tctggttatgaacctccccggatcc

SEQ ID NO: 973642 - DNA, 25 bp, Mus musculus
tctggttatgaagctccccggatcc

SEQ ID NO: 973643 - DNA, 25 bp, Mus musculus
tctggttctgctcacaggtcgagta

SEQ ID NO: 973644 - DNA, 25 bp, Mus musculus
tctggttctgctcagaggtcgagta

SEQ ID NO: 973645 - DNA, 25 bp, Mus musculus
tctggttgagcaacaaaatcttgct

SEQ ID NO: 973646 - DNA, 25 bp, Mus musculus
tctggttgagcatcaaaatcttgct

SEQ ID NO: 973647 - DNA, 25 bp, Mus musculus
tctggttgcccacgtgctgggcttg

SEQ ID NO: 973648 - DNA, 25 bp, Mus musculus
tctggttgcccaggtgctgggcttg

SEQ ID NO: 973649 - DNA, 25 bp, Mus musculus
tctgtaaaaaagcttctctatataa

SEQ ID NO: 973650 - DNA, 25 bp, Mus musculus
tctgtaaaaaaggttctctatataa

SEQ ID NO: 973651 - DNA, 25 bp, Mus musculus
tctgtaaactattacatcgtcaacc

SEQ ID NO: 973652 - DNA, 25 bp, Mus musculus
tctgtaaacttttacatcgtcaacc

SEQ ID NO: 973653 - DNA, 25 bp, Mus musculus
tctgtaaagtcatggctgcagcaac

SEQ ID NO: 973654 - DNA, 25 bp, Mus musculus
tctgtaaagtgatggctgcagcaac

SEQ ID NO: 973655 - DNA, 25 bp, Mus musculus
tctgtaacattgatcccacagagca

SEQ ID NO: 973656 - DNA, 25 bp, Mus musculus
tctgtaacattgttcccacagagca

SEQ ID NO: 973657 - DNA, 25 bp, Mus musculus
tctgtaactgacatcagagatcacc

SEQ ID NO: 973658 - DNA, 25 bp, Mus musculus
tctgtaactgcgatcatggcaggat

SEQ ID NO: 973659 - DNA, 25 bp, Mus musculus
tctgtaactgggatcatggcaggat

SEQ ID NO: 973660 - DNA, 25 bp, Mus musculus
tctgtaactgtcatcagagatcacc

SEQ ID NO: 973661 - DNA, 25 bp, Mus musculus
tctgtaatagcaggatgctggtcct

SEQ ID NO: 973662 - DNA, 25 bp, Mus musculus
tctgtaatagctgtgtgctgaagat

SEQ ID NO: 973663 - DNA, 25 bp, Mus musculus
tctgtaataggaggatgctggtcct

SEQ ID NO: 973664 - DNA, 25 bp, Mus musculus
tctgtaataggtgtgtgctgaagat

SEQ ID NO: 973665 - DNA, 25 bp, Mus musculus
tctgtacatccacagccatataagt

SEQ ID NO: 973666 - DNA, 25 bp, Mus musculus
tctgtacatccagagccatataagt

SEQ ID NO: 973667 - DNA, 25 bp, Mus musculus
tctgtaccccgaaacagctcctggg

SEQ ID NO: 973668 - DNA, 25 bp, Mus musculus
tctgtaccccgaaagagctcctggg

SEQ ID NO: 973669 - DNA, 25 bp, Mus musculus
tctgtacccgcttcatcagcaaaga

SEQ ID NO: 973670 - DNA, 25 bp, Mus musculus
tctgtacccggttcatcagcaaaga

SEQ ID NO: 973671 - DNA, 25 bp, Mus musculus
tctgtagaccagcgctaattagtat

SEQ ID NO: 973672 - DNA, 25 bp, Mus musculus
tctgtagaccagggctaattagtat

SEQ ID NO: 973673 - DNA, 25 bp, Mus musculus
tctgtagcagctctagtgacaggat

SEQ ID NO: 973674 - DNA, 25 bp, Mus musculus
tctgtagcaggtctagtgacaggat

SEQ ID NO: 973675 - DNA, 25 bp, Mus musculus
tctgtagtgatgctgcatgccatga

SEQ ID NO: 973676 - DNA, 25 bp, Mus musculus
tctgtagtgatggtgcatgccatga

SEQ ID NO: 973677 - DNA, 25 bp, Mus musculus
tctgtatcatcggacttttggacca

SEQ ID NO: 973678 - DNA, 25 bp, Mus musculus
tctgtatcatcggagttttggacca

SEQ ID NO: 973679 - DNA, 25 bp, Mus musculus
tctgtatccatggacgtattcctcc

SEQ ID NO: 973680 - DNA, 25 bp, Mus musculus
tctgtatccatggaggtattcctcc

SEQ ID NO: 973681 - DNA, 25 bp, Mus musculus
tctgtatgagaacaaagccagtcaa

SEQ ID NO: 973682 - DNA, 25 bp, Mus musculus
tctgtatgagaggctgagagggttg

SEQ ID NO: 973683 - DNA, 25 bp, Mus musculus
tctgtatgagtacaaagccagtcaa

SEQ ID NO: 973684 - DNA, 25 bp, Mus musculus
tctgtatgagtggctgagagggttg

SEQ ID NO: 973685 - DNA, 25 bp, Mus musculus
tctgtattttctcacgtgtgcatgt

SEQ ID NO: 973686 - DNA, 25 bp, Mus musculus
tctgtattttctcaggtgtgcatgt

SEQ ID NO: 973687 - DNA, 25 bp, Mus musculus
tctgtcacccagctttacacgctat

SEQ ID NO: 973688 - DNA, 25 bp, Mus musculus
tctgtcacccaggtttacacgctat

SEQ ID NO: 973689 - DNA, 25 bp, Mus musculus
tctgtcactttatacaacttcacct

SEQ ID NO: 973690 - DNA, 25 bp, Mus musculus
tctgtcactttatagaacttcacct

SEQ ID NO: 973691 - DNA, 25 bp, Mus musculus
tctgtcagtcctatcgcagtaccag

SEQ ID NO: 973692 - DNA, 25 bp, Mus musculus
tctgtcagtcctatggcagtaccag

SEQ ID NO: 973693 - DNA, 25 bp, Mus musculus
tctgtcagtgaccccatgaatgcac

SEQ ID NO: 973694 - DNA, 25 bp, Mus musculus
tctgtcagtgtccccatgaatgcac

SEQ ID NO: 973695 - DNA, 25 bp, Mus musculus
tctgtcatagaaaacaactttcagc

SEQ ID NO: 973696 - DNA, 25 bp, Mus musculus
tctgtcatagaaaagaactttcagc

SEQ ID NO: 973697 - DNA, 25 bp, Mus musculus
tctgtcatcacacacaccctctctc

SEQ ID NO: 973698 - DNA, 25 bp, Mus musculus
tctgtcatcacacattctttaagat

SEQ ID NO: 973699 - DNA, 25 bp, Mus musculus
tctgtcatcacagacaccctctctc

SEQ ID NO: 973700 - DNA, 25 bp, Mus musculus
tctgtcatcacagattctttaagat

SEQ ID NO: 973701 - DNA, 25 bp, Mus musculus
tctgtccacatgcccctgtgatgcc

SEQ ID NO: 973702 - DNA, 25 bp, Mus musculus
tctgtccacatggccctgtgatgcc

SEQ ID NO: 973703 - DNA, 25 bp, Mus musculus
tctgtccagaccaacggtacagcct

SEQ ID NO: 973704 - DNA, 25 bp, Mus musculus
tctgtccagaccaagggtacagcct

SEQ ID NO: 973705 - DNA, 25 bp, Mus musculus
tctgtccagactcacagcctctacc

SEQ ID NO: 973706 - DNA, 25 bp, Mus musculus
tctgtccagagtcacagcctctacc

SEQ ID NO: 973707 - DNA, 25 bp, Mus musculus
tctgtccagagttgcgtcacagcct

SEQ ID NO: 973708 - DNA, 25 bp, Mus musculus
tctgtccagagttgggtcacagcct

SEQ ID NO: 973709 - DNA, 25 bp, Mus musculus
tctgtccctggacggtggctataac

SEQ ID NO: 973710 - DNA, 25 bp, Mus musculus
tctgtccctggagggtggctataac

SEQ ID NO: 973711 - DNA, 25 bp, Mus musculus
tctgtccgagctcgctcatccgatc

SEQ ID NO: 973712 - DNA, 25 bp, Mus musculus
tctgtccgaggtcgctcatccgatc

SEQ ID NO: 973713 - DNA, 25 bp, Mus musculus
tctgtccgctttcacgaggacatta

SEQ ID NO: 973714 - DNA, 25 bp, Mus musculus
tctgtccgctttcaggaggacatta

SEQ ID NO: 973715 - DNA, 25 bp, Mus musculus
tctgtcctgaaacccagagacccgc

SEQ ID NO: 973716 - DNA, 25 bp, Mus musculus
tctgtcctgaaactaggcttctttg

SEQ ID NO: 973717 - DNA, 25 bp, Mus musculus
tctgtcctgaaactctcagaggagc

SEQ ID NO: 973718 - DNA, 25 bp, Mus musculus
tctgtcctgaaagccagagacccgc

SEQ ID NO: 973719 - DNA, 25 bp, Mus musculus
tctgtcctgaaagtaggcttctttg

SEQ ID NO: 973720 - DNA, 25 bp, Mus musculus
tctgtcctgaaagtctcagaggagc

SEQ ID NO: 973721 - DNA, 25 bp, Mus musculus
tctgtcctgactgaaactggttctt

SEQ ID NO: 973722 - DNA, 25 bp, Mus musculus
tctgtcctgagtgaaactggttctt

SEQ ID NO: 973723 - DNA, 25 bp, Mus musculus
tctgtcgattatcacgctttgaacc

SEQ ID NO: 973724 - DNA, 25 bp, Mus musculus
tctgtcgattatcaggctttgaacc

SEQ ID NO: 973725 - DNA, 25 bp, Mus musculus
tctgtcgcagattggaagaattgtt

SEQ ID NO: 973726 - DNA, 25 bp, Mus musculus
tctgtcgcagtttggaagaattgtt

SEQ ID NO: 973727 - DNA, 25 bp, Mus musculus
tctgtcggctgagacgcaggctgtc

SEQ ID NO: 973728 - DNA, 25 bp, Mus musculus
tctgtcggctgagaggcaggctgtc

SEQ ID NO: 973729 - DNA, 25 bp, Mus musculus
tctgtctgttagaagaaatggagct

SEQ ID NO: 973730 - DNA, 25 bp, Mus musculus
tctgtctgttagtagaaatggagct

SEQ ID NO: 973731 - DNA, 25 bp, Mus musculus
tctgtgaaggcttccgagcctccct

SEQ ID NO: 973732 - DNA, 25 bp, Mus musculus
tctgtgaagggttccgagcctccct

SEQ ID NO: 973733 - DNA, 25 bp, Mus musculus
tctgtgactgcattggccgcagacc

SEQ ID NO: 973734 - DNA, 25 bp, Mus musculus
tctgtgactgctttgtggacagtct

SEQ ID NO: 973735 - DNA, 25 bp, Mus musculus
tctgtgactggattggccgcagacc

SEQ ID NO: 973736 - DNA, 25 bp, Mus musculus
tctgtgactggtttgtggacagtct

SEQ ID NO: 973737 - DNA, 25 bp, Mus musculus
tctgtgataccacaccctgaagaag

SEQ ID NO: 973738 - DNA, 25 bp, Mus musculus
tctgtgataccagaccctgaagaag

SEQ ID NO: 973739 - DNA, 25 bp, Mus musculus
tctgtgatcgagaatggctacgtgc

SEQ ID NO: 973740 - DNA, 25 bp, Mus musculus
tctgtgatcgtgaatggctacgtgc

SEQ ID NO: 973741 - DNA, 25 bp, Mus musculus
tctgtgcacacaagtctgagagcaa

SEQ ID NO: 973742 - DNA, 25 bp, Mus musculus
tctgtgcacacatgtctgagagcaa

SEQ ID NO: 973743 - DNA, 25 bp, Mus musculus
tctgtgcactaagtagaaaatgaga

SEQ ID NO: 973744 - DNA, 25 bp, Mus musculus
tctgtgcacttagtagaaaatgaga

SEQ ID NO: 973745 - DNA, 25 bp, Mus musculus
tctgtgcagaagattcaaggtacat

SEQ ID NO: 973746 - DNA, 25 bp, Mus musculus
tctgtgcagaagtttcaaggtacat

SEQ ID NO: 973747 - DNA, 25 bp, Mus musculus
tctgtgccagaacgggaccgagaga

SEQ ID NO: 973748 - DNA, 25 bp, Mus musculus
tctgtgccagaaggggaccgagaga

SEQ ID NO: 973749 - DNA, 25 bp, Mus musculus
tctgtgccagacatcctgcagttca

SEQ ID NO: 973750 - DNA, 25 bp, Mus musculus
tctgtgccagccatgaatgtcctgg

SEQ ID NO: 973751 - DNA, 25 bp, Mus musculus
tctgtgccaggcatgaatgtcctgg

SEQ ID NO: 973752 - DNA, 25 bp, Mus musculus
tctgtgccagtcatcctgcagttca

SEQ ID NO: 973753 - DNA, 25 bp, Mus musculus
tctgtgccattgccagtggttctga

SEQ ID NO: 973754 - DNA, 25 bp, Mus musculus
tctgtgccattgcctgtggttctga

SEQ ID NO: 973755 - DNA, 25 bp, Mus musculus
tctgtgcccgctggcgtgtgctggc

SEQ ID NO: 973756 - DNA, 25 bp, Mus musculus
tctgtgcccggtggcgtgtgctggc

SEQ ID NO: 973757 - DNA, 25 bp, Mus musculus
tctgtgcgcatacgttttggctcct

SEQ ID NO: 973758 - DNA, 25 bp, Mus musculus
tctgtgcgcataggttttggctcct

SEQ ID NO: 973759 - DNA, 25 bp, Mus musculus
tctgtgcgcgccaatacagagtgct

SEQ ID NO: 973760 - DNA, 25 bp, Mus musculus
tctgtgcgcggcaatacagagtgct

SEQ ID NO: 973761 - DNA, 25 bp, Mus musculus
tctgtgctgtggatcgccccagaag

SEQ ID NO: 973762 - DNA, 25 bp, Mus musculus
tctgtgctgtggatggccccagaag

SEQ ID NO: 973763 - DNA, 25 bp, Mus musculus
tctgtgctttcacctcagacagcca

SEQ ID NO: 973764 - DNA, 25 bp, Mus musculus
tctgtgctttcagctcagacagcca

SEQ ID NO: 973765 - DNA, 25 bp, Mus musculus
tctgtggaaatccacgctgttcatc

SEQ ID NO: 973766 - DNA, 25 bp, Mus musculus
tctgtggaaatccacggcagagatg

SEQ ID NO: 973767 - DNA, 25 bp, Mus musculus
tctgtggaaatccaggctgttcatc

SEQ ID NO: 973768 - DNA, 25 bp, Mus musculus
tctgtggaaatccagggcagagatg

SEQ ID NO: 973769 - DNA, 25 bp, Mus musculus
tctgtggaagagacctctgctaagg

SEQ ID NO: 973770 - DNA, 25 bp, Mus musculus
tctgtggaagtgacctctgctaagg

SEQ ID NO: 973771 - DNA, 25 bp, Mus musculus
tctgtggatgagctcactacttcag

SEQ ID NO: 973772 - DNA, 25 bp, Mus musculus
tctgtggatgagggccgggcctgcg

SEQ ID NO: 973773 - DNA, 25 bp, Mus musculus
tctgtggatgaggtcactacttcag

SEQ ID NO: 973774 - DNA, 25 bp, Mus musculus
tctgtggatgatgaccacaagccga

SEQ ID NO: 973775 - DNA, 25 bp, Mus musculus
tctgtggatgtgggccgggcctgcg

SEQ ID NO: 973776 - DNA, 25 bp, Mus musculus
tctgtggatgttgaccacaagccga

SEQ ID NO: 973777 - DNA, 25 bp, Mus musculus
tctgtggtcaagcccctggactatg

SEQ ID NO: 973778 - DNA, 25 bp, Mus musculus
tctgtggtcaaggccctggactatg

SEQ ID NO: 973779 - DNA, 25 bp, Mus musculus
tctgtgtctcactaatgctcatact

SEQ ID NO: 973780 - DNA, 25 bp, Mus musculus
tctgtgtctcctttaaaaagcttgt

SEQ ID NO: 973781 - DNA, 25 bp, Mus musculus
tctgtgtctcgtttaaaaagcttgt

SEQ ID NO: 973782 - DNA, 25 bp, Mus musculus
tctgtgtctctctaatgctcatact

SEQ ID NO: 973783 - DNA, 25 bp, Mus musculus
tctgtgtctgctggcatgcgttgct

SEQ ID NO: 973784 - DNA, 25 bp, Mus musculus
tctgtgtctgctgggatgcgttgct

SEQ ID NO: 973785 - DNA, 25 bp, Mus musculus
tctgtgtgagagttcacggcgtcca

SEQ ID NO: 973786 - DNA, 25 bp, Mus musculus
tctgtgtgagagttcagtcctacct

SEQ ID NO: 973787 - DNA, 25 bp, Mus musculus
tctgtgtgagagttgacggcgtcca

SEQ ID NO: 973788 - DNA, 25 bp, Mus musculus
tctgtgtgagagttgagtcctacct

SEQ ID NO: 973789 - DNA, 25 bp, Mus musculus
tctgtgtgagctcgaaatgaagcat

SEQ ID NO: 973790 - DNA, 25 bp, Mus musculus
tctgtgtgagctggaaatgaagcat

SEQ ID NO: 973791 - DNA, 25 bp, Mus musculus
tctgtgttcacggcaatgacatcac

SEQ ID NO: 973792 - DNA, 25 bp, Mus musculus
tctgtgttcacggctatgacatcac

SEQ ID NO: 973793 - DNA, 25 bp, Mus musculus
tctgttcagtcaacctaacactgag

SEQ ID NO: 973794 - DNA, 25 bp, Mus musculus
tctgttcagtgaacctaacactgag

SEQ ID NO: 973795 - DNA, 25 bp, Mus musculus
tctgttctgaaactgcttcagatct

SEQ ID NO: 973796 - DNA, 25 bp, Mus musculus
tctgttctgaaagtgcttcagatct

SEQ ID NO: 973797 - DNA, 25 bp, Mus musculus
tctgttcttgcccgtaatatttgct

SEQ ID NO: 973798 - DNA, 25 bp, Mus musculus
tctgttcttgccggtaatatttgct

SEQ ID NO: 973799 - DNA, 25 bp, Mus musculus
tctgttgaaaagcacgccttcaaac

SEQ ID NO: 973800 - DNA, 25 bp, Mus musculus
tctgttgaaaagcaggccttcaaac

SEQ ID NO: 973801 - DNA, 25 bp, Mus musculus
tctgttgcactgcccatcatcaaca

SEQ ID NO: 973802 - DNA, 25 bp, Mus musculus
tctgttgcactggccatcatcaaca

SEQ ID NO: 973803 - DNA, 25 bp, Mus musculus
tctgttgctaaagccgctattaaat

SEQ ID NO: 973804 - DNA, 25 bp, Mus musculus
tctgttgctaaagcggctattaaat

SEQ ID NO: 973805 - DNA, 25 bp, Mus musculus
tctgttggagataccttcctatccc

SEQ ID NO: 973806 - DNA, 25 bp, Mus musculus
tctgttggagttaccttcctatccc

SEQ ID NO: 973807 - DNA, 25 bp, Mus musculus
tctgttggctaaaggcgatttgacc

SEQ ID NO: 973808 - DNA, 25 bp, Mus musculus
tctgttggctaatggcgatttgacc

SEQ ID NO: 973809 - DNA, 25 bp, Mus musculus
tctgtttaccagcaagccatgaatc

SEQ ID NO: 973810 - DNA, 25 bp, Mus musculus
tctgtttaccaggaagccatgaatc

SEQ ID NO: 973811 - DNA, 25 bp, Mus musculus
tctgtttactggatgtccgatcaaa

SEQ ID NO: 973812 - DNA, 25 bp, Mus musculus
tctgtttactggttgtccgatcaaa

SEQ ID NO: 973813 - DNA, 25 bp, Mus musculus
tctgtttcaaatcccagaaaccggc

SEQ ID NO: 973814 - DNA, 25 bp, Mus musculus
tctgtttcaaatcccagaaactggc

SEQ ID NO: 973815 - DNA, 25 bp, Mus musculus
tctgtttcaacaagatctgcctcag

SEQ ID NO: 973816 - DNA, 25 bp, Mus musculus
tctgtttcaagaagatctgcctcag

SEQ ID NO: 973817 - DNA, 25 bp, Mus musculus
tctgtttcaattcccagaaaccggc

SEQ ID NO: 973818 - DNA, 25 bp, Mus musculus
tctgtttcaattcccagaaactggc

SEQ ID NO: 973819 - DNA, 25 bp, Mus musculus
tctgtttcagaggaaacaagttgag

SEQ ID NO: 973820 - DNA, 25 bp, Mus musculus
tctgtttcagtggaaacaagttgag

SEQ ID NO: 973821 - DNA, 25 bp, Mus musculus
tctgttttatgacatgtccagctcg

SEQ ID NO: 973822 - DNA, 25 bp, Mus musculus
tctgttttatgagatgtccagctcg

SEQ ID NO: 973823 - DNA, 25 bp, Mus musculus
tctgttttgccacatagctgatttg

SEQ ID NO: 973824 - DNA, 25 bp, Mus musculus
tctgttttgccagatagctgatttg

SEQ ID NO: 973825 - DNA, 25 bp, Mus musculus
tcttaaaaacagctgtcctggagcc

SEQ ID NO: 973826 - DNA, 25 bp, Mus musculus
tcttaaaaacaggtgtcctggagcc

SEQ ID NO: 973827 - DNA, 25 bp, Mus musculus
tcttaaaaatgcaccaacaattctc

SEQ ID NO: 973828 - DNA, 25 bp, Mus musculus
tcttaaaaatgctccaacaattctc

SEQ ID NO: 973829 - DNA, 25 bp, Mus musculus
tcttaaatagaatgtcaaaactgga

SEQ ID NO: 973830 - DNA, 25 bp, Mus musculus
tcttaaatagtatgtcaaaactgga

SEQ ID NO: 973831 - DNA, 25 bp, Mus musculus
tcttaacaagcgataactctctgcc

SEQ ID NO: 973832 - DNA, 25 bp, Mus musculus
tcttaacaagggataactctctgcc

SEQ ID NO: 973833 - DNA, 25 bp, Mus musculus
tcttaagactggcctgctgcaaaaa

SEQ ID NO: 973834 - DNA, 25 bp, Mus musculus
tcttaagactgggctgctgcaaaaa

SEQ ID NO: 973835 - DNA, 25 bp, Mus musculus
tcttaagaggagctccttgttcacc

SEQ ID NO: 973836 - DNA, 25 bp, Mus musculus
tcttaagaggaggtccttgttcacc

SEQ ID NO: 973837 - DNA, 25 bp, Mus musculus
tcttaagggacatcgccacgactcg

SEQ ID NO: 973838 - DNA, 25 bp, Mus musculus
tcttaagggagatcgccacgactcg

SEQ ID NO: 973839 - DNA, 25 bp, Mus musculus
tcttaagtatttcatgctggagaag

SEQ ID NO: 973840 - DNA, 25 bp, Mus musculus
tcttaagtatttcgctcagtgttta

SEQ ID NO: 973841 - DNA, 25 bp, Mus musculus
tcttaagtatttgatgctggagaag

SEQ ID NO: 973842 - DNA, 25 bp, Mus musculus
tcttaagtatttggctcagtgttta

SEQ ID NO: 973843 - DNA, 25 bp, Mus musculus
tcttaataagcaagaaactcagaac

SEQ ID NO: 973844 - DNA, 25 bp, Mus musculus
tcttaataaggaagaaactcagaac

SEQ ID NO: 973845 - DNA, 25 bp, Mus musculus
tcttaatatgcaagttacttggagt

SEQ ID NO: 973846 - DNA, 25 bp, Mus musculus
tcttaatatgcatgttacttggagt

SEQ ID NO: 973847 - DNA, 25 bp, Mus musculus
tcttaatcaaaaatactaaggctcg

SEQ ID NO: 973848 - DNA, 25 bp, Mus musculus
tcttaatcaaaattactaaggctcg

SEQ ID NO: 973849 - DNA, 25 bp, Mus musculus
tcttacaaaactcattcggaagaca

SEQ ID NO: 973850 - DNA, 25 bp, Mus musculus
tcttacaaaactgattcggaagaca

SEQ ID NO: 973851 - DNA, 25 bp, Mus musculus
tcttacaaagctgtatgatggatac

SEQ ID NO: 973852 - DNA, 25 bp, Mus musculus
tcttacaaaggtgtatgatggatac

SEQ ID NO: 973853 - DNA, 25 bp, Mus musculus
tcttacaataatcaccaatggacat

SEQ ID NO: 973854 - DNA, 25 bp, Mus musculus
tcttacaataatgaccaatggacat

SEQ ID NO: 973855 - DNA, 25 bp, Mus musculus
tcttaccaagcaatggagccaaagt

SEQ ID NO: 973856 - DNA, 25 bp, Mus musculus
tcttaccaaggaatggagccaaagt

SEQ ID NO: 973857 - DNA, 25 bp, Mus musculus
tcttacccaaagcccacctggaagc

SEQ ID NO: 973858 - DNA, 25 bp, Mus musculus
tcttacccaaaggccacctggaagc

SEQ ID NO: 973859 - DNA, 25 bp, Mus musculus
tcttactatgaaaacggatggatct

SEQ ID NO: 973860 - DNA, 25 bp, Mus musculus
tcttactatgaaaacgtgacgtgca

SEQ ID NO: 973861 - DNA, 25 bp, Mus musculus
tcttactatgaaaagggatggatct

SEQ ID NO: 973862 - DNA, 25 bp, Mus musculus
tcttactatgaaaaggtgacgtgca

SEQ ID NO: 973863 - DNA, 25 bp, Mus musculus
tcttactcagaggaagaaaagtatg

SEQ ID NO: 973864 - DNA, 25 bp, Mus musculus
tcttactcagcaagaaaagtatgcc

SEQ ID NO: 973865 - DNA, 25 bp, Mus musculus
tcttactcaggaagaaaagtatgcc

SEQ ID NO: 973866 - DNA, 25 bp, Mus musculus
tcttactcagtggaagaaaagtatg

SEQ ID NO: 973867 - DNA, 25 bp, Mus musculus
tcttactccaccaacgcttacctga

SEQ ID NO: 973868 - DNA, 25 bp, Mus musculus
tcttactccaccaaggcttacctga

SEQ ID NO: 973869 - DNA, 25 bp, Mus musculus
tcttactcccccatccagaagattt

SEQ ID NO: 973870 - DNA, 25 bp, Mus musculus
tcttactcccccatgcagaagattt

SEQ ID NO: 973871 - DNA, 25 bp, Mus musculus
tcttactcggcaaacatggctcaca

SEQ ID NO: 973872 - DNA, 25 bp, Mus musculus
tcttactcggcaaagatggctcaca

SEQ ID NO: 973873 - DNA, 25 bp, Mus musculus
tcttagaattagacagttcatcatc

SEQ ID NO: 973874 - DNA, 25 bp, Mus musculus
tcttagaattagtcagttcatcatc

SEQ ID NO: 973875 - DNA, 25 bp, Mus musculus
tcttagcaagcgtctgtcaccgctg

SEQ ID NO: 973876 - DNA, 25 bp, Mus musculus
tcttagcaagggtctgtcaccgctg

SEQ ID NO: 973877 - DNA, 25 bp, Mus musculus
tcttagcatcggcacgacagcagcg

SEQ ID NO: 973878 - DNA, 25 bp, Mus musculus
tcttagcatcggcaggacagcagcg

SEQ ID NO: 973879 - DNA, 25 bp, Mus musculus
tcttagcatgcttcataagttctac

SEQ ID NO: 973880 - DNA, 25 bp, Mus musculus
tcttagcatggttcataagttctac

SEQ ID NO: 973881 - DNA, 25 bp, Mus musculus
tcttaggaagagtctctcttaaaca

SEQ ID NO: 973882 - DNA, 25 bp, Mus musculus
tcttaggaagtgtctctcttaaaca

SEQ ID NO: 973883 - DNA, 25 bp, Mus musculus
tcttaggcagctcacgctcagggaa

SEQ ID NO: 973884 - DNA, 25 bp, Mus musculus
tcttaggcagctcaggctcagggaa

SEQ ID NO: 973885 - DNA, 25 bp, Mus musculus
tcttatgctggagacggccttgaag

SEQ ID NO: 973886 - DNA, 25 bp, Mus musculus
tcttatgctggagagggccttgaag

SEQ ID NO: 973887 - DNA, 25 bp, Mus musculus
tcttattaagcatacagccatgagt

SEQ ID NO: 973888 - DNA, 25 bp, Mus musculus
tcttattaaggatacagccatgagt

SEQ ID NO: 973889 - DNA, 25 bp, Mus musculus
tcttattccatactagtgggcagca

SEQ ID NO: 973890 - DNA, 25 bp, Mus musculus
tcttattccatagtagtgggcagca

SEQ ID NO: 973891 - DNA, 25 bp, Mus musculus
tcttattctagacggtggatacaat

SEQ ID NO: 973892 - DNA, 25 bp, Mus musculus
tcttattctagagggtggatacaat

SEQ ID NO: 973893 - DNA, 25 bp, Mus musculus
tcttcaaactgaaaaccagcaccga

SEQ ID NO: 973894 - DNA, 25 bp, Mus musculus
tcttcaaactgataaccagcaccga

SEQ ID NO: 973895 - DNA, 25 bp, Mus musculus
tcttcaaagactagaatgttgtgtc

SEQ ID NO: 973896 - DNA, 25 bp, Mus musculus
tcttcaaagacttgaatgttgtgtc

SEQ ID NO: 973897 - DNA, 25 bp, Mus musculus
tcttcaaagtagaacgttacatcca

SEQ ID NO: 973898 - DNA, 25 bp, Mus musculus
tcttcaaagtagaaggttacatcca

SEQ ID NO: 973899 - DNA, 25 bp, Mus musculus
tcttcaaagtcacaagtaaagccat

SEQ ID NO: 973900 - DNA, 25 bp, Mus musculus
tcttcaaagtcagaagtaaagccat

SEQ ID NO: 973901 - DNA, 25 bp, Mus musculus
tcttcaaatacaaaccttaccaaga

SEQ ID NO: 973902 - DNA, 25 bp, Mus musculus
tcttcaaatacaaagcttaccaaga

SEQ ID NO: 973903 - DNA, 25 bp, Mus musculus
tcttcaacaccacataatgtgtctt

SEQ ID NO: 973904 - DNA, 25 bp, Mus musculus
tcttcaacaccagataatgtgtctt

SEQ ID NO: 973905 - DNA, 25 bp, Mus musculus
tcttcaacactgttcctcaggagct

SEQ ID NO: 973906 - DNA, 25 bp, Mus musculus
tcttcaacactgttgctcaggagct

SEQ ID NO: 973907 - DNA, 25 bp, Mus musculus
tcttcaaccgcatctccctgactgg

SEQ ID NO: 973908 - DNA, 25 bp, Mus musculus
tcttcaaccggatctccctgactgg

SEQ ID NO: 973909 - DNA, 25 bp, Mus musculus
tcttcaagctcttaagtgagacgtg

SEQ ID NO: 973910 - DNA, 25 bp, Mus musculus
tcttcaagctcttatgtgagacgtg

SEQ ID NO: 973911 - DNA, 25 bp, Mus musculus
tcttcaaggacgcttggtactggaa

SEQ ID NO: 973912 - DNA, 25 bp, Mus musculus
tcttcaaggacggttggtactggaa

SEQ ID NO: 973913 - DNA, 25 bp, Mus musculus
tcttcaataaacctactgaacttga

SEQ ID NO: 973914 - DNA, 25 bp, Mus musculus
tcttcaataagcaacctactgaact

SEQ ID NO: 973915 - DNA, 25 bp, Mus musculus
tcttcaataagctacctactgaact

SEQ ID NO: 973916 - DNA, 25 bp, Mus musculus
tcttcaataatcctactgaacttga

SEQ ID NO: 973917 - DNA, 25 bp, Mus musculus
tcttcaatccccaacgttcattctg

SEQ ID NO: 973918 - DNA, 25 bp, Mus musculus
tcttcaatccccaaggttcattctg

SEQ ID NO: 973919 - DNA, 25 bp, Mus musculus
tcttcacaaccaatcctggtctgac

SEQ ID NO: 973920 - DNA, 25 bp, Mus musculus
tcttcacaaccattcctggtctgac

SEQ ID NO: 973921 - DNA, 25 bp, Mus musculus
tcttcacactggctggcacccctta

SEQ ID NO: 973922 - DNA, 25 bp, Mus musculus
tcttcacactgggtggcacccctta

SEQ ID NO: 973923 - DNA, 25 bp, Mus musculus
tcttcacattatccatgccattgcg

SEQ ID NO: 973924 - DNA, 25 bp, Mus musculus
tcttcacattttccatgccattgcg

SEQ ID NO: 973925 - DNA, 25 bp, Mus musculus
tcttcaccacagagataatatgcaa

SEQ ID NO: 973926 - DNA, 25 bp, Mus musculus
tcttcaccacagctgtggtctatga

SEQ ID NO: 973927 - DNA, 25 bp, Mus musculus
tcttcaccacaggtgtggtctatga

SEQ ID NO: 973928 - DNA, 25 bp, Mus musculus
tcttcaccacagtgataatatgcaa

SEQ ID NO: 973929 - DNA, 25 bp, Mus musculus
tcttcaccagactaaatccagtgaa

SEQ ID NO: 973930 - DNA, 25 bp, Mus musculus
tcttcaccagctccagctagctggg

SEQ ID NO: 973931 - DNA, 25 bp, Mus musculus
tcttcaccaggtccagctagctggg

SEQ ID NO: 973932 - DNA, 25 bp, Mus musculus
tcttcaccagtctaaatccagtgaa

SEQ ID NO: 973933 - DNA, 25 bp, Mus musculus
tcttcacccggacgcttctttggct

SEQ ID NO: 973934 - DNA, 25 bp, Mus musculus
tcttcacccggactaggcttctttg

SEQ ID NO: 973935 - DNA, 25 bp, Mus musculus
tcttcacccggaggcttctttggct

SEQ ID NO: 973936 - DNA, 25 bp, Mus musculus
tcttcacccggagtaggcttctttg

SEQ ID NO: 973937 - DNA, 25 bp, Mus musculus
tcttcacctactacagacaagtaga

SEQ ID NO: 973938 - DNA, 25 bp, Mus musculus
tcttcacctagtacagacaagtaga

SEQ ID NO: 973939 - DNA, 25 bp, Mus musculus
tcttcacctttgctgtcctgtgcat

SEQ ID NO: 973940 - DNA, 25 bp, Mus musculus
tcttcacctttggtgtcctgtgcat

SEQ ID NO: 973941 - DNA, 25 bp, Mus musculus
tcttcacgatagccaaggggaagtc

SEQ ID NO: 973942 - DNA, 25 bp, Mus musculus
tcttcacgataggcaaggggaagtc

SEQ ID NO: 973943 - DNA, 25 bp, Mus musculus
tcttcacgcctgatgcctgtggcct

SEQ ID NO: 973944 - DNA, 25 bp, Mus musculus
tcttcacgcctgttgcctgtggcct

SEQ ID NO: 973945 - DNA, 25 bp, Mus musculus
tcttcactcttgcacggtgattgcc

SEQ ID NO: 973946 - DNA, 25 bp, Mus musculus
tcttcactcttggacggtgattgcc

SEQ ID NO: 973947 - DNA, 25 bp, Mus musculus
tcttcactggggccttcctcctagg

SEQ ID NO: 973948 - DNA, 25 bp, Mus musculus
tcttcactgggggcttcctcctagg

SEQ ID NO: 973949 - DNA, 25 bp, Mus musculus
tcttcagaatcgtgcagatccccag

SEQ ID NO: 973950 - DNA, 25 bp, Mus musculus
tcttcagaatggtgcagatccccag

SEQ ID NO: 973951 - DNA, 25 bp, Mus musculus
tcttcagagagacgtaccgaccctt

SEQ ID NO: 973952 - DNA, 25 bp, Mus musculus
tcttcagagagactctttctgcagg

SEQ ID NO: 973953 - DNA, 25 bp, Mus musculus
tcttcagagagaggtaccgaccctt

SEQ ID NO: 973954 - DNA, 25 bp, Mus musculus
tcttcagagagagtctttctgcagg

SEQ ID NO: 973955 - DNA, 25 bp, Mus musculus
tcttcagagcagctacggatgctgc

SEQ ID NO: 973956 - DNA, 25 bp, Mus musculus
tcttcagagcaggtacggatgctgc

SEQ ID NO: 973957 - DNA, 25 bp, Mus musculus
tcttcagccagtttcgtaagaccct

SEQ ID NO: 973958 - DNA, 25 bp, Mus musculus
tcttcagccagtttggtaagaccct

SEQ ID NO: 973959 - DNA, 25 bp, Mus musculus
tcttcagccctcaaatggaccaatt

SEQ ID NO: 973960 - DNA, 25 bp, Mus musculus
tcttcagccctctaatggaccaatt

SEQ ID NO: 973961 - DNA, 25 bp, Mus musculus
tcttcagcctcccatggctgttatc

SEQ ID NO: 973962 - DNA, 25 bp, Mus musculus
tcttcagcctgccatggctgttatc

SEQ ID NO: 973963 - DNA, 25 bp, Mus musculus
tcttcagcttcaaatcagtaccaca

SEQ ID NO: 973964 - DNA, 25 bp, Mus musculus
tcttcagcttcaaggtttggattca

SEQ ID NO: 973965 - DNA, 25 bp, Mus musculus
tcttcagcttcatatcagtaccaca

SEQ ID NO: 973966 - DNA, 25 bp, Mus musculus
tcttcagcttcatggtttggattca

SEQ ID NO: 973967 - DNA, 25 bp, Mus musculus
tcttcaggggctgattagtgttaag

SEQ ID NO: 973968 - DNA, 25 bp, Mus musculus
tcttcagggggtgattagtgttaag

SEQ ID NO: 973969 - DNA, 25 bp, Mus musculus
tcttcagtgcaacgatggaaggacc

SEQ ID NO: 973970 - DNA, 25 bp, Mus musculus
tcttcagtgcaacgttatcctgctc

SEQ ID NO: 973971 - DNA, 25 bp, Mus musculus
tcttcagtgcaaggatggaaggacc

SEQ ID NO: 973972 - DNA, 25 bp, Mus musculus
tcttcagtgcaaggttatcctgctc

SEQ ID NO: 973973 - DNA, 25 bp, Mus musculus
tcttcagtggaacgtaaacagaatc

SEQ ID NO: 973974 - DNA, 25 bp, Mus musculus
tcttcagtggaaggtaaacagaatc

SEQ ID NO: 973975 - DNA, 25 bp, Mus musculus
tcttcatcaaccatgttattctcac

SEQ ID NO: 973976 - DNA, 25 bp, Mus musculus
tcttcatcaaccttgttattctcac

SEQ ID NO: 973977 - DNA, 25 bp, Mus musculus
tcttcatcaccacgtatcacgtatg

SEQ ID NO: 973978 - DNA, 25 bp, Mus musculus
tcttcatcaccaggtatcacgtatg

SEQ ID NO: 973979 - DNA, 25 bp, Mus musculus
tcttcatcccaggacatcttcccac

SEQ ID NO: 973980 - DNA, 25 bp, Mus musculus
tcttcatcccaggagatcttcccac

SEQ ID NO: 973981 - DNA, 25 bp, Mus musculus
tcttcatctgactctggctcctctt

SEQ ID NO: 973982 - DNA, 25 bp, Mus musculus
tcttcatctgtctctggctcctctt

SEQ ID NO: 973983 - DNA, 25 bp, Mus musculus
tcttcatgccagattcagaaagcag

SEQ ID NO: 973984 - DNA, 25 bp, Mus musculus
tcttcatgccagtttcagaaagcag

SEQ ID NO: 973985 - DNA, 25 bp, Mus musculus
tcttcatgctggatcatactatcgt

SEQ ID NO: 973986 - DNA, 25 bp, Mus musculus
tcttcatgctggatgatactatcgt

SEQ ID NO: 973987 - DNA, 25 bp, Mus musculus
tcttcatgtttccacttggcctcta

SEQ ID NO: 973988 - DNA, 25 bp, Mus musculus
tcttcatgtttccagttggcctcta

SEQ ID NO: 973989 - DNA, 25 bp, Mus musculus
tcttcattcactcacataacagtgc

SEQ ID NO: 973990 - DNA, 25 bp, Mus musculus
tcttcattcactcagataacagtgc

SEQ ID NO: 973991 - DNA, 25 bp, Mus musculus
tcttcattcgaaagaaggatcgggt

SEQ ID NO: 973992 - DNA, 25 bp, Mus musculus
tcttcattcgaatgaaggatcgggt

SEQ ID NO: 973993 - DNA, 25 bp, Mus musculus
tcttcattgatgcgcagacacgcac

SEQ ID NO: 973994 - DNA, 25 bp, Mus musculus
tcttcattgatgggcagacacgcac

SEQ ID NO: 973995 - DNA, 25 bp, Mus musculus
tcttcattggtacacatgtgggcac

SEQ ID NO: 973996 - DNA, 25 bp, Mus musculus
tcttcattggtacagatgtgggcac

SEQ ID NO: 973997 - DNA, 25 bp, Mus musculus
tcttcatttgagggcgtcaggacaa

SEQ ID NO: 973998 - DNA, 25 bp, Mus musculus
tcttcatttgagggggtcaggacaa

SEQ ID NO: 973999 - DNA, 25 bp, Mus musculus
tcttccaagaggcaacaactgtatg

SEQ ID NO: 974000 - DNA, 25 bp, Mus musculus
tcttccaagagggaacaactgtatg

SEQ ID NO: 974001 - DNA, 25 bp, Mus musculus
tcttccaagcaacggcccctggctt

SEQ ID NO: 974002 - DNA, 25 bp, Mus musculus
tcttccaagcaagggcccctggctt

SEQ ID NO: 974003 - DNA, 25 bp, Mus musculus
tcttccacagagcctccggagccag

SEQ ID NO: 974004 - DNA, 25 bp, Mus musculus
tcttccacagtgcctccggagccag

SEQ ID NO: 974005 - DNA, 25 bp, Mus musculus
tcttccacgaagcagccgcagccct

SEQ ID NO: 974006 - DNA, 25 bp, Mus musculus
tcttccacgaaggagccgcagccct

SEQ ID NO: 974007 - DNA, 25 bp, Mus musculus
tcttccagaagaaacattatgtgcg

SEQ ID NO: 974008 - DNA, 25 bp, Mus musculus
tcttccagaagaaagattatgtgcg

SEQ ID NO: 974009 - DNA, 25 bp, Mus musculus
tcttccagccagagagtttatggtc

SEQ ID NO: 974010 - DNA, 25 bp, Mus musculus
tcttccagccagagtgtttatggtc

SEQ ID NO: 974011 - DNA, 25 bp, Mus musculus
tcttccagcgcaagcgccgtgggac

SEQ ID NO: 974012 - DNA, 25 bp, Mus musculus
tcttccagcgcgttgataaagacag

SEQ ID NO: 974013 - DNA, 25 bp, Mus musculus
tcttccagcggaagcgccgtgggac

SEQ ID NO: 974014 - DNA, 25 bp, Mus musculus
tcttccagcgggttgataaagacag

SEQ ID NO: 974015 - DNA, 25 bp, Mus musculus
tcttccagtaaacactgtccactgc

SEQ ID NO: 974016 - DNA, 25 bp, Mus musculus
tcttccagtaaacagtgtccactgc

SEQ ID NO: 974017 - DNA, 25 bp, Mus musculus
tcttccagtaccaacacaaagccta

SEQ ID NO: 974018 - DNA, 25 bp, Mus musculus
tcttccagtaccaagacaaagccta

SEQ ID NO: 974019 - DNA, 25 bp, Mus musculus
tcttccagtcagagaacaccttctg

SEQ ID NO: 974020 - DNA, 25 bp, Mus musculus
tcttccagtcagtgaacaccttctg

SEQ ID NO: 974021 - DNA, 25 bp, Mus musculus
tcttccatatcacccgcttacagtc

SEQ ID NO: 974022 - DNA, 25 bp, Mus musculus
tcttccatatcagccgcttacagtc

SEQ ID NO: 974023 - DNA, 25 bp, Mus musculus
tcttccatgaacttctccatgatga

SEQ ID NO: 974024 - DNA, 25 bp, Mus musculus
tcttccatgatcttctccatgatga

SEQ ID NO: 974025 - DNA, 25 bp, Mus musculus
tcttccatgccacttcccacccagc

SEQ ID NO: 974026 - DNA, 25 bp, Mus musculus
tcttccatgccagttcccacccagc

SEQ ID NO: 974027 - DNA, 25 bp, Mus musculus
tcttccatggaacatctcatggaca

SEQ ID NO: 974028 - DNA, 25 bp, Mus musculus
tcttccatggaagatctcatggaca

SEQ ID NO: 974029 - DNA, 25 bp, Mus musculus
tcttcccaagctaaagcccattatc

SEQ ID NO: 974030 - DNA, 25 bp, Mus musculus
tcttcccaaggtaaagcccattatc

SEQ ID NO: 974031 - DNA, 25 bp, Mus musculus
tcttcccacgaacaagatgccattt

SEQ ID NO: 974032 - DNA, 25 bp, Mus musculus
tcttcccacgcatgtgatcttcgtg

SEQ ID NO: 974033 - DNA, 25 bp, Mus musculus
tcttcccacggatgtgatcttcgtg

SEQ ID NO: 974034 - DNA, 25 bp, Mus musculus
tcttcccacgtacaagatgccattt

SEQ ID NO: 974035 - DNA, 25 bp, Mus musculus
tcttcccatcagcccaggccacagc

SEQ ID NO: 974036 - DNA, 25 bp, Mus musculus
tcttcccatcaggccaggccacagc

SEQ ID NO: 974037 - DNA, 25 bp, Mus musculus
tcttccccagcttctccaagccagc

SEQ ID NO: 974038 - DNA, 25 bp, Mus musculus
tcttccccagcttgccctggcatgt

SEQ ID NO: 974039 - DNA, 25 bp, Mus musculus
tcttccccaggttctccaagccagc

SEQ ID NO: 974040 - DNA, 25 bp, Mus musculus
tcttccccaggttgccctggcatgt

SEQ ID NO: 974041 - DNA, 25 bp, Mus musculus
tcttccctagagatggctttcctga

SEQ ID NO: 974042 - DNA, 25 bp, Mus musculus
tcttccctagagttggctttcctga

SEQ ID NO: 974043 - DNA, 25 bp, Mus musculus
tcttccctattgcactggttgccct

SEQ ID NO: 974044 - DNA, 25 bp, Mus musculus
tcttccctattggactggttgccct

SEQ ID NO: 974045 - DNA, 25 bp, Mus musculus
tcttccctggtacaccaagctttcc

SEQ ID NO: 974046 - DNA, 25 bp, Mus musculus
tcttccctggtacagcaagctttcc

SEQ ID NO: 974047 - DNA, 25 bp, Mus musculus
tcttccgagcccaggtaaactgcag

SEQ ID NO: 974048 - DNA, 25 bp, Mus musculus
tcttccgagccctggtaaactgcag

SEQ ID NO: 974049 - DNA, 25 bp, Mus musculus
tcttccgtacagcatggacgtggag

SEQ ID NO: 974050 - DNA, 25 bp, Mus musculus
tcttccgtacaggatggacgtggag

SEQ ID NO: 974051 - DNA, 25 bp, Mus musculus
tcttcctacgcagatggctcgtgga

SEQ ID NO: 974052 - DNA, 25 bp, Mus musculus
tcttcctacggagatggctcgtgga

SEQ ID NO: 974053 - DNA, 25 bp, Mus musculus
tcttcctatcagagagtgactcaga

SEQ ID NO: 974054 - DNA, 25 bp, Mus musculus
tcttcctatcagcgctcagttctga

SEQ ID NO: 974055 - DNA, 25 bp, Mus musculus
tcttcctatcagggctcagttctga

SEQ ID NO: 974056 - DNA, 25 bp, Mus musculus
tcttcctatcagtgagtgactcaga

SEQ ID NO: 974057 - DNA, 25 bp, Mus musculus
tcttcctgcactttcaggaggaaga

SEQ ID NO: 974058 - DNA, 25 bp, Mus musculus
tcttcctgcactttgaggaggaaga

SEQ ID NO: 974059 - DNA, 25 bp, Mus musculus
tcttcctgcgcgacatcaccatgag

SEQ ID NO: 974060 - DNA, 25 bp, Mus musculus
tcttcctgcgggacatcaccatgag

SEQ ID NO: 974061 - DNA, 25 bp, Mus musculus
tcttcctggacttccctgaggatcc

SEQ ID NO: 974062 - DNA, 25 bp, Mus musculus
tcttcctggagttccctgaggatcc

SEQ ID NO: 974063 - DNA, 25 bp, Mus musculus
tcttcctgggctgttgttcagccag

SEQ ID NO: 974064 - DNA, 25 bp, Mus musculus
tcttcctggggtgttgttcagccag

SEQ ID NO: 974065 - DNA, 25 bp, Mus musculus
tcttcgaatggaaatacccctccta

SEQ ID NO: 974066 - DNA, 25 bp, Mus musculus
tcttcgaatggatatacccctccta

SEQ ID NO: 974067 - DNA, 25 bp, Mus musculus
tcttcgcaagaacgcgattaatctt

SEQ ID NO: 974068 - DNA, 25 bp, Mus musculus
tcttcgcaagaacgggattaatctt

SEQ ID NO: 974069 - DNA, 25 bp, Mus musculus
tcttcgccatagctagcattgccaa

SEQ ID NO: 974070 - DNA, 25 bp, Mus musculus
tcttcgccataggtagcattgccaa

SEQ ID NO: 974071 - DNA, 25 bp, Mus musculus
tcttcgccatctccagtcttgtccg

SEQ ID NO: 974072 - DNA, 25 bp, Mus musculus
tcttcgccatctcctgtcttgtccg

SEQ ID NO: 974073 - DNA, 25 bp, Mus musculus
tcttcggatgatatcaacaagtttc

SEQ ID NO: 974074 - DNA, 25 bp, Mus musculus
tcttcggatgttatcaacaagtttc

SEQ ID NO: 974075 - DNA, 25 bp, Mus musculus
tcttcgtaaagacaagtataatgcc

SEQ ID NO: 974076 - DNA, 25 bp, Mus musculus
tcttcgtaaagactataatgccgac

SEQ ID NO: 974077 - DNA, 25 bp, Mus musculus
tcttcgtaaagagaagtataatgcc

SEQ ID NO: 974078 - DNA, 25 bp, Mus musculus
tcttcgtaaagagtataatgccgac

SEQ ID NO: 974079 - DNA, 25 bp, Mus musculus
tcttcgtactagaggctgctgtccg

SEQ ID NO: 974080 - DNA, 25 bp, Mus musculus
tcttcgtactagctcacttcatgac

SEQ ID NO: 974081 - DNA, 25 bp, Mus musculus
tcttcgtactagctcctggacttct

SEQ ID NO: 974082 - DNA, 25 bp, Mus musculus
tcttcgtactaggtcacttcatgac

SEQ ID NO: 974083 - DNA, 25 bp, Mus musculus
tcttcgtactaggtcctggacttct

SEQ ID NO: 974084 - DNA, 25 bp, Mus musculus
tcttcgtactagtggctgctgtccg

SEQ ID NO: 974085 - DNA, 25 bp, Mus musculus
tcttcgtgggagatgcagcagggcg

SEQ ID NO: 974086 - DNA, 25 bp, Mus musculus
tcttcgtgggagttgcagcagggcg

SEQ ID NO: 974087 - DNA, 25 bp, Mus musculus
tcttcgttgacacttatgacgtggt

SEQ ID NO: 974088 - DNA, 25 bp, Mus musculus
tcttcgttgacagttatgacgtggt

SEQ ID NO: 974089 - DNA, 25 bp, Mus musculus
tcttctaatagacaccccaggaaac

SEQ ID NO: 974090 - DNA, 25 bp, Mus musculus
tcttctaatagacagcccaggaaac

SEQ ID NO: 974091 - DNA, 25 bp, Mus musculus
tcttctaccccacataatatttctt

SEQ ID NO: 974092 - DNA, 25 bp, Mus musculus
tcttctaccccagataatatttctt

SEQ ID NO: 974093 - DNA, 25 bp, Mus musculus
tcttctagatgacatcaccgaagtg

SEQ ID NO: 974094 - DNA, 25 bp, Mus musculus
tcttctagatgagatcaccgaagtg

SEQ ID NO: 974095 - DNA, 25 bp, Mus musculus
tcttctatggagagaaacaacccga

SEQ ID NO: 974096 - DNA, 25 bp, Mus musculus
tcttctatggagtgaaacaacccga

SEQ ID NO: 974097 - DNA, 25 bp, Mus musculus
tcttctatttctcggttctgccaga

SEQ ID NO: 974098 - DNA, 25 bp, Mus musculus
tcttctatttctgggttctgccaga

SEQ ID NO: 974099 - DNA, 25 bp, Mus musculus
tcttctcaagcacatgtttggacag

SEQ ID NO: 974100 - DNA, 25 bp, Mus musculus
tcttctcaaggacatgtttggacag

SEQ ID NO: 974101 - DNA, 25 bp, Mus musculus
tcttctcagcatatgccctggttcc

SEQ ID NO: 974102 - DNA, 25 bp, Mus musculus
tcttctcagcatttgccctggttcc

SEQ ID NO: 974103 - DNA, 25 bp, Mus musculus
tcttctccatcacaatccaagagaa

SEQ ID NO: 974104 - DNA, 25 bp, Mus musculus
tcttctccatcagaatccaagagaa

SEQ ID NO: 974105 - DNA, 25 bp, Mus musculus
tcttctcccacccagatatgaatca

SEQ ID NO: 974106 - DNA, 25 bp, Mus musculus
tcttctcccaccgagatatgaatca

SEQ ID NO: 974107 - DNA, 25 bp, Mus musculus
tcttctcccctgacagacccggagt

SEQ ID NO: 974108 - DNA, 25 bp, Mus musculus
tcttctcccctgctttctgtatgca

SEQ ID NO: 974109 - DNA, 25 bp, Mus musculus
tcttctcccctggtttctgtatgca

SEQ ID NO: 974110 - DNA, 25 bp, Mus musculus
tcttctcccctgtcagacccggagt

SEQ ID NO: 974111 - DNA, 25 bp, Mus musculus
tcttctctggagacaaatactaccg

SEQ ID NO: 974112 - DNA, 25 bp, Mus musculus
tcttctctggagtcaaatactaccg

SEQ ID NO: 974113 - DNA, 25 bp, Mus musculus
tcttctcttctttgctgctctctcc

SEQ ID NO: 974114 - DNA, 25 bp, Mus musculus
tcttctcttctttggtgctctctcc

SEQ ID NO: 974115 - DNA, 25 bp, Mus musculus
tcttctgaccaaagaatacattcca

SEQ ID NO: 974116 - DNA, 25 bp, Mus musculus
tcttctgaccaaagtatacattcca

SEQ ID NO: 974117 - DNA, 25 bp, Mus musculus
tcttctgacccacactaccttgtag

SEQ ID NO: 974118 - DNA, 25 bp, Mus musculus
tcttctgacccagactaccttgtag

SEQ ID NO: 974119 - DNA, 25 bp, Mus musculus
tcttctgagtcacgccacatactcc

SEQ ID NO: 974120 - DNA, 25 bp, Mus musculus
tcttctgagtcaggccacatactcc

SEQ ID NO: 974121 - DNA, 25 bp, Mus musculus
tcttctgatcagcacagtgaaatgg

SEQ ID NO: 974122 - DNA, 25 bp, Mus musculus
tcttctgatcagcagagtgaaatgg

SEQ ID NO: 974123 - DNA, 25 bp, Mus musculus
tcttctgatgagctgggaagtcatc

SEQ ID NO: 974124 - DNA, 25 bp, Mus musculus
tcttctgatgaggtgggaagtcatc

SEQ ID NO: 974125 - DNA, 25 bp, Mus musculus
tcttctgccaaagaagttgcaaagc

SEQ ID NO: 974126 - DNA, 25 bp, Mus musculus
tcttctgccaaagatgttgcaaagc

SEQ ID NO: 974127 - DNA, 25 bp, Mus musculus
tcttctgccctacacaatactgtgg

SEQ ID NO: 974128 - DNA, 25 bp, Mus musculus
tcttctgccctacagaatactgtgg

SEQ ID NO: 974129 - DNA, 25 bp, Mus musculus
tcttctggagagaagtgtgctggtg

SEQ ID NO: 974130 - DNA, 25 bp, Mus musculus
tcttctggagagcgcatcatggctc

SEQ ID NO: 974131 - DNA, 25 bp, Mus musculus
tcttctggagagggcatcatggctc

SEQ ID NO: 974132 - DNA, 25 bp, Mus musculus
tcttctggagagtagtgtgctggtg

SEQ ID NO: 974133 - DNA, 25 bp, Mus musculus
tcttctggcctccgatggtgacatt

SEQ ID NO: 974134 - DNA, 25 bp, Mus musculus
tcttctggcctcggatggtgacatt

SEQ ID NO: 974135 - DNA, 25 bp, Mus musculus
tcttctggtgtacggaaagaccaca

SEQ ID NO: 974136 - DNA, 25 bp, Mus musculus
tcttctggtgtagggaaagaccaca

SEQ ID NO: 974137 - DNA, 25 bp, Mus musculus
tcttcttaagcagagcgattcaatg

SEQ ID NO: 974138 - DNA, 25 bp, Mus musculus
tcttcttaaggagagcgattcaatg

SEQ ID NO: 974139 - DNA, 25 bp, Mus musculus
tcttcttatctgagttgaactcttt

SEQ ID NO: 974140 - DNA, 25 bp, Mus musculus
tcttcttatctgtgttgaactcttt

SEQ ID NO: 974141 - DNA, 25 bp, Mus musculus
tcttcttcactcttccacggtgatt

SEQ ID NO: 974142 - DNA, 25 bp, Mus musculus
tcttcttcactcttgcacggtgatt

SEQ ID NO: 974143 - DNA, 25 bp, Mus musculus
tcttcttcatcaaccatgttattct

SEQ ID NO: 974144 - DNA, 25 bp, Mus musculus
tcttcttcatcaacgatgttattct

SEQ ID NO: 974145 - DNA, 25 bp, Mus musculus
tcttcttccacgaacgagccgcagc

SEQ ID NO: 974146 - DNA, 25 bp, Mus musculus
tcttcttccacgaaggagccgcagc

SEQ ID NO: 974147 - DNA, 25 bp, Mus musculus
tcttcttccctattccactggttgc

SEQ ID NO: 974148 - DNA, 25 bp, Mus musculus
tcttcttccctattgcactggttgc

SEQ ID NO: 974149 - DNA, 25 bp, Mus musculus
tcttcttctctgcacgtcaaatgtg

SEQ ID NO: 974150 - DNA, 25 bp, Mus musculus
tcttcttctctggacgtcaaatgtg

SEQ ID NO: 974151 - DNA, 25 bp, Mus musculus
tcttctttgacatgagccagtggag

SEQ ID NO: 974152 - DNA, 25 bp, Mus musculus
tcttctttgacatgtgccagtggag

SEQ ID NO: 974153 - DNA, 25 bp, Mus musculus
tcttctttgatccacatgccaaggg

SEQ ID NO: 974154 - DNA, 25 bp, Mus musculus
tcttctttgatccagatgccaaggg

SEQ ID NO: 974155 - DNA, 25 bp, Mus musculus
tcttctttggagctctctccagccc

SEQ ID NO: 974156 - DNA, 25 bp, Mus musculus
tcttctttggtgctctctccagccc

SEQ ID NO: 974157 - DNA, 25 bp, Mus musculus
tcttctttgtgacgagtgatgcatc

SEQ ID NO: 974158 - DNA, 25 bp, Mus musculus
tcttctttgtgaggagtgatgcatc

SEQ ID NO: 974159 - DNA, 25 bp, Mus musculus
tcttgaaaagcatactcccacaagc

SEQ ID NO: 974160 - DNA, 25 bp, Mus musculus
tcttgaaaaggatactcccacaagc

SEQ ID NO: 974161 - DNA, 25 bp, Mus musculus
tcttgaagaactttcctgtggccaa

SEQ ID NO: 974162 - DNA, 25 bp, Mus musculus
tcttgaagaagtttcctgtggccaa

SEQ ID NO: 974163 - DNA, 25 bp, Mus musculus
tcttgaagagctaagtgaagacccc

SEQ ID NO: 974164 - DNA, 25 bp, Mus musculus
tcttgaagagcttagtgaagacccc

SEQ ID NO: 974165 - DNA, 25 bp, Mus musculus
tcttgaaggcaacacaatgaaggga

SEQ ID NO: 974166 - DNA, 25 bp, Mus musculus
tcttgaaggcaacagaatgaaggga

SEQ ID NO: 974167 - DNA, 25 bp, Mus musculus
tcttgacaaagtaatcgaccttcca

SEQ ID NO: 974168 - DNA, 25 bp, Mus musculus
tcttgacaaagttatcgaccttcca

SEQ ID NO: 974169 - DNA, 25 bp, Mus musculus
tcttgacaagacagaggagggcgcg

SEQ ID NO: 974170 - DNA, 25 bp, Mus musculus
tcttgacaagtcagaggagggcgcg

SEQ ID NO: 974171 - DNA, 25 bp, Mus musculus
tcttgagaatcattctgatgtatga

SEQ ID NO: 974172 - DNA, 25 bp, Mus musculus
tcttgagaatgattctgatgtatga

SEQ ID NO: 974173 - DNA, 25 bp, Mus musculus
tcttgagaccatcgttgatgccctc

SEQ ID NO: 974174 - DNA, 25 bp, Mus musculus
tcttgagaccatggttgatgccctc

SEQ ID NO: 974175 - DNA, 25 bp, Mus musculus
tcttgagtatatggcaagtactgga

SEQ ID NO: 974176 - DNA, 25 bp, Mus musculus
tcttgagtatatggcgcagagcccg

SEQ ID NO: 974177 - DNA, 25 bp, Mus musculus
tcttgagtatatgggaagtactgga

SEQ ID NO: 974178 - DNA, 25 bp, Mus musculus
tcttgagtatatggggcagagcccg

SEQ ID NO: 974179 - DNA, 25 bp, Mus musculus
tcttgataacagcaccctgcagagt

SEQ ID NO: 974180 - DNA, 25 bp, Mus musculus
tcttgataacaggaccctgcagagt

SEQ ID NO: 974181 - DNA, 25 bp, Mus musculus
tcttgatcatcccaccctatgggaa

SEQ ID NO: 974182 - DNA, 25 bp, Mus musculus
tcttgatcatcccagcctatgggaa

SEQ ID NO: 974183 - DNA, 25 bp, Mus musculus
tcttgatgaaagcagagatgtcttg

SEQ ID NO: 974184 - DNA, 25 bp, Mus musculus
tcttgatgaaaggagagatgtcttg

SEQ ID NO: 974185 - DNA, 25 bp, Mus musculus
tcttgattatgacatcagctttgga

SEQ ID NO: 974186 - DNA, 25 bp, Mus musculus
tcttgattatgagatcagctttgga

SEQ ID NO: 974187 - DNA, 25 bp, Mus musculus
tcttgcaaaaacagctttcgatgaa

SEQ ID NO: 974188 - DNA, 25 bp, Mus musculus
tcttgcaaaaactgctttcgatgaa

SEQ ID NO: 974189 - DNA, 25 bp, Mus musculus
tcttgcaaagatcactggagattgc

SEQ ID NO: 974190 - DNA, 25 bp, Mus musculus
tcttgcaaagttcactggagattgc

SEQ ID NO: 974191 - DNA, 25 bp, Mus musculus
tcttgcaactcaatctgcctgtaaa

SEQ ID NO: 974192 - DNA, 25 bp, Mus musculus
tcttgcaactccatctcggaagaaa

SEQ ID NO: 974193 - DNA, 25 bp, Mus musculus
tcttgcaactgaatctgcctgtaaa

SEQ ID NO: 974194 - DNA, 25 bp, Mus musculus
tcttgcaactgcatctcggaagaaa

SEQ ID NO: 974195 - DNA, 25 bp, Mus musculus
tcttgcagcaggactgctttgcctt

SEQ ID NO: 974196 - DNA, 25 bp, Mus musculus
tcttgcagcaggtctgctttgcctt

SEQ ID NO: 974197 - DNA, 25 bp, Mus musculus
tcttgcagctgtctagcccatgcca

SEQ ID NO: 974198 - DNA, 25 bp, Mus musculus
tcttgcagctgtgtagcccatgcca

SEQ ID NO: 974199 - DNA, 25 bp, Mus musculus
tcttgcagttttcacaaagaagcaa

SEQ ID NO: 974200 - DNA, 25 bp, Mus musculus
tcttgcagttttcagaaagaagcaa

SEQ ID NO: 974201 - DNA, 25 bp, Mus musculus
tcttgccaagatgtgaacgagtgcg

SEQ ID NO: 974202 - DNA, 25 bp, Mus musculus
tcttgccaagatgtggatgaatgtt

SEQ ID NO: 974203 - DNA, 25 bp, Mus musculus
tcttgccaagttgtgaacgagtgcg

SEQ ID NO: 974204 - DNA, 25 bp, Mus musculus
tcttgccaagttgtggatgaatgtt

SEQ ID NO: 974205 - DNA, 25 bp, Mus musculus
tcttgcccaggacctcctgacactg

SEQ ID NO: 974206 - DNA, 25 bp, Mus musculus
tcttgcccaggagctcctgacactg

SEQ ID NO: 974207 - DNA, 25 bp, Mus musculus
tcttgcctgcaacgaagcggtgcgt

SEQ ID NO: 974208 - DNA, 25 bp, Mus musculus
tcttgcctgcaaggaagcggtgcgt

SEQ ID NO: 974209 - DNA, 25 bp, Mus musculus
tcttgccttgcggaaatggccattc

SEQ ID NO: 974210 - DNA, 25 bp, Mus musculus
tcttgccttggggaaatggccattc

SEQ ID NO: 974211 - DNA, 25 bp, Mus musculus
tcttgctacctcagactcacggatg

SEQ ID NO: 974212 - DNA, 25 bp, Mus musculus
tcttgctacctcagtctcacggatg

SEQ ID NO: 974213 - DNA, 25 bp, Mus musculus
tcttgctagcagcaatcatctgggg

SEQ ID NO: 974214 - DNA, 25 bp, Mus musculus
tcttgctagcaggaatcatctgggg

SEQ ID NO: 974215 - DNA, 25 bp, Mus musculus
tcttgctgataagacgcaagtgtca

SEQ ID NO: 974216 - DNA, 25 bp, Mus musculus
tcttgctgataagaggcaagtgtca

SEQ ID NO: 974217 - DNA, 25 bp, Mus musculus
tcttgctgatctcacatgctgtttc

SEQ ID NO: 974218 - DNA, 25 bp, Mus musculus
tcttgctgatctcagatgctgtttc

SEQ ID NO: 974219 - DNA, 25 bp, Mus musculus
tcttgctgctcacaggcctgcctgg

SEQ ID NO: 974220 - DNA, 25 bp, Mus musculus
tcttgctgctcaccagaggcctgcc

SEQ ID NO: 974221 - DNA, 25 bp, Mus musculus
tcttgctgctcagaggcctgcctgg

SEQ ID NO: 974222 - DNA, 25 bp, Mus musculus
tcttgctgctcagcagaggcctgcc

SEQ ID NO: 974223 - DNA, 25 bp, Mus musculus
tcttgctggtggaacgaggcaggat

SEQ ID NO: 974224 - DNA, 25 bp, Mus musculus
tcttgctggtggaaggaggcaggat

SEQ ID NO: 974225 - DNA, 25 bp, Mus musculus
tcttgctgtgcacgcatttttgcag

SEQ ID NO: 974226 - DNA, 25 bp, Mus musculus
tcttgctgtgcaggcatttttgcag

SEQ ID NO: 974227 - DNA, 25 bp, Mus musculus
tcttgcttagatggcaggttcagcg

SEQ ID NO: 974228 - DNA, 25 bp, Mus musculus
tcttgcttagttggcaggttcagcg

SEQ ID NO: 974229 - DNA, 25 bp, Mus musculus
tcttgcttggtgctcggatcctgtt

SEQ ID NO: 974230 - DNA, 25 bp, Mus musculus
tcttgcttggtgctgggatcctgtt

SEQ ID NO: 974231 - DNA, 25 bp, Mus musculus
tcttggaaagcttcacagaggctga

SEQ ID NO: 974232 - DNA, 25 bp, Mus musculus
tcttggaaaggttcacagaggctga

SEQ ID NO: 974233 - DNA, 25 bp, Mus musculus
tcttggaaatgacacgagatattga

SEQ ID NO: 974234 - DNA, 25 bp, Mus musculus
tcttggaaatgacaggagatattga

SEQ ID NO: 974235 - DNA, 25 bp, Mus musculus
tcttggaactaattctgcatagaga

SEQ ID NO: 974236 - DNA, 25 bp, Mus musculus
tcttggaacttattctgcatagaga

SEQ ID NO: 974237 - DNA, 25 bp, Mus musculus
tcttggaccacgctatggttttgga

SEQ ID NO: 974238 - DNA, 25 bp, Mus musculus
tcttggaccacggtatggttttgga

SEQ ID NO: 974239 - DNA, 25 bp, Mus musculus
tcttggacggagatgcctggaccaa

SEQ ID NO: 974240 - DNA, 25 bp, Mus musculus
tcttggacggagttgcctggaccaa

SEQ ID NO: 974241 - DNA, 25 bp, Mus musculus
tcttggacttcagacaatctgttaa

SEQ ID NO: 974242 - DNA, 25 bp, Mus musculus
tcttggacttcagagaatctgttaa

SEQ ID NO: 974243 - DNA, 25 bp, Mus musculus
tcttggagcaatccaagttaaagaa

SEQ ID NO: 974244 - DNA, 25 bp, Mus musculus
tcttggagcaatccattaaagaaag

SEQ ID NO: 974245 - DNA, 25 bp, Mus musculus
tcttggagcaatcctagttaaagaa

SEQ ID NO: 974246 - DNA, 25 bp, Mus musculus
tcttggagcaatcctttaaagaaag

SEQ ID NO: 974247 - DNA, 25 bp, Mus musculus
tcttggataaacaattgctgtgtct

SEQ ID NO: 974248 - DNA, 25 bp, Mus musculus
tcttggataaactattgctgtgtct

SEQ ID NO: 974249 - DNA, 25 bp, Mus musculus
tcttggcacctgagcacaaagtctg

SEQ ID NO: 974250 - DNA, 25 bp, Mus musculus
tcttggcacctgaggacaaagtctg

SEQ ID NO: 974251 - DNA, 25 bp, Mus musculus
tcttggccacttcaccaagttcatt

SEQ ID NO: 974252 - DNA, 25 bp, Mus musculus
tcttggccacttcagcaagttcatt

SEQ ID NO: 974253 - DNA, 25 bp, Mus musculus
tcttggccagactgaacacttgcct

SEQ ID NO: 974254 - DNA, 25 bp, Mus musculus
tcttggccagtctgaacacttgcct

SEQ ID NO: 974255 - DNA, 25 bp, Mus musculus
tcttggctataaaaaatgccaggca

SEQ ID NO: 974256 - DNA, 25 bp, Mus musculus
tcttggctataataaatgccaggca

SEQ ID NO: 974257 - DNA, 25 bp, Mus musculus
tcttggctccagctttagttgcccc

SEQ ID NO: 974258 - DNA, 25 bp, Mus musculus
tcttggctccaggtttagttgcccc

SEQ ID NO: 974259 - DNA, 25 bp, Mus musculus
tcttgggaagaaagacgatgctcaa

SEQ ID NO: 974260 - DNA, 25 bp, Mus musculus
tcttgggaagtaagacgatgctcaa

SEQ ID NO: 974261 - DNA, 25 bp, Mus musculus
tcttgggagatgcgtatgctgccag

SEQ ID NO: 974262 - DNA, 25 bp, Mus musculus
tcttgggagatgggtatgctgccag

SEQ ID NO: 974263 - DNA, 25 bp, Mus musculus
tcttgggcatatcgtgcccaaccct

SEQ ID NO: 974264 - DNA, 25 bp, Mus musculus
tcttgggcatatggtgcccaaccct

SEQ ID NO: 974265 - DNA, 25 bp, Mus musculus
tcttgggctatggacctggtgctgt

SEQ ID NO: 974266 - DNA, 25 bp, Mus musculus
tcttgggctatggactcccaacagg

SEQ ID NO: 974267 - DNA, 25 bp, Mus musculus
tcttgggctatggagctggtgctgt

SEQ ID NO: 974268 - DNA, 25 bp, Mus musculus
tcttgggctatggagtcccaacagg

SEQ ID NO: 974269 - DNA, 25 bp, Mus musculus
tcttggggtgatcggttcagcattg

SEQ ID NO: 974270 - DNA, 25 bp, Mus musculus
tcttggggtgatgggttcagcattg

SEQ ID NO: 974271 - DNA, 25 bp, Mus musculus
tcttgggttcaacatcttggcaacc

SEQ ID NO: 974272 - DNA, 25 bp, Mus musculus
tcttgggttcaagatcttggcaacc

SEQ ID NO: 974273 - DNA, 25 bp, Mus musculus
tcttggtccttgaggatttcaaaca

SEQ ID NO: 974274 - DNA, 25 bp, Mus musculus
tcttggtccttgatccaccctccaa

SEQ ID NO: 974275 - DNA, 25 bp, Mus musculus
tcttggtccttgtggatttcaaaca

SEQ ID NO: 974276 - DNA, 25 bp, Mus musculus
tcttggtccttgttccaccctccaa

SEQ ID NO: 974277 - DNA, 25 bp, Mus musculus
tcttggtgcaggctttgtggtagtg

SEQ ID NO: 974278 - DNA, 25 bp, Mus musculus
tcttggtgcagggtttgtggtagtg

SEQ ID NO: 974279 - DNA, 25 bp, Mus musculus
tcttgtacttcactcaattttcacc

SEQ ID NO: 974280 - DNA, 25 bp, Mus musculus
tcttgtacttcactgaattttcacc

SEQ ID NO: 974281 - DNA, 25 bp, Mus musculus
tcttgtagagaacgcatctgtggct

SEQ ID NO: 974282 - DNA, 25 bp, Mus musculus
tcttgtagagaaggcatctgtggct

SEQ ID NO: 974283 - DNA, 25 bp, Mus musculus
tcttgtctccaacctgagcccctac

SEQ ID NO: 974284 - DNA, 25 bp, Mus musculus
tcttgtctccaagctgagcccctac

SEQ ID NO: 974285 - DNA, 25 bp, Mus musculus
tctttaaatgacaacaattgacata

SEQ ID NO: 974286 - DNA, 25 bp, Mus musculus
tctttaaatgactacaattgacata

SEQ ID NO: 974287 - DNA, 25 bp, Mus musculus
tctttaaatgtacactctaaatcca

SEQ ID NO: 974288 - DNA, 25 bp, Mus musculus
tctttaaatgtacagtctaaatcca

SEQ ID NO: 974289 - DNA, 25 bp, Mus musculus
tctttaactaccaaccatctatatt

SEQ ID NO: 974290 - DNA, 25 bp, Mus musculus
tctttaactaccaagcatctatatt

SEQ ID NO: 974291 - DNA, 25 bp, Mus musculus
tctttacatttcaagggcctgcacc

SEQ ID NO: 974292 - DNA, 25 bp, Mus musculus
tctttacatttctagggcctgcacc

SEQ ID NO: 974293 - DNA, 25 bp, Mus musculus
tctttactagcctgattgagtcaag

SEQ ID NO: 974294 - DNA, 25 bp, Mus musculus
tctttactaggctgattgagtcaag

SEQ ID NO: 974295 - DNA, 25 bp, Mus musculus
tctttactgaatataagtaccatat

SEQ ID NO: 974296 - DNA, 25 bp, Mus musculus
tctttactgaatttaagtaccatat

SEQ ID NO: 974297 - DNA, 25 bp, Mus musculus
tctttagaagaactgctctggatgt

SEQ ID NO: 974298 - DNA, 25 bp, Mus musculus
tctttagaagaagtgctctggatgt

SEQ ID NO: 974299 - DNA, 25 bp, Mus musculus
tctttagaagccttcagaaatggga

SEQ ID NO: 974300 - DNA, 25 bp, Mus musculus
tctttagaaggcttcagaaatggga

SEQ ID NO: 974301 - DNA, 25 bp, Mus musculus
tctttataaaaaactgctgtatctt

SEQ ID NO: 974302 - DNA, 25 bp, Mus musculus
tctttataaaaatctgctgtatctt

SEQ ID NO: 974303 - DNA, 25 bp, Mus musculus
tctttatcacccaacgttcagacaa

SEQ ID NO: 974304 - DNA, 25 bp, Mus musculus
tctttatcacccaaggttcagacaa

SEQ ID NO: 974305 - DNA, 25 bp, Mus musculus
tctttcaaaaacaacgaggaccagt

SEQ ID NO: 974306 - DNA, 25 bp, Mus musculus
tctttcaaaaacaaggaggaccagt

SEQ ID NO: 974307 - DNA, 25 bp, Mus musculus
tctttcaaaaatcgcagaaaagttt

SEQ ID NO: 974308 - DNA, 25 bp, Mus musculus
tctttcaaaattcgcagaaaagttt

SEQ ID NO: 974309 - DNA, 25 bp, Mus musculus
tctttcaaggaatcagccgccagat

SEQ ID NO: 974310 - DNA, 25 bp, Mus musculus
tctttcaaggaatctgccgccagat

SEQ ID NO: 974311 - DNA, 25 bp, Mus musculus
tctttcaccgatcatcgggaaagat

SEQ ID NO: 974312 - DNA, 25 bp, Mus musculus
tctttcaccgttcatcgggaaagat

SEQ ID NO: 974313 - DNA, 25 bp, Mus musculus
tctttcacgacacggctgagtacct

SEQ ID NO: 974314 - DNA, 25 bp, Mus musculus
tctttcacgacagggctgagtacct

SEQ ID NO: 974315 - DNA, 25 bp, Mus musculus
tctttcatagatgaagcccgaggca

SEQ ID NO: 974316 - DNA, 25 bp, Mus musculus
tctttcatagccggaaccctctgca

SEQ ID NO: 974317 - DNA, 25 bp, Mus musculus
tctttcatagcgattttgataaagt

SEQ ID NO: 974318 - DNA, 25 bp, Mus musculus
tctttcataggcggaaccctctgca

SEQ ID NO: 974319 - DNA, 25 bp, Mus musculus
tctttcatagggattttgataaagt

SEQ ID NO: 974320 - DNA, 25 bp, Mus musculus
tctttcatagttgaagcccgaggca

SEQ ID NO: 974321 - DNA, 25 bp, Mus musculus
tctttcatcaagcgtgacacttccg

SEQ ID NO: 974322 - DNA, 25 bp, Mus musculus
tctttcatcaagggtgacacttccg

SEQ ID NO: 974323 - DNA, 25 bp, Mus musculus
tctttcatctcacatgcctgcaaaa

SEQ ID NO: 974324 - DNA, 25 bp, Mus musculus
tctttcatctcagatgcctgcaaaa

SEQ ID NO: 974325 - DNA, 25 bp, Mus musculus
tctttcatttatctttcctgcatag

SEQ ID NO: 974326 - DNA, 25 bp, Mus musculus
tctttcatttttctttcctgcatag

SEQ ID NO: 974327 - DNA, 25 bp, Mus musculus
tctttccaaaagcaactgctttgct

SEQ ID NO: 974328 - DNA, 25 bp, Mus musculus
tctttccaaaagctcctgggacctg

SEQ ID NO: 974329 - DNA, 25 bp, Mus musculus
tctttccaaaaggaactgctttgct

SEQ ID NO: 974330 - DNA, 25 bp, Mus musculus
tctttccaaaaggtcctgggacctg

SEQ ID NO: 974331 - DNA, 25 bp, Mus musculus
tctttccacagggacactccaccac

SEQ ID NO: 974332 - DNA, 25 bp, Mus musculus
tctttccacagggagactccaccac

SEQ ID NO: 974333 - DNA, 25 bp, Mus musculus
tctttccagaagcgaagcaaaagtg

SEQ ID NO: 974334 - DNA, 25 bp, Mus musculus
tctttccagaagggaagcaaaagtg

SEQ ID NO: 974335 - DNA, 25 bp, Mus musculus
tctttcccgcaactgtgagtgtgtc

SEQ ID NO: 974336 - DNA, 25 bp, Mus musculus
tctttcccgcaagtgtgagtgtgtc

SEQ ID NO: 974337 - DNA, 25 bp, Mus musculus
tctttcctggaacacgtgacatgta

SEQ ID NO: 974338 - DNA, 25 bp, Mus musculus
tctttcctggaacaggtgacatgta

SEQ ID NO: 974339 - DNA, 25 bp, Mus musculus
tctttctaactgcccacctttgaca

SEQ ID NO: 974340 - DNA, 25 bp, Mus musculus
tctttctaactggccacctttgaca

SEQ ID NO: 974341 - DNA, 25 bp, Mus musculus
tctttctcagatcacaaacaatatt

SEQ ID NO: 974342 - DNA, 25 bp, Mus musculus
tctttctcagttcacaaacaatatt

SEQ ID NO: 974343 - DNA, 25 bp, Mus musculus
tctttctctcagccaaagccttcta

SEQ ID NO: 974344 - DNA, 25 bp, Mus musculus
tctttctctcaggcaaagccttcta

SEQ ID NO: 974345 - DNA, 25 bp, Mus musculus
tctttctgagagaaactgcaagaaa

SEQ ID NO: 974346 - DNA, 25 bp, Mus musculus
tctttctgagagaatctgcaagaaa

SEQ ID NO: 974347 - DNA, 25 bp, Mus musculus
tctttctgatcaatcgtcctgaaat

SEQ ID NO: 974348 - DNA, 25 bp, Mus musculus
tctttctgatcaatggtcctgaaat

SEQ ID NO: 974349 - DNA, 25 bp, Mus musculus
tctttctggacctgcctgcaggtcc

SEQ ID NO: 974350 - DNA, 25 bp, Mus musculus
tctttctggacctggctgcaggtcc

SEQ ID NO: 974351 - DNA, 25 bp, Mus musculus
tctttctgttcctacgagccgttca

SEQ ID NO: 974352 - DNA, 25 bp, Mus musculus
tctttctgttcctaggagccgttca

SEQ ID NO: 974353 - DNA, 25 bp, Mus musculus
tctttcttcacaacatctcccctaa

SEQ ID NO: 974354 - DNA, 25 bp, Mus musculus
tctttcttcacatcatctcccctaa

SEQ ID NO: 974355 - DNA, 25 bp, Mus musculus
tctttgaaaaagagcccactaggta

SEQ ID NO: 974356 - DNA, 25 bp, Mus musculus
tctttgaaaaagcagagcaacttct

SEQ ID NO: 974357 - DNA, 25 bp, Mus musculus
tctttgaaaaaggagagcaacttct

SEQ ID NO: 974358 - DNA, 25 bp, Mus musculus
tctttgaaaaagtgcccactaggta

SEQ ID NO: 974359 - DNA, 25 bp, Mus musculus
tctttgaaagcagaaggaatgagcc

SEQ ID NO: 974360 - DNA, 25 bp, Mus musculus
tctttgaaagcgctgctgaaaaggg

SEQ ID NO: 974361 - DNA, 25 bp, Mus musculus
tctttgaaaggagaaggaatgagcc

SEQ ID NO: 974362 - DNA, 25 bp, Mus musculus
tctttgaaagggctgctgaaaaggg

SEQ ID NO: 974363 - DNA, 25 bp, Mus musculus
tctttgaaccttaggtcagaaagca

SEQ ID NO: 974364 - DNA, 25 bp, Mus musculus
tctttgaacctttggtcagaaagca

SEQ ID NO: 974365 - DNA, 25 bp, Mus musculus
tctttgacagcgtgctaacagagct

SEQ ID NO: 974366 - DNA, 25 bp, Mus musculus
tctttgacagggtgctaacagagct

SEQ ID NO: 974367 - DNA, 25 bp, Mus musculus
tctttgacatcactgatgagagtag

SEQ ID NO: 974368 - DNA, 25 bp, Mus musculus
tctttgacatcagtgatgagagtag

SEQ ID NO: 974369 - DNA, 25 bp, Mus musculus
tctttgacatgacccagtggaggca

SEQ ID NO: 974370 - DNA, 25 bp, Mus musculus
tctttgacatgagccagtggaggca

SEQ ID NO: 974371 - DNA, 25 bp, Mus musculus
tctttgatataatgcacagccgatg

SEQ ID NO: 974372 - DNA, 25 bp, Mus musculus
tctttgatataatggacagccgatg

SEQ ID NO: 974373 - DNA, 25 bp, Mus musculus
tctttgatccagatgccaaggggct

SEQ ID NO: 974374 - DNA, 25 bp, Mus musculus
tctttgatccagttgccaaggggct

SEQ ID NO: 974375 - DNA, 25 bp, Mus musculus
tctttgatgcccatcaaggtttctc

SEQ ID NO: 974376 - DNA, 25 bp, Mus musculus
tctttgatgcccatgaaggtttctc

SEQ ID NO: 974377 - DNA, 25 bp, Mus musculus
tctttgccttccgacatgagacggc

SEQ ID NO: 974378 - DNA, 25 bp, Mus musculus
tctttgccttccgacggcagtactg

SEQ ID NO: 974379 - DNA, 25 bp, Mus musculus
tctttgccttccgagatgagacggc

SEQ ID NO: 974380 - DNA, 25 bp, Mus musculus
tctttgccttccgagggcagtactg

SEQ ID NO: 974381 - DNA, 25 bp, Mus musculus
tctttgcttgaaagggcctgtgttt

SEQ ID NO: 974382 - DNA, 25 bp, Mus musculus
tctttgcttgaatgggcctgtgttt

SEQ ID NO: 974383 - DNA, 25 bp, Mus musculus
tctttggagaaaaatgtggaattgg

SEQ ID NO: 974384 - DNA, 25 bp, Mus musculus
tctttggagaaatatgtggaattgg

SEQ ID NO: 974385 - DNA, 25 bp, Mus musculus
tctttggagctgcgtttgacacagt

SEQ ID NO: 974386 - DNA, 25 bp, Mus musculus
tctttggagctgggtttgacacagt

SEQ ID NO: 974387 - DNA, 25 bp, Mus musculus
tctttggcaacaaccctctggtgca

SEQ ID NO: 974388 - DNA, 25 bp, Mus musculus
tctttggcaacaacgctctggtgca

SEQ ID NO: 974389 - DNA, 25 bp, Mus musculus
tctttggcaagtttcggcctgcctt

SEQ ID NO: 974390 - DNA, 25 bp, Mus musculus
tctttggcaagtttgggcctgcctt

SEQ ID NO: 974391 - DNA, 25 bp, Mus musculus
tctttggctgggctctgccggctgt

SEQ ID NO: 974392 - DNA, 25 bp, Mus musculus
tctttggctggggtctgccggctgt

SEQ ID NO: 974393 - DNA, 25 bp, Mus musculus
tctttggggatgcccctgcctccct

SEQ ID NO: 974394 - DNA, 25 bp, Mus musculus
tctttggggatggccctgcctccct

SEQ ID NO: 974395 - DNA, 25 bp, Mus musculus
tctttgtcaccgatgttcctgatga

SEQ ID NO: 974396 - DNA, 25 bp, Mus musculus
tctttgtcacggatgttcctgatga

SEQ ID NO: 974397 - DNA, 25 bp, Mus musculus
tctttgtcctaacattagcctcaca

SEQ ID NO: 974398 - DNA, 25 bp, Mus musculus
tctttgtcctaagattagcctcaca

SEQ ID NO: 974399 - DNA, 25 bp, Mus musculus
tctttgtgagactcttcgtaccacc

SEQ ID NO: 974400 - DNA, 25 bp, Mus musculus
tctttgtgagcagtgatgcatccag

SEQ ID NO: 974401 - DNA, 25 bp, Mus musculus
tctttgtgaggagtgatgcatccag

SEQ ID NO: 974402 - DNA, 25 bp, Mus musculus
tctttgtgagtctcttcgtaccacc

SEQ ID NO: 974403 - DNA, 25 bp, Mus musculus
tctttgtgccagatcccaccatggg

SEQ ID NO: 974404 - DNA, 25 bp, Mus musculus
tctttgtgccagttcccaccatggg

SEQ ID NO: 974405 - DNA, 25 bp, Mus musculus
tctttgtggtggccggacctggctc

SEQ ID NO: 974406 - DNA, 25 bp, Mus musculus
tctttgtggtgggcggacctggctc

SEQ ID NO: 974407 - DNA, 25 bp, Mus musculus
tctttgtgtcttcacaaatgcagct

SEQ ID NO: 974408 - DNA, 25 bp, Mus musculus
tctttgtgtcttcagaaatgcagct

SEQ ID NO: 974409 - DNA, 25 bp, Mus musculus
tctttgtgtgcccttcaccacgttc

SEQ ID NO: 974410 - DNA, 25 bp, Mus musculus
tctttgtgtggccttcaccacgttc

SEQ ID NO: 974411 - DNA, 25 bp, Mus musculus
tctttgtgttcgatgtttcgtcttc

SEQ ID NO: 974412 - DNA, 25 bp, Mus musculus
tctttgtgttggatgtttcgtcttc

SEQ ID NO: 974413 - DNA, 25 bp, Mus musculus
tctttgttcgaaaaaatgctgctca

SEQ ID NO: 974414 - DNA, 25 bp, Mus musculus
tctttgttcgaataaatgctgctca

SEQ ID NO: 974415 - DNA, 25 bp, Mus musculus
tctttgtttggaaacgcaagcaggc

SEQ ID NO: 974416 - DNA, 25 bp, Mus musculus
tctttgtttggaaaggcaagcaggc

SEQ ID NO: 974417 - DNA, 25 bp, Mus musculus
tcttttattttggacgttgtccaga

SEQ ID NO: 974418 - DNA, 25 bp, Mus musculus
tcttttattttggaggttgtccaga

SEQ ID NO: 974419 - DNA, 25 bp, Mus musculus
tcttttcagccacgaagagctttct

SEQ ID NO: 974420 - DNA, 25 bp, Mus musculus
tcttttcagccaggaagagctttct

SEQ ID NO: 974421 - DNA, 25 bp, Mus musculus
tcttttcataatcaatggtagccga

SEQ ID NO: 974422 - DNA, 25 bp, Mus musculus
tcttttcataatgaatggtagccga

SEQ ID NO: 974423 - DNA, 25 bp, Mus musculus
tcttttgaatcgcagacagttccct

SEQ ID NO: 974424 - DNA, 25 bp, Mus musculus
tcttttgaatcggagacagttccct

SEQ ID NO: 974425 - DNA, 25 bp, Mus musculus
tcttttgtgccacagaaagagagag

SEQ ID NO: 974426 - DNA, 25 bp, Mus musculus
tcttttgtgccagagaaagagagag

SEQ ID NO: 974427 - DNA, 25 bp, Mus musculus
tctttttaagctatcccagaatgcc

SEQ ID NO: 974428 - DNA, 25 bp, Mus musculus
tctttttaaggtatcccagaatgcc

SEQ ID NO: 974429 - DNA, 25 bp, Mus musculus
tctttttgctaaagtacctgtttcc

SEQ ID NO: 974430 - DNA, 25 bp, Mus musculus
tctttttgctaatgtacctgtttcc

SEQ ID NO: 974431 - DNA, 25 bp, Mus musculus
tgaaaaacaatgcgttgatcagagc

SEQ ID NO: 974432 - DNA, 25 bp, Mus musculus
tgaaaaacaatgggttgatcagagc

SEQ ID NO: 974433 - DNA, 25 bp, Mus musculus
tgaaaaacagatagaagaagtgaat

SEQ ID NO: 974434 - DNA, 25 bp, Mus musculus
tgaaaaacagcaggaggaagcagaa

SEQ ID NO: 974435 - DNA, 25 bp, Mus musculus
tgaaaaacaggaggaggaagcagaa

SEQ ID NO: 974436 - DNA, 25 bp, Mus musculus
tgaaaaacagttagaagaagtgaat

SEQ ID NO: 974437 - DNA, 25 bp, Mus musculus
tgaaaaaccgcacgcccttcaacac

SEQ ID NO: 974438 - DNA, 25 bp, Mus musculus
tgaaaaaccgcacggccttcaacac

SEQ ID NO: 974439 - DNA, 25 bp, Mus musculus
tgaaaaacttcacaccccagtgcat

SEQ ID NO: 974440 - DNA, 25 bp, Mus musculus
tgaaaaacttcagaccccagtgcat

SEQ ID NO: 974441 - DNA, 25 bp, Mus musculus
tgaaaaacttgacgtatctgagtta

SEQ ID NO: 974442 - DNA, 25 bp, Mus musculus
tgaaaaacttgaggtatctgagtta

SEQ ID NO: 974443 - DNA, 25 bp, Mus musculus
tgaaaaagaaagatcattactcctt

SEQ ID NO: 974444 - DNA, 25 bp, Mus musculus
tgaaaaagaaagttcattactcctt

SEQ ID NO: 974445 - DNA, 25 bp, Mus musculus
tgaaaaagaacacatttctcgaagc

SEQ ID NO: 974446 - DNA, 25 bp, Mus musculus
tgaaaaagaacagatttctcgaagc

SEQ ID NO: 974447 - DNA, 25 bp, Mus musculus
tgaaaaagagccattttataagttt

SEQ ID NO: 974448 - DNA, 25 bp, Mus musculus
tgaaaaagagctgcatgagaaattt

SEQ ID NO: 974449 - DNA, 25 bp, Mus musculus
tgaaaaagaggcattttataagttt

SEQ ID NO: 974450 - DNA, 25 bp, Mus musculus
tgaaaaagaggtgcatgagaaattt

SEQ ID NO: 974451 - DNA, 25 bp, Mus musculus
tgaaaaatccgtgacgtatcatcac

SEQ ID NO: 974452 - DNA, 25 bp, Mus musculus
tgaaaaatccgtgaggtatcatcac

SEQ ID NO: 974453 - DNA, 25 bp, Mus musculus
tgaaaaatgcaaaaagttgaggaat

SEQ ID NO: 974454 - DNA, 25 bp, Mus musculus
tgaaaaatgcaaaatgttgaggaat

SEQ ID NO: 974455 - DNA, 25 bp, Mus musculus
tgaaaacatacaagttgccaggatg

SEQ ID NO: 974456 - DNA, 25 bp, Mus musculus
tgaaaacatacatgttgccaggatg

SEQ ID NO: 974457 - DNA, 25 bp, Mus musculus
tgaaaaccatcacaatgactgcttc

SEQ ID NO: 974458 - DNA, 25 bp, Mus musculus
tgaaaaccatcacattgactgcttc

SEQ ID NO: 974459 - DNA, 25 bp, Mus musculus
tgaaaactggtcagtacttggctct

SEQ ID NO: 974460 - DNA, 25 bp, Mus musculus
tgaaaactggtctgtacttggctct

SEQ ID NO: 974461 - DNA, 25 bp, Mus musculus
tgaaaagaacaacaccatcattaag

SEQ ID NO: 974462 - DNA, 25 bp, Mus musculus
tgaaaagaacaagaccatcattaag

SEQ ID NO: 974463 - DNA, 25 bp, Mus musculus
tgaaaagcaagaagcacctagaccg

SEQ ID NO: 974464 - DNA, 25 bp, Mus musculus
tgaaaagcaagaagcgtcttgttgc

SEQ ID NO: 974465 - DNA, 25 bp, Mus musculus
tgaaaagcaagaaggacctagaccg

SEQ ID NO: 974466 - DNA, 25 bp, Mus musculus
tgaaaagcaagaagggtcttgttgc

SEQ ID NO: 974467 - DNA, 25 bp, Mus musculus
tgaaaagcagcccttcaaacaagct

SEQ ID NO: 974468 - DNA, 25 bp, Mus musculus
tgaaaagcaggccttcaaacaagct

SEQ ID NO: 974469 - DNA, 25 bp, Mus musculus
tgaaaataagagccattctgaggag

SEQ ID NO: 974470 - DNA, 25 bp, Mus musculus
tgaaaataagcagactggatgacaa

SEQ ID NO: 974471 - DNA, 25 bp, Mus musculus
tgaaaataaggagactggatgacaa

SEQ ID NO: 974472 - DNA, 25 bp, Mus musculus
tgaaaataagtgccattctgaggag

SEQ ID NO: 974473 - DNA, 25 bp, Mus musculus
tgaaaatagaagccagttatgagtc

SEQ ID NO: 974474 - DNA, 25 bp, Mus musculus
tgaaaatagaaggcagttatgagtc

SEQ ID NO: 974475 - DNA, 25 bp, Mus musculus
tgaaaatgcttgcgtcaccagtgga

SEQ ID NO: 974476 - DNA, 25 bp, Mus musculus
tgaaaatgcttgggtcaccagtgga

SEQ ID NO: 974477 - DNA, 25 bp, Mus musculus
tgaaaatgttatgtaggtattttct

SEQ ID NO: 974478 - DNA, 25 bp, Mus musculus
tgaaaatgttatgttggtattttct

SEQ ID NO: 974479 - DNA, 25 bp, Mus musculus
tgaaacaatgcttgaaatttggagt

SEQ ID NO: 974480 - DNA, 25 bp, Mus musculus
tgaaacaatggttgaaatttggagt

SEQ ID NO: 974481 - DNA, 25 bp, Mus musculus
tgaaacatctggaacgtatctcaga

SEQ ID NO: 974482 - DNA, 25 bp, Mus musculus
tgaaacatctggaaggtatctcaga

SEQ ID NO: 974483 - DNA, 25 bp, Mus musculus
tgaaacatgcagctatgggttcata

SEQ ID NO: 974484 - DNA, 25 bp, Mus musculus
tgaaacatgcaggtatgggttcata

SEQ ID NO: 974485 - DNA, 25 bp, Mus musculus
tgaaaccaagccattctctgacgcc

SEQ ID NO: 974486 - DNA, 25 bp, Mus musculus
tgaaaccaaggcattctctgacgcc

SEQ ID NO: 974487 - DNA, 25 bp, Mus musculus
tgaaaccaatgtgacagggcgattg

SEQ ID NO: 974488 - DNA, 25 bp, Mus musculus
tgaaaccaatgtgagagggcgattg

SEQ ID NO: 974489 - DNA, 25 bp, Mus musculus
tgaaactaagcacaacaagccatcc

SEQ ID NO: 974490 - DNA, 25 bp, Mus musculus
tgaaactaagcacgaagcagaacaa

SEQ ID NO: 974491 - DNA, 25 bp, Mus musculus
tgaaactaagcagaacaagccatcc

SEQ ID NO: 974492 - DNA, 25 bp, Mus musculus
tgaaactaagcaggaagcagaacaa

SEQ ID NO: 974493 - DNA, 25 bp, Mus musculus
tgaaactcttagctgtgtgtgccgt

SEQ ID NO: 974494 - DNA, 25 bp, Mus musculus
tgaaactcttaggtgtgtgtgccgt

SEQ ID NO: 974495 - DNA, 25 bp, Mus musculus
tgaaactgtcctgacagtactatct

SEQ ID NO: 974496 - DNA, 25 bp, Mus musculus
tgaaactgtcctgagagtactatct

SEQ ID NO: 974497 - DNA, 25 bp, Mus musculus
tgaaacttatgacacggtacatagc

SEQ ID NO: 974498 - DNA, 25 bp, Mus musculus
tgaaacttatgagacggtacatagc

SEQ ID NO: 974499 - DNA, 25 bp, Mus musculus
tgaaagaatcaactagcagctgtgg

SEQ ID NO: 974500 - DNA, 25 bp, Mus musculus
tgaaagaatcaagtagcagctgtgg

SEQ ID NO: 974501 - DNA, 25 bp, Mus musculus
tgaaagaatgcctgaaaagaagaaa

SEQ ID NO: 974502 - DNA, 25 bp, Mus musculus
tgaaagaatgcctgtaaagaagaaa

SEQ ID NO: 974503 - DNA, 25 bp, Mus musculus
tgaaagacagaaacaaactgttccc

SEQ ID NO: 974504 - DNA, 25 bp, Mus musculus
tgaaagacagcgacatgaaacctga

SEQ ID NO: 974505 - DNA, 25 bp, Mus musculus
tgaaagacagggacatgaaacctga

SEQ ID NO: 974506 - DNA, 25 bp, Mus musculus
tgaaagacagtaacaaactgttccc

SEQ ID NO: 974507 - DNA, 25 bp, Mus musculus
tgaaagacgtctagacatggatgag

SEQ ID NO: 974508 - DNA, 25 bp, Mus musculus
tgaaagacgtgtagacatggatgag

SEQ ID NO: 974509 - DNA, 25 bp, Mus musculus
tgaaagagggtgaacaaactgaagg

SEQ ID NO: 974510 - DNA, 25 bp, Mus musculus
tgaaagagggtgaagaaactgaagg

SEQ ID NO: 974511 - DNA, 25 bp, Mus musculus
tgaaagatcaatcggcagcagcaat

SEQ ID NO: 974512 - DNA, 25 bp, Mus musculus
tgaaagatcaatgggcagcagcaat

SEQ ID NO: 974513 - DNA, 25 bp, Mus musculus
tgaaagcaatctgacagatctcaat

SEQ ID NO: 974514 - DNA, 25 bp, Mus musculus
tgaaagcaatctgagagatctcaat

SEQ ID NO: 974515 - DNA, 25 bp, Mus musculus
tgaaagcatccactttgtgctcgat

SEQ ID NO: 974516 - DNA, 25 bp, Mus musculus
tgaaagcatccagtttgtgctcgat

SEQ ID NO: 974517 - DNA, 25 bp, Mus musculus
tgaaagccatgccccagagaccgct

SEQ ID NO: 974518 - DNA, 25 bp, Mus musculus
tgaaagccatgcgccagagaccgct

SEQ ID NO: 974519 - DNA, 25 bp, Mus musculus
tgaaagcccaagaggccgcacgagg

SEQ ID NO: 974520 - DNA, 25 bp, Mus musculus
tgaaagcccaagtggccgcacgagg

SEQ ID NO: 974521 - DNA, 25 bp, Mus musculus
tgaaagcttcagctctttccgggta

SEQ ID NO: 974522 - DNA, 25 bp, Mus musculus
tgaaagcttcaggtctttccgggta

SEQ ID NO: 974523 - DNA, 25 bp, Mus musculus
tgaaagcttgtgtcacagttctgca

SEQ ID NO: 974524 - DNA, 25 bp, Mus musculus
tgaaagcttgtgtctcagttctgca

SEQ ID NO: 974525 - DNA, 25 bp, Mus musculus
tgaaaggaattcaacatggtcaaat

SEQ ID NO: 974526 - DNA, 25 bp, Mus musculus
tgaaaggaattcaagatggtcaaat

SEQ ID NO: 974527 - DNA, 25 bp, Mus musculus
tgaaaggaattccagatggtcaaat

SEQ ID NO: 974528 - DNA, 25 bp, Mus musculus
tgaaaggaattcgagatggtcaaat

SEQ ID NO: 974529 - DNA, 25 bp, Mus musculus
tgaaaggcacatacttggtacattt

SEQ ID NO: 974530 - DNA, 25 bp, Mus musculus
tgaaaggcacattcttggtacattt

SEQ ID NO: 974531 - DNA, 25 bp, Mus musculus
tgaaaggcctcgctactgatgaaga

SEQ ID NO: 974532 - DNA, 25 bp, Mus musculus
tgaaaggcctcggtactgatgaaga

SEQ ID NO: 974533 - DNA, 25 bp, Mus musculus
tgaaaggctgaacgaaacagagaag

SEQ ID NO: 974534 - DNA, 25 bp, Mus musculus
tgaaaggctgaaggaaacagagaag

SEQ ID NO: 974535 - DNA, 25 bp, Mus musculus
tgaaagggcccaagatctccatctt

SEQ ID NO: 974536 - DNA, 25 bp, Mus musculus
tgaaagggcccatgatctccatctt

SEQ ID NO: 974537 - DNA, 25 bp, Mus musculus
tgaaaggggtggcacgtgtccagaa

SEQ ID NO: 974538 - DNA, 25 bp, Mus musculus
tgaaaggggtggcaggtgtccagaa

SEQ ID NO: 974539 - DNA, 25 bp, Mus musculus
tgaaagttggacaacatgcaagttc

SEQ ID NO: 974540 - DNA, 25 bp, Mus musculus
tgaaagttggacaagatgcaagttc

SEQ ID NO: 974541 - DNA, 25 bp, Mus musculus
tgaaataatacgatttttatcaaaa

SEQ ID NO: 974542 - DNA, 25 bp, Mus musculus
tgaaataataggatttttatcaaaa

SEQ ID NO: 974543 - DNA, 25 bp, Mus musculus
tgaaatatttagattatccttatgt

SEQ ID NO: 974544 - DNA, 25 bp, Mus musculus
tgaaatatttagtttatccttatgt

SEQ ID NO: 974545 - DNA, 25 bp, Mus musculus
tgaaatatttgacgataacagcttc

SEQ ID NO: 974546 - DNA, 25 bp, Mus musculus
tgaaatatttgaggataacagcttc

SEQ ID NO: 974547 - DNA, 25 bp, Mus musculus
tgaaatcaagcaacaagcaatggca

SEQ ID NO: 974548 - DNA, 25 bp, Mus musculus
tgaaatcaagctaactatggatgca

SEQ ID NO: 974549 - DNA, 25 bp, Mus musculus
tgaaatcaaggaacaagcaatggca

SEQ ID NO: 974550 - DNA, 25 bp, Mus musculus
tgaaatcaaggtaactatggatgca

SEQ ID NO: 974551 - DNA, 25 bp, Mus musculus
tgaaatccaacaatatatttctcca

SEQ ID NO: 974552 - DNA, 25 bp, Mus musculus
tgaaatccaacattatatttctcca

SEQ ID NO: 974553 - DNA, 25 bp, Mus musculus
tgaaatccttccaggaaggccggat

SEQ ID NO: 974554 - DNA, 25 bp, Mus musculus
tgaaatccttcctggaaggccggat

SEQ ID NO: 974555 - DNA, 25 bp, Mus musculus
tgaaatctttctcgtatacattgtc

SEQ ID NO: 974556 - DNA, 25 bp, Mus musculus
tgaaatctttctggtatacattgtc

SEQ ID NO: 974557 - DNA, 25 bp, Mus musculus
tgaaatgatccacgtactgcagggt

SEQ ID NO: 974558 - DNA, 25 bp, Mus musculus
tgaaatgatccaggtactgcagggt

SEQ ID NO: 974559 - DNA, 25 bp, Mus musculus
tgaaatgcaaacaacagatgtaatt

SEQ ID NO: 974560 - DNA, 25 bp, Mus musculus
tgaaatgcaaactacagatgtaatt

SEQ ID NO: 974561 - DNA, 25 bp, Mus musculus
tgaaatgccgattggttgtatcaag

SEQ ID NO: 974562 - DNA, 25 bp, Mus musculus
tgaaatgccgtttggttgtatcaag

SEQ ID NO: 974563 - DNA, 25 bp, Mus musculus
tgaaatgtccagcttgctacaagat

SEQ ID NO: 974564 - DNA, 25 bp, Mus musculus
tgaaatgtccaggttgctacaagat

SEQ ID NO: 974565 - DNA, 25 bp, Mus musculus
tgaaatgtctcccctattacgctgg

SEQ ID NO: 974566 - DNA, 25 bp, Mus musculus
tgaaatgtctccgctattacgctgg

SEQ ID NO: 974567 - DNA, 25 bp, Mus musculus
tgaaatgttccactatgttaaagga

SEQ ID NO: 974568 - DNA, 25 bp, Mus musculus
tgaaatgttccagtatgttaaagga

SEQ ID NO: 974569 - DNA, 25 bp, Mus musculus
tgaaattaatcaagcagacacaact

SEQ ID NO: 974570 - DNA, 25 bp, Mus musculus
tgaaattaatcatgcagacacaact

SEQ ID NO: 974571 - DNA, 25 bp, Mus musculus
tgaaattcacaaaacggaaggatct

SEQ ID NO: 974572 - DNA, 25 bp, Mus musculus
tgaaattcacaaaagggaaggatct

SEQ ID NO: 974573 - DNA, 25 bp, Mus musculus
tgaaattccacaagctgatcaacgt

SEQ ID NO: 974574 - DNA, 25 bp, Mus musculus
tgaaattccacatgctgatcaacgt

SEQ ID NO: 974575 - DNA, 25 bp, Mus musculus
tgaaattgccagcttctacaaactg

SEQ ID NO: 974576 - DNA, 25 bp, Mus musculus
tgaaattgccaggttctacaaactg

SEQ ID NO: 974577 - DNA, 25 bp, Mus musculus
tgaaattggacacgtccttcatttt

SEQ ID NO: 974578 - DNA, 25 bp, Mus musculus
tgaaattggacaggtccttcatttt

SEQ ID NO: 974579 - DNA, 25 bp, Mus musculus
tgaaattgtacaactgtatggagta

SEQ ID NO: 974580 - DNA, 25 bp, Mus musculus
tgaaattgtagaactgtatggagta

SEQ ID NO: 974581 - DNA, 25 bp, Mus musculus
tgaaattttccacgtccactggtct

SEQ ID NO: 974582 - DNA, 25 bp, Mus musculus
tgaaattttccaggtccactggtct

SEQ ID NO: 974583 - DNA, 25 bp, Mus musculus
tgaacaaaacaacaatgtcattgcg

SEQ ID NO: 974584 - DNA, 25 bp, Mus musculus
tgaacaaaacaagaatgtcattgcg

SEQ ID NO: 974585 - DNA, 25 bp, Mus musculus
tgaacaagagctgtactaccaagtc

SEQ ID NO: 974586 - DNA, 25 bp, Mus musculus
tgaacaagaggtgtactaccaagtc

SEQ ID NO: 974587 - DNA, 25 bp, Mus musculus
tgaacaagctggcgcaccagaagaa

SEQ ID NO: 974588 - DNA, 25 bp, Mus musculus
tgaacaagctggggcaccagaagaa

SEQ ID NO: 974589 - DNA, 25 bp, Mus musculus
tgaacaagtcaacttactggcagaa

SEQ ID NO: 974590 - DNA, 25 bp, Mus musculus
tgaacaagtcaagttactggcagaa

SEQ ID NO: 974591 - DNA, 25 bp, Mus musculus
tgaacaatgtagatggtgtgcagaa

SEQ ID NO: 974592 - DNA, 25 bp, Mus musculus
tgaacaatgtagttggtgtgcagaa

SEQ ID NO: 974593 - DNA, 25 bp, Mus musculus
tgaacaattccactatactctggat

SEQ ID NO: 974594 - DNA, 25 bp, Mus musculus
tgaacaattccagtatactctggat

SEQ ID NO: 974595 - DNA, 25 bp, Mus musculus
tgaacactctggccaaccgctttcc

SEQ ID NO: 974596 - DNA, 25 bp, Mus musculus
tgaacactctggcctaccgctttcc

SEQ ID NO: 974597 - DNA, 25 bp, Mus musculus
tgaacagaagattggacagcccaca

SEQ ID NO: 974598 - DNA, 25 bp, Mus musculus
tgaacagaagtttggacagcccaca

SEQ ID NO: 974599 - DNA, 25 bp, Mus musculus
tgaacagagaaacaaagttgaaact

SEQ ID NO: 974600 - DNA, 25 bp, Mus musculus
tgaacagagaaagaaagttgaaact

SEQ ID NO: 974601 - DNA, 25 bp, Mus musculus
tgaacagaggggacgaccctgtgcg

SEQ ID NO: 974602 - DNA, 25 bp, Mus musculus
tgaacagaggggtcgaccctgtgcg

SEQ ID NO: 974603 - DNA, 25 bp, Mus musculus
tgaacagcaaagctcaatatccaac

SEQ ID NO: 974604 - DNA, 25 bp, Mus musculus
tgaacagcaaaggtcaatatccaac

SEQ ID NO: 974605 - DNA, 25 bp, Mus musculus
tgaacagcagaacactagagagact

SEQ ID NO: 974606 - DNA, 25 bp, Mus musculus
tgaacagcagaagactagagagact

SEQ ID NO: 974607 - DNA, 25 bp, Mus musculus
tgaacagctccgaaggagactggtg

SEQ ID NO: 974608 - DNA, 25 bp, Mus musculus
tgaacagctcggaaggagactggtg

SEQ ID NO: 974609 - DNA, 25 bp, Mus musculus
tgaacatcaacgcttctcccatggc

SEQ ID NO: 974610 - DNA, 25 bp, Mus musculus
tgaacatcaacggttctcccatggc

SEQ ID NO: 974611 - DNA, 25 bp, Mus musculus
tgaacatcctcaaaccgacccctga

SEQ ID NO: 974612 - DNA, 25 bp, Mus musculus
tgaacatcctcaaacgatacaactt

SEQ ID NO: 974613 - DNA, 25 bp, Mus musculus
tgaacatcctcaaagcgacccctga

SEQ ID NO: 974614 - DNA, 25 bp, Mus musculus
tgaacatcctcaaaggatacaactt

SEQ ID NO: 974615 - DNA, 25 bp, Mus musculus
tgaacatgggcccaatgaagctgtt

SEQ ID NO: 974616 - DNA, 25 bp, Mus musculus
tgaacatgggccgaatgaagctgtt

SEQ ID NO: 974617 - DNA, 25 bp, Mus musculus
tgaacatttaagagtgaatgccatc

SEQ ID NO: 974618 - DNA, 25 bp, Mus musculus
tgaacatttaagccaattctgcctt

SEQ ID NO: 974619 - DNA, 25 bp, Mus musculus
tgaacatttaaggcaattctgcctt

SEQ ID NO: 974620 - DNA, 25 bp, Mus musculus
tgaacatttaagtgtgaatgccatc

SEQ ID NO: 974621 - DNA, 25 bp, Mus musculus
tgaaccaaagcacacataaaatctg

SEQ ID NO: 974622 - DNA, 25 bp, Mus musculus
tgaaccaaagcacagataaaatctg

SEQ ID NO: 974623 - DNA, 25 bp, Mus musculus
tgaacccaagagacttctctaccca

SEQ ID NO: 974624 - DNA, 25 bp, Mus musculus
tgaacccaagagtcttctctaccca

SEQ ID NO: 974625 - DNA, 25 bp, Mus musculus
tgaaccccagctttgaggagccacg

SEQ ID NO: 974626 - DNA, 25 bp, Mus musculus
tgaaccccaggtttgaggagccacg

SEQ ID NO: 974627 - DNA, 25 bp, Mus musculus
tgaacccccagatacgtcacctctg

SEQ ID NO: 974628 - DNA, 25 bp, Mus musculus
tgaacccccagataggtcacctctg

SEQ ID NO: 974629 - DNA, 25 bp, Mus musculus
tgaaccctgaagcgagcctctgatc

SEQ ID NO: 974630 - DNA, 25 bp, Mus musculus
tgaaccctgaagggagcctctgatc

SEQ ID NO: 974631 - DNA, 25 bp, Mus musculus
tgaaccgccagtacaaggcggataa

SEQ ID NO: 974632 - DNA, 25 bp, Mus musculus
tgaaccgccagttcaaggcggataa

SEQ ID NO: 974633 - DNA, 25 bp, Mus musculus
tgaacctcacagatgaaacaggagt

SEQ ID NO: 974634 - DNA, 25 bp, Mus musculus
tgaacctcacagttgaaacaggagt

SEQ ID NO: 974635 - DNA, 25 bp, Mus musculus
tgaacctcaccaccatgtccaaaat

SEQ ID NO: 974636 - DNA, 25 bp, Mus musculus
tgaacctcaccagcatgtccaaaat

SEQ ID NO: 974637 - DNA, 25 bp, Mus musculus
tgaacctccgaaccagattcacaga

SEQ ID NO: 974638 - DNA, 25 bp, Mus musculus
tgaacctccgaacctgattcacaga

SEQ ID NO: 974639 - DNA, 25 bp, Mus musculus
tgaacctcctcactatccgtatatt

SEQ ID NO: 974640 - DNA, 25 bp, Mus musculus
tgaacctcctcagtatccgtatatt

SEQ ID NO: 974641 - DNA, 25 bp, Mus musculus
tgaacctgaaagccaaaggacatgg

SEQ ID NO: 974642 - DNA, 25 bp, Mus musculus
tgaacctgaaaggcaaaggacatgg

SEQ ID NO: 974643 - DNA, 25 bp, Mus musculus
tgaacctgaagacgttgccaggctc

SEQ ID NO: 974644 - DNA, 25 bp, Mus musculus
tgaacctgaagaggttgccaggctc

SEQ ID NO: 974645 - DNA, 25 bp, Mus musculus
tgaacgaatgcaccaatgacactgg

SEQ ID NO: 974646 - DNA, 25 bp, Mus musculus
tgaacgaatggaccaatgacactgg

SEQ ID NO: 974647 - DNA, 25 bp, Mus musculus
tgaacgactggagcccacgagacat

SEQ ID NO: 974648 - DNA, 25 bp, Mus musculus
tgaacgactggagcgcacgagacat

SEQ ID NO: 974649 - DNA, 25 bp, Mus musculus
tgaacgcctcagagactccatctcc

SEQ ID NO: 974650 - DNA, 25 bp, Mus musculus
tgaacgcctcagtgactccatctcc

SEQ ID NO: 974651 - DNA, 25 bp, Mus musculus
tgaacggacttgatcctgagcccct

SEQ ID NO: 974652 - DNA, 25 bp, Mus musculus
tgaacggacttgatgctgagcccct

SEQ ID NO: 974653 - DNA, 25 bp, Mus musculus
tgaacggatccctgcgctcgggcga

SEQ ID NO: 974654 - DNA, 25 bp, Mus musculus
tgaacggatccctgggctcgggcga

SEQ ID NO: 974655 - DNA, 25 bp, Mus musculus
tgaacggcatcacgcgcagatagat

SEQ ID NO: 974656 - DNA, 25 bp, Mus musculus
tgaacggcatcaggcgcagatagat

SEQ ID NO: 974657 - DNA, 25 bp, Mus musculus
tgaacggcctgagacgctggtttcc

SEQ ID NO: 974658 - DNA, 25 bp, Mus musculus
tgaacggcctgagaggctggtttcc

SEQ ID NO: 974659 - DNA, 25 bp, Mus musculus
tgaacggtgcagatgtcgacgattt

SEQ ID NO: 974660 - DNA, 25 bp, Mus musculus
tgaacggtgcagttgtcgacgattt

SEQ ID NO: 974661 - DNA, 25 bp, Mus musculus
tgaacgtcacagccatatatcgagc

SEQ ID NO: 974662 - DNA, 25 bp, Mus musculus
tgaacgtcacaggcatatatcgagc

SEQ ID NO: 974663 - DNA, 25 bp, Mus musculus
tgaactagcaagcttgcagggcttg

SEQ ID NO: 974664 - DNA, 25 bp, Mus musculus
tgaactagcaaggttgcagggcttg

SEQ ID NO: 974665 - DNA, 25 bp, Mus musculus
tgaactcaatcgcgacaaacctgac

SEQ ID NO: 974666 - DNA, 25 bp, Mus musculus
tgaactcaatcgggacaaacctgac

SEQ ID NO: 974667 - DNA, 25 bp, Mus musculus
tgaactcaggaaaacgttggatgtc

SEQ ID NO: 974668 - DNA, 25 bp, Mus musculus
tgaactcaggaaaaggttggatgtc

SEQ ID NO: 974669 - DNA, 25 bp, Mus musculus
tgaactccagccaagtcgttgggaa

SEQ ID NO: 974670 - DNA, 25 bp, Mus musculus
tgaactccaggcaagtcgttgggaa

SEQ ID NO: 974671 - DNA, 25 bp, Mus musculus
tgaactccgaagaggactatcccaa

SEQ ID NO: 974672 - DNA, 25 bp, Mus musculus
tgaactccgaagtggactatcccaa

SEQ ID NO: 974673 - DNA, 25 bp, Mus musculus
tgaactgaaacaggcaccgctcctc

SEQ ID NO: 974674 - DNA, 25 bp, Mus musculus
tgaactgaaaccaccgctcctctga

SEQ ID NO: 974675 - DNA, 25 bp, Mus musculus
tgaactgaaagaggcaccgctcctc

SEQ ID NO: 974676 - DNA, 25 bp, Mus musculus
tgaactgaaagcaccgctcctctga

SEQ ID NO: 974677 - DNA, 25 bp, Mus musculus
tgaactgcattgagatgggcgggaa

SEQ ID NO: 974678 - DNA, 25 bp, Mus musculus
tgaactgcattgtgatgggcgggaa

SEQ ID NO: 974679 - DNA, 25 bp, Mus musculus
tgaactgcgcagcttacatccaggc

SEQ ID NO: 974680 - DNA, 25 bp, Mus musculus
tgaactgcgcaggttacatccaggc

SEQ ID NO: 974681 - DNA, 25 bp, Mus musculus
tgaactgtgtgtatatccccaaagt

SEQ ID NO: 974682 - DNA, 25 bp, Mus musculus
tgaactgtgtgtttatccccaaagt

SEQ ID NO: 974683 - DNA, 25 bp, Mus musculus
tgaactgttcagacgcctccttggc

SEQ ID NO: 974684 - DNA, 25 bp, Mus musculus
tgaactgttcagtcgcctccttggc

SEQ ID NO: 974685 - DNA, 25 bp, Mus musculus
tgaactgttgccccttgattgtgat

SEQ ID NO: 974686 - DNA, 25 bp, Mus musculus
tgaactgttggcccttgattgtgat

SEQ ID NO: 974687 - DNA, 25 bp, Mus musculus
tgaacttcacttgtcgtggatccaa

SEQ ID NO: 974688 - DNA, 25 bp, Mus musculus
tgaacttcacttgtggtggatccaa

SEQ ID NO: 974689 - DNA, 25 bp, Mus musculus
tgaacttctcaagactgtgaatgac

SEQ ID NO: 974690 - DNA, 25 bp, Mus musculus
tgaacttctcaagagtgtgaatgac

SEQ ID NO: 974691 - DNA, 25 bp, Mus musculus
tgaacttctgcctaccatcaacgat

SEQ ID NO: 974692 - DNA, 25 bp, Mus musculus
tgaacttctgcctacgtatgtctat

SEQ ID NO: 974693 - DNA, 25 bp, Mus musculus
tgaacttctgcctacgtcctcaact

SEQ ID NO: 974694 - DNA, 25 bp, Mus musculus
tgaacttctgcctagcatcaacgat

SEQ ID NO: 974695 - DNA, 25 bp, Mus musculus
tgaacttctgcctaggtatgtctat

SEQ ID NO: 974696 - DNA, 25 bp, Mus musculus
tgaacttctgcctaggtcctcaact

SEQ ID NO: 974697 - DNA, 25 bp, Mus musculus
tgaagaaaaaagatcctgtgacatg

SEQ ID NO: 974698 - DNA, 25 bp, Mus musculus
tgaagaaaaaagttcctgtgacatg

SEQ ID NO: 974699 - DNA, 25 bp, Mus musculus
tgaagaaaagaactctcaaaaagaa

SEQ ID NO: 974700 - DNA, 25 bp, Mus musculus
tgaagaaaagattcaggccgcagtg

SEQ ID NO: 974701 - DNA, 25 bp, Mus musculus
tgaagaaaagcatggatcatgcagg

SEQ ID NO: 974702 - DNA, 25 bp, Mus musculus
tgaagaaaagcccttggcaattaaa

SEQ ID NO: 974703 - DNA, 25 bp, Mus musculus
tgaagaaaagcctaaagatcgcatt

SEQ ID NO: 974704 - DNA, 25 bp, Mus musculus
tgaagaaaaggatggatcatgcagg

SEQ ID NO: 974705 - DNA, 25 bp, Mus musculus
tgaagaaaaggccttggcaattaaa

SEQ ID NO: 974706 - DNA, 25 bp, Mus musculus
tgaagaaaaggctaaagatcgcatt

SEQ ID NO: 974707 - DNA, 25 bp, Mus musculus
tgaagaaaagtactctcaaaaagaa

SEQ ID NO: 974708 - DNA, 25 bp, Mus musculus
tgaagaaaagtttcaggccgcagtg

SEQ ID NO: 974709 - DNA, 25 bp, Mus musculus
tgaagaaactgcaacggaaagacca

SEQ ID NO: 974710 - DNA, 25 bp, Mus musculus
tgaagaaactgcaagggaaagacca

SEQ ID NO: 974711 - DNA, 25 bp, Mus musculus
tgaagaaagcggaacctctggaagc

SEQ ID NO: 974712 - DNA, 25 bp, Mus musculus
tgaagaaagcggaagctctggaagc

SEQ ID NO: 974713 - DNA, 25 bp, Mus musculus
tgaagaaagtatcacattctggcac

SEQ ID NO: 974714 - DNA, 25 bp, Mus musculus
tgaagaaagtatcagattctggcac

SEQ ID NO: 974715 - DNA, 25 bp, Mus musculus
tgaagaaatgaacagagctaaagaa

SEQ ID NO: 974716 - DNA, 25 bp, Mus musculus
tgaagaaatgaagagagctaaagaa

SEQ ID NO: 974717 - DNA, 25 bp, Mus musculus
tgaagaaatgcagcgccttatggat

SEQ ID NO: 974718 - DNA, 25 bp, Mus musculus
tgaagaaatggagcgccttatggat

SEQ ID NO: 974719 - DNA, 25 bp, Mus musculus
tgaagaacagagcctttttagtaca

SEQ ID NO: 974720 - DNA, 25 bp, Mus musculus
tgaagaacagtgcctttttagtaca

SEQ ID NO: 974721 - DNA, 25 bp, Mus musculus
tgaagaacccagcacgttccatcac

SEQ ID NO: 974722 - DNA, 25 bp, Mus musculus
tgaagaacccagcaggttccatcac

SEQ ID NO: 974723 - DNA, 25 bp, Mus musculus
tgaagaacggactgttatgttctga

SEQ ID NO: 974724 - DNA, 25 bp, Mus musculus
tgaagaacggctatggctttgtgga

SEQ ID NO: 974725 - DNA, 25 bp, Mus musculus
tgaagaacgggtatggctttgtgga

SEQ ID NO: 974726 - DNA, 25 bp, Mus musculus
tgaagaacggtctgttatgttctga

SEQ ID NO: 974727 - DNA, 25 bp, Mus musculus
tgaagaactggacgttgtcgaggcc

SEQ ID NO: 974728 - DNA, 25 bp, Mus musculus
tgaagaactggaggttgtcgaggcc

SEQ ID NO: 974729 - DNA, 25 bp, Mus musculus
tgaagaactggcaacgtctggcctg

SEQ ID NO: 974730 - DNA, 25 bp, Mus musculus
tgaagaactggcaaggtctggcctg

SEQ ID NO: 974731 - DNA, 25 bp, Mus musculus
tgaagaacttctcgaaaatctcagt

SEQ ID NO: 974732 - DNA, 25 bp, Mus musculus
tgaagaacttctggaaaatctcagt

SEQ ID NO: 974733 - DNA, 25 bp, Mus musculus
tgaagaagaatgcacgtgggagagg

SEQ ID NO: 974734 - DNA, 25 bp, Mus musculus
tgaagaagaatgcaggtgggagagg

SEQ ID NO: 974735 - DNA, 25 bp, Mus musculus
tgaagaagatcacaaaatatttcta

SEQ ID NO: 974736 - DNA, 25 bp, Mus musculus
tgaagaagatcagaaaatatttcta

SEQ ID NO: 974737 - DNA, 25 bp, Mus musculus
tgaagaagtgggctgccgccatgct

SEQ ID NO: 974738 - DNA, 25 bp, Mus musculus
tgaagaagtggggtgccgccatgct

SEQ ID NO: 974739 - DNA, 25 bp, Mus musculus
tgaagaatgctgacatgtgcattgc

SEQ ID NO: 974740 - DNA, 25 bp, Mus musculus
tgaagaatgctgacttgtgcattgc

SEQ ID NO: 974741 - DNA, 25 bp, Mus musculus
tgaagaattaaacgagattgatgtg

SEQ ID NO: 974742 - DNA, 25 bp, Mus musculus
tgaagaattaaaggagattgatgtg

SEQ ID NO: 974743 - DNA, 25 bp, Mus musculus
tgaagacaggagtcttttattcaaa

SEQ ID NO: 974744 - DNA, 25 bp, Mus musculus
tgaagacaggtgtcttttattcaaa

SEQ ID NO: 974745 - DNA, 25 bp, Mus musculus
tgaagaccccggctcttgttgcagc

SEQ ID NO: 974746 - DNA, 25 bp, Mus musculus
tgaagaccccgggtcttgttgcagc

SEQ ID NO: 974747 - DNA, 25 bp, Mus musculus
tgaagacgatgtctatttttgggtt

SEQ ID NO: 974748 - DNA, 25 bp, Mus musculus
tgaagacgatgtgtatttttgggtt

SEQ ID NO: 974749 - DNA, 25 bp, Mus musculus
tgaagacttgactacacacgctgag

SEQ ID NO: 974750 - DNA, 25 bp, Mus musculus
tgaagacttgactagacacgctgag

SEQ ID NO: 974751 - DNA, 25 bp, Mus musculus
tgaagagaacgcagagctcgtttca

SEQ ID NO: 974752 - DNA, 25 bp, Mus musculus
tgaagagaacgctgagctcgtttca

SEQ ID NO: 974753 - DNA, 25 bp, Mus musculus
tgaagagaagcggccggagtacctg

SEQ ID NO: 974754 - DNA, 25 bp, Mus musculus
tgaagagaagcggcgggagtacctg

SEQ ID NO: 974755 - DNA, 25 bp, Mus musculus
tgaagagcagaactttctacaacaa

SEQ ID NO: 974756 - DNA, 25 bp, Mus musculus
tgaagagcagatggcccagtgagcc

SEQ ID NO: 974757 - DNA, 25 bp, Mus musculus
tgaagagcagcagcagaggaaagca

SEQ ID NO: 974758 - DNA, 25 bp, Mus musculus
tgaagagcagctatctcagacgagg

SEQ ID NO: 974759 - DNA, 25 bp, Mus musculus
tgaagagcagcttgcttccataaga

SEQ ID NO: 974760 - DNA, 25 bp, Mus musculus
tgaagagcaggagcagaggaaagca

SEQ ID NO: 974761 - DNA, 25 bp, Mus musculus
tgaagagcaggtatctcagacgagg

SEQ ID NO: 974762 - DNA, 25 bp, Mus musculus
tgaagagcaggttgcttccataaga

SEQ ID NO: 974763 - DNA, 25 bp, Mus musculus
tgaagagcagtactttctacaacaa

SEQ ID NO: 974764 - DNA, 25 bp, Mus musculus
tgaagagcagttggcccagtgagcc

SEQ ID NO: 974765 - DNA, 25 bp, Mus musculus
tgaagagctaagtgaagaccccatt

SEQ ID NO: 974766 - DNA, 25 bp, Mus musculus
tgaagagctagacatatgtgtcaca

SEQ ID NO: 974767 - DNA, 25 bp, Mus musculus
tgaagagctagagatatgtgtcaca

SEQ ID NO: 974768 - DNA, 25 bp, Mus musculus
tgaagagctatgtgaagaccccatt

SEQ ID NO: 974769 - DNA, 25 bp, Mus musculus
tgaagagctgctatatccagagcct

SEQ ID NO: 974770 - DNA, 25 bp, Mus musculus
tgaagagctggtatatccagagcct

SEQ ID NO: 974771 - DNA, 25 bp, Mus musculus
tgaagaggagcacgattttctgcaa

SEQ ID NO: 974772 - DNA, 25 bp, Mus musculus
tgaagaggagcaggattttctgcaa

SEQ ID NO: 974773 - DNA, 25 bp, Mus musculus
tgaagaggagctcccccagaggtgc

SEQ ID NO: 974774 - DNA, 25 bp, Mus musculus
tgaagaggaggtcccccagaggtgc

SEQ ID NO: 974775 - DNA, 25 bp, Mus musculus
tgaagaggcttcctctctttggcac

SEQ ID NO: 974776 - DNA, 25 bp, Mus musculus
tgaagaggcttcctgtctttggcac

SEQ ID NO: 974777 - DNA, 25 bp, Mus musculus
tgaagagggagacgctgaagaaaca

SEQ ID NO: 974778 - DNA, 25 bp, Mus musculus
tgaagagggagaggctgaagaaaca

SEQ ID NO: 974779 - DNA, 25 bp, Mus musculus
tgaagaggggttaactgactgtgaa

SEQ ID NO: 974780 - DNA, 25 bp, Mus musculus
tgaagaggggttaagtgactgtgaa

SEQ ID NO: 974781 - DNA, 25 bp, Mus musculus
tgaagataagctcaagtccttgctg

SEQ ID NO: 974782 - DNA, 25 bp, Mus musculus
tgaagataaggtcaagtccttgctg

SEQ ID NO: 974783 - DNA, 25 bp, Mus musculus
tgaagatatgctaaccgagatccgc

SEQ ID NO: 974784 - DNA, 25 bp, Mus musculus
tgaagatatggtaaccgagatccgc

SEQ ID NO: 974785 - DNA, 25 bp, Mus musculus
tgaagatcaaaacaatcctcgcaag

SEQ ID NO: 974786 - DNA, 25 bp, Mus musculus
tgaagatcaaaagaatcctcgcaag

SEQ ID NO: 974787 - DNA, 25 bp, Mus musculus
tgaagatcaccacgtgtgtggagat

SEQ ID NO: 974788 - DNA, 25 bp, Mus musculus
tgaagatcaccaggtgtgtggagat

SEQ ID NO: 974789 - DNA, 25 bp, Mus musculus
tgaagatcagagcaaacatccacat

SEQ ID NO: 974790 - DNA, 25 bp, Mus musculus
tgaagatcagaggaaacatccacat

SEQ ID NO: 974791 - DNA, 25 bp, Mus musculus
tgaagatcctggcggcagtgtatgg

SEQ ID NO: 974792 - DNA, 25 bp, Mus musculus
tgaagatcctgggggcagtgtatgg

SEQ ID NO: 974793 - DNA, 25 bp, Mus musculus
tgaagatctctacacaggaaggcat

SEQ ID NO: 974794 - DNA, 25 bp, Mus musculus
tgaagatctctacagaggaaggcat

SEQ ID NO: 974795 - DNA, 25 bp, Mus musculus
tgaagatgaagaagttttcacgaag

SEQ ID NO: 974796 - DNA, 25 bp, Mus musculus
tgaagatgaagatgttttcacgaag

SEQ ID NO: 974797 - DNA, 25 bp, Mus musculus
tgaagatgatgaaacccctctctat

SEQ ID NO: 974798 - DNA, 25 bp, Mus musculus
tgaagatgatgaaagccctctctat

SEQ ID NO: 974799 - DNA, 25 bp, Mus musculus
tgaagatgccgtcgtggaatgtaac

SEQ ID NO: 974800 - DNA, 25 bp, Mus musculus
tgaagatgccgtggtggaatgtaac

SEQ ID NO: 974801 - DNA, 25 bp, Mus musculus
tgaagatgctgaaacacaatgcctc

SEQ ID NO: 974802 - DNA, 25 bp, Mus musculus
tgaagatgctgaaacatgatgcgac

SEQ ID NO: 974803 - DNA, 25 bp, Mus musculus
tgaagatgctgaaagacaatgcctc

SEQ ID NO: 974804 - DNA, 25 bp, Mus musculus
tgaagatgctgaaagatgatgcgac

SEQ ID NO: 974805 - DNA, 25 bp, Mus musculus
tgaagatgttgaaacatgatgccac

SEQ ID NO: 974806 - DNA, 25 bp, Mus musculus
tgaagatgttgaaagatgatgccac

SEQ ID NO: 974807 - DNA, 25 bp, Mus musculus
tgaagatgttgaagaccgacgcaac

SEQ ID NO: 974808 - DNA, 25 bp, Mus musculus
tgaagatgttgaagtccgacgcaac

SEQ ID NO: 974809 - DNA, 25 bp, Mus musculus
tgaagcaaagcagttggaattttca

SEQ ID NO: 974810 - DNA, 25 bp, Mus musculus
tgaagcaaagctgaatcttctgtat

SEQ ID NO: 974811 - DNA, 25 bp, Mus musculus
tgaagcaaaggagttggaattttca

SEQ ID NO: 974812 - DNA, 25 bp, Mus musculus
tgaagcaaaggtgaatcttctgtat

SEQ ID NO: 974813 - DNA, 25 bp, Mus musculus
tgaagcaaataaaaggaaacagaag

SEQ ID NO: 974814 - DNA, 25 bp, Mus musculus
tgaagcaaataataggaaacagaag

SEQ ID NO: 974815 - DNA, 25 bp, Mus musculus
tgaagcacttcgcatggttcgagtg

SEQ ID NO: 974816 - DNA, 25 bp, Mus musculus
tgaagcacttcggatggttcgagtg

SEQ ID NO: 974817 - DNA, 25 bp, Mus musculus
tgaagcagaaatatctggaatacaa

SEQ ID NO: 974818 - DNA, 25 bp, Mus musculus
tgaagcagaattatctggaatacaa

SEQ ID NO: 974819 - DNA, 25 bp, Mus musculus
tgaagcagacagcatgacggacggt

SEQ ID NO: 974820 - DNA, 25 bp, Mus musculus
tgaagcagacaggatgacggacggt

SEQ ID NO: 974821 - DNA, 25 bp, Mus musculus
tgaagcagatgaagatcatccatga

SEQ ID NO: 974822 - DNA, 25 bp, Mus musculus
tgaagcagatgatgatcatccatga

SEQ ID NO: 974823 - DNA, 25 bp, Mus musculus
tgaagcagattgcacaggaggattt

SEQ ID NO: 974824 - DNA, 25 bp, Mus musculus
tgaagcagattgcacgaggatttct

SEQ ID NO: 974825 - DNA, 25 bp, Mus musculus
tgaagcagattgcagaggaggattt

SEQ ID NO: 974826 - DNA, 25 bp, Mus musculus
tgaagcagattgcaggaggatttct

SEQ ID NO: 974827 - DNA, 25 bp, Mus musculus
tgaagcagccagccaatttgtaaaa

SEQ ID NO: 974828 - DNA, 25 bp, Mus musculus
tgaagcagccaggcaatttgtaaaa

SEQ ID NO: 974829 - DNA, 25 bp, Mus musculus
tgaagcatgcggatccccggatcca

SEQ ID NO: 974830 - DNA, 25 bp, Mus musculus
tgaagcatgcggattctgatgtctg

SEQ ID NO: 974831 - DNA, 25 bp, Mus musculus
tgaagcatgcggttccccggatcca

SEQ ID NO: 974832 - DNA, 25 bp, Mus musculus
tgaagcatgcggtttctgatgtctg

SEQ ID NO: 974833 - DNA, 25 bp, Mus musculus
tgaagccaaatccacgttctagcac

SEQ ID NO: 974834 - DNA, 25 bp, Mus musculus
tgaagccaaatccaggttctagcac

SEQ ID NO: 974835 - DNA, 25 bp, Mus musculus
tgaagccaagattgtaagggccaag

SEQ ID NO: 974836 - DNA, 25 bp, Mus musculus
tgaagccaagtttgtaagggccaag

SEQ ID NO: 974837 - DNA, 25 bp, Mus musculus
tgaagccaccaacacccatctgaag

SEQ ID NO: 974838 - DNA, 25 bp, Mus musculus
tgaagccaccaagacccatctgaag

SEQ ID NO: 974839 - DNA, 25 bp, Mus musculus
tgaagccacgatgtgggacctaaga

SEQ ID NO: 974840 - DNA, 25 bp, Mus musculus
tgaagccacgcttgcctctccacct

SEQ ID NO: 974841 - DNA, 25 bp, Mus musculus
tgaagccacggttgcctctccacct

SEQ ID NO: 974842 - DNA, 25 bp, Mus musculus
tgaagccacgttgtgggacctaaga

SEQ ID NO: 974843 - DNA, 25 bp, Mus musculus
tgaagccagctaaacgtatgctaac

SEQ ID NO: 974844 - DNA, 25 bp, Mus musculus
tgaagccagctaaaggtatgctaac

SEQ ID NO: 974845 - DNA, 25 bp, Mus musculus
tgaagcccagaacccctacccatgt

SEQ ID NO: 974846 - DNA, 25 bp, Mus musculus
tgaagcccagaacctgtgattggac

SEQ ID NO: 974847 - DNA, 25 bp, Mus musculus
tgaagcccagaagccctacccatgt

SEQ ID NO: 974848 - DNA, 25 bp, Mus musculus
tgaagcccagaagctgtgattggac

SEQ ID NO: 974849 - DNA, 25 bp, Mus musculus
tgaagcccagcacatttggcctggc

SEQ ID NO: 974850 - DNA, 25 bp, Mus musculus
tgaagcccagcacgccagtgtgctt

SEQ ID NO: 974851 - DNA, 25 bp, Mus musculus
tgaagcccagcagatttggcctggc

SEQ ID NO: 974852 - DNA, 25 bp, Mus musculus
tgaagcccagcaggccagtgtgctt

SEQ ID NO: 974853 - DNA, 25 bp, Mus musculus
tgaagcccgcaaaacctccctccaa

SEQ ID NO: 974854 - DNA, 25 bp, Mus musculus
tgaagcccgcaaaagctccctccaa

SEQ ID NO: 974855 - DNA, 25 bp, Mus musculus
tgaagccctggctgcgggatgggct

SEQ ID NO: 974856 - DNA, 25 bp, Mus musculus
tgaagccctggctgggggatgggct

SEQ ID NO: 974857 - DNA, 25 bp, Mus musculus
tgaagccgtggctacgggatggcct

SEQ ID NO: 974858 - DNA, 25 bp, Mus musculus
tgaagccgtggctaggggatggcct

SEQ ID NO: 974859 - DNA, 25 bp, Mus musculus
tgaagcctcaagcgcgccctgagcc

SEQ ID NO: 974860 - DNA, 25 bp, Mus musculus
tgaagcctcaagggcgccctgagcc

SEQ ID NO: 974861 - DNA, 25 bp, Mus musculus
tgaagcctgaagctctccaccagct

SEQ ID NO: 974862 - DNA, 25 bp, Mus musculus
tgaagcctgaaggtctccaccagct

SEQ ID NO: 974863 - DNA, 25 bp, Mus musculus
tgaagcctgctgctcctacagtgga

SEQ ID NO: 974864 - DNA, 25 bp, Mus musculus
tgaagcctgctggtcctacagtgga

SEQ ID NO: 974865 - DNA, 25 bp, Mus musculus
tgaagcctggggatcgtgtgacccc

SEQ ID NO: 974866 - DNA, 25 bp, Mus musculus
tgaagcctggggatggtgtgacccc

SEQ ID NO: 974867 - DNA, 25 bp, Mus musculus
tgaagcctgtgtcagcggagccttt

SEQ ID NO: 974868 - DNA, 25 bp, Mus musculus
tgaagcctgtgtctgcagcggagcc

SEQ ID NO: 974869 - DNA, 25 bp, Mus musculus
tgaagcctgtgtgagcggagccttt

SEQ ID NO: 974870 - DNA, 25 bp, Mus musculus
tgaagcctgtgtgtgcagcggagcc

SEQ ID NO: 974871 - DNA, 25 bp, Mus musculus
tgaagcgaagatgcaacagacagag

SEQ ID NO: 974872 - DNA, 25 bp, Mus musculus
tgaagcgaagcacggatcttgtaaa

SEQ ID NO: 974873 - DNA, 25 bp, Mus musculus
tgaagcgaaggacggatcttgtaaa

SEQ ID NO: 974874 - DNA, 25 bp, Mus musculus
tgaagcgaagttgcaacagacagag

SEQ ID NO: 974875 - DNA, 25 bp, Mus musculus
tgaagcgggaagctgtgcaggagga

SEQ ID NO: 974876 - DNA, 25 bp, Mus musculus
tgaagcgggaaggtgtgcaggagga

SEQ ID NO: 974877 - DNA, 25 bp, Mus musculus
tgaagctacactcatagcctcctct

SEQ ID NO: 974878 - DNA, 25 bp, Mus musculus
tgaagctacactgatagcctcctct

SEQ ID NO: 974879 - DNA, 25 bp, Mus musculus
tgaagctagatgaaagtaaaactac

SEQ ID NO: 974880 - DNA, 25 bp, Mus musculus
tgaagctagatgaatgtaaaactac

SEQ ID NO: 974881 - DNA, 25 bp, Mus musculus
tgaagctcggctatgtgtcccggta

SEQ ID NO: 974882 - DNA, 25 bp, Mus musculus
tgaagctcgggtatgtgtcccggta

SEQ ID NO: 974883 - DNA, 25 bp, Mus musculus
tgaagctcgtgacatttttgatgaa

SEQ ID NO: 974884 - DNA, 25 bp, Mus musculus
tgaagctcgtgagatttttgatgaa

SEQ ID NO: 974885 - DNA, 25 bp, Mus musculus
tgaagctgagcaagatggcattggg

SEQ ID NO: 974886 - DNA, 25 bp, Mus musculus
tgaagctgaggaagatggcattggg

SEQ ID NO: 974887 - DNA, 25 bp, Mus musculus
tgaaggaaagatgccgccaatgcca

SEQ ID NO: 974888 - DNA, 25 bp, Mus musculus
tgaaggaaagttgccgccaatgcca

SEQ ID NO: 974889 - DNA, 25 bp, Mus musculus
tgaaggaagaggcgatatgtggtac

SEQ ID NO: 974890 - DNA, 25 bp, Mus musculus
tgaaggaagaggggatatgtggtac

SEQ ID NO: 974891 - DNA, 25 bp, Mus musculus
tgaaggaatgccatatcaacgaatg

SEQ ID NO: 974892 - DNA, 25 bp, Mus musculus
tgaaggaatgccttatcaacgaatg

SEQ ID NO: 974893 - DNA, 25 bp, Mus musculus
tgaaggacaacaccctctggagatg

SEQ ID NO: 974894 - DNA, 25 bp, Mus musculus
tgaaggacaagaccctctggagatg

SEQ ID NO: 974895 - DNA, 25 bp, Mus musculus
tgaaggactacatcagtccaaacat

SEQ ID NO: 974896 - DNA, 25 bp, Mus musculus
tgaaggactacatctgtccaaacat

SEQ ID NO: 974897 - DNA, 25 bp, Mus musculus
tgaaggagaccacaaggactccatg

SEQ ID NO: 974898 - DNA, 25 bp, Mus musculus
tgaaggagaccagaaggactccatg

SEQ ID NO: 974899 - DNA, 25 bp, Mus musculus
tgaaggagccctcgcctgcctcccc

SEQ ID NO: 974900 - DNA, 25 bp, Mus musculus
tgaaggagccgtcgcctgcctcccc

SEQ ID NO: 974901 - DNA, 25 bp, Mus musculus
tgaaggatcaagccagagatgcttt

SEQ ID NO: 974902 - DNA, 25 bp, Mus musculus
tgaaggatcaaggcagagatgcttt

SEQ ID NO: 974903 - DNA, 25 bp, Mus musculus
tgaaggatgccaccccaaaccaggt

SEQ ID NO: 974904 - DNA, 25 bp, Mus musculus
tgaaggatgccacccctccagggcc

SEQ ID NO: 974905 - DNA, 25 bp, Mus musculus
tgaaggatgccagcccaaaccaggt

SEQ ID NO: 974906 - DNA, 25 bp, Mus musculus
tgaaggatgccagccctccagggcc

SEQ ID NO: 974907 - DNA, 25 bp, Mus musculus
tgaaggcaacagaatgaagggacct

SEQ ID NO: 974908 - DNA, 25 bp, Mus musculus
tgaaggcaacagtatgaagggacct

SEQ ID NO: 974909 - DNA, 25 bp, Mus musculus
tgaaggcaagggaagtgacagtgac

SEQ ID NO: 974910 - DNA, 25 bp, Mus musculus
tgaaggcaagggtagtgacagtgac

SEQ ID NO: 974911 - DNA, 25 bp, Mus musculus
tgaaggccagagcacatgaagtgag

SEQ ID NO: 974912 - DNA, 25 bp, Mus musculus
tgaaggccagagcacgctccttagg

SEQ ID NO: 974913 - DNA, 25 bp, Mus musculus
tgaaggccagagcagatgaagtgag

SEQ ID NO: 974914 - DNA, 25 bp, Mus musculus
tgaaggccagagcaggctccttagg

SEQ ID NO: 974915 - DNA, 25 bp, Mus musculus
tgaaggcgtgaatatgacatctgca

SEQ ID NO: 974916 - DNA, 25 bp, Mus musculus
tgaaggcgtgcgtatgcaatataaa

SEQ ID NO: 974917 - DNA, 25 bp, Mus musculus
tgaaggcgtgggtatgcaatataaa

SEQ ID NO: 974918 - DNA, 25 bp, Mus musculus
tgaaggcgtgtatatgacatctgca

SEQ ID NO: 974919 - DNA, 25 bp, Mus musculus
tgaaggctacaacttggtaatcttc

SEQ ID NO: 974920 - DNA, 25 bp, Mus musculus
tgaaggctacaagttggtaatcttc

SEQ ID NO: 974921 - DNA, 25 bp, Mus musculus
tgaaggctagagccctgacaggttt

SEQ ID NO: 974922 - DNA, 25 bp, Mus musculus
tgaaggctagaggcctgacaggttt

SEQ ID NO: 974923 - DNA, 25 bp, Mus musculus
tgaaggctcgcaacaccaagaagga

SEQ ID NO: 974924 - DNA, 25 bp, Mus musculus
tgaaggctcggaacaccaagaagga

SEQ ID NO: 974925 - DNA, 25 bp, Mus musculus
tgaaggctggcgtacatcgactgtg

SEQ ID NO: 974926 - DNA, 25 bp, Mus musculus
tgaaggctggcgtagatcgactgtg

SEQ ID NO: 974927 - DNA, 25 bp, Mus musculus
tgaaggctggctccctttgcggggc

SEQ ID NO: 974928 - DNA, 25 bp, Mus musculus
tgaaggctggctgcctttgcggggc

SEQ ID NO: 974929 - DNA, 25 bp, Mus musculus
tgaaggctgtaacggcttctttcgg

SEQ ID NO: 974930 - DNA, 25 bp, Mus musculus
tgaaggctgtaagggcttctttcgg

SEQ ID NO: 974931 - DNA, 25 bp, Mus musculus
tgaaggcttttgcacgttttagaag

SEQ ID NO: 974932 - DNA, 25 bp, Mus musculus
tgaaggcttttgcaggttttagaag

SEQ ID NO: 974933 - DNA, 25 bp, Mus musculus
tgaagggcacggcaccagtattcat

SEQ ID NO: 974934 - DNA, 25 bp, Mus musculus
tgaagggcacggcactattcatgat

SEQ ID NO: 974935 - DNA, 25 bp, Mus musculus
tgaagggcacggcagcagtattcat

SEQ ID NO: 974936 - DNA, 25 bp, Mus musculus
tgaagggcacggcagtattcatgat

SEQ ID NO: 974937 - DNA, 25 bp, Mus musculus
tgaagggggtgacgtgggcctgcgc

SEQ ID NO: 974938 - DNA, 25 bp, Mus musculus
tgaagggggtgaggtgggcctgcgc

SEQ ID NO: 974939 - DNA, 25 bp, Mus musculus
tgaagggtgcaaaacgtaccagcaa

SEQ ID NO: 974940 - DNA, 25 bp, Mus musculus
tgaagggtgcaaaaggtaccagcaa

SEQ ID NO: 974941 - DNA, 25 bp, Mus musculus
tgaagggttataccatgatgacctg

SEQ ID NO: 974942 - DNA, 25 bp, Mus musculus
tgaagggttatagcatgatgacctg

SEQ ID NO: 974943 - DNA, 25 bp, Mus musculus
tgaagggtttgacagaatcgcacgt

SEQ ID NO: 974944 - DNA, 25 bp, Mus musculus
tgaagggtttgagagaatcgcacgt

SEQ ID NO: 974945 - DNA, 25 bp, Mus musculus
tgaaggtagaagcacatgtcttccc

SEQ ID NO: 974946 - DNA, 25 bp, Mus musculus
tgaaggtagaaggacatgtcttccc

SEQ ID NO: 974947 - DNA, 25 bp, Mus musculus
tgaaggtcttgcatgtacctgtggt

SEQ ID NO: 974948 - DNA, 25 bp, Mus musculus
tgaaggtcttgcttgtacctgtggt

SEQ ID NO: 974949 - DNA, 25 bp, Mus musculus
tgaaggtgccggatttggcacgtga

SEQ ID NO: 974950 - DNA, 25 bp, Mus musculus
tgaaggtgccggttttggcacgtga

SEQ ID NO: 974951 - DNA, 25 bp, Mus musculus
tgaaggtgtgcttcggacaaaggat

SEQ ID NO: 974952 - DNA, 25 bp, Mus musculus
tgaaggtgtggttcggacaaaggat

SEQ ID NO: 974953 - DNA, 25 bp, Mus musculus
tgaaggttcatcactcccttctcag

SEQ ID NO: 974954 - DNA, 25 bp, Mus musculus
tgaaggttcatctctcccttctcag

SEQ ID NO: 974955 - DNA, 25 bp, Mus musculus
tgaagtacagcctggacattgtgca

SEQ ID NO: 974956 - DNA, 25 bp, Mus musculus
tgaagtacaggctggacattgtgca

SEQ ID NO: 974957 - DNA, 25 bp, Mus musculus
tgaagtagagaccatccatgtggcc

SEQ ID NO: 974958 - DNA, 25 bp, Mus musculus
tgaagtagagctatattcaagagca

SEQ ID NO: 974959 - DNA, 25 bp, Mus musculus
tgaagtagaggtatattcaagagca

SEQ ID NO: 974960 - DNA, 25 bp, Mus musculus
tgaagtagagtccatccatgtggcc

SEQ ID NO: 974961 - DNA, 25 bp, Mus musculus
tgaagtcaacagatttgctcttgcc

SEQ ID NO: 974962 - DNA, 25 bp, Mus musculus
tgaagtcaacagttttgctcttgcc

SEQ ID NO: 974963 - DNA, 25 bp, Mus musculus
tgaagtcacccaacatgctaatcac

SEQ ID NO: 974964 - DNA, 25 bp, Mus musculus
tgaagtcacccatcatgctaatcac

SEQ ID NO: 974965 - DNA, 25 bp, Mus musculus
tgaagtcagaactggaaaacatcaa

SEQ ID NO: 974966 - DNA, 25 bp, Mus musculus
tgaagtcagatctggaaaacatcaa

SEQ ID NO: 974967 - DNA, 25 bp, Mus musculus
tgaagtcattcaattctggaacaag

SEQ ID NO: 974968 - DNA, 25 bp, Mus musculus
tgaagtcattcatttctggaacaag

SEQ ID NO: 974969 - DNA, 25 bp, Mus musculus
tgaagtcccgagcccaaccgcgtag

SEQ ID NO: 974970 - DNA, 25 bp, Mus musculus
tgaagtcccgagcttgagccccaca

SEQ ID NO: 974971 - DNA, 25 bp, Mus musculus
tgaagtcccgaggccaaccgcgtag

SEQ ID NO: 974972 - DNA, 25 bp, Mus musculus
tgaagtcccgaggttgagccccaca

SEQ ID NO: 974973 - DNA, 25 bp, Mus musculus
tgaagtgactgagactggaatgcag

SEQ ID NO: 974974 - DNA, 25 bp, Mus musculus
tgaagtgactgagagtggaatgcag

SEQ ID NO: 974975 - DNA, 25 bp, Mus musculus
tgaagtgcacccccagcgtgcttcc

SEQ ID NO: 974976 - DNA, 25 bp, Mus musculus
tgaagtgcacccccgtgcttccggc

SEQ ID NO: 974977 - DNA, 25 bp, Mus musculus
tgaagtgcacccgcagcgtgcttcc

SEQ ID NO: 974978 - DNA, 25 bp, Mus musculus
tgaagtgcacccgcgtgcttccggc

SEQ ID NO: 974979 - DNA, 25 bp, Mus musculus
tgaagtgctagaatctcttgaaaat

SEQ ID NO: 974980 - DNA, 25 bp, Mus musculus
tgaagtgctagattctcttgaaaat

SEQ ID NO: 974981 - DNA, 25 bp, Mus musculus
tgaagtgctctgctcctcctcctcc

SEQ ID NO: 974982 - DNA, 25 bp, Mus musculus
tgaagtgctctggtcctcctcctcc

SEQ ID NO: 974983 - DNA, 25 bp, Mus musculus
tgaagtgctgcattatggctatgtg

SEQ ID NO: 974984 - DNA, 25 bp, Mus musculus
tgaagtgctggattatggctatgtg

SEQ ID NO: 974985 - DNA, 25 bp, Mus musculus
tgaagtggaactcgtaagcaataac

SEQ ID NO: 974986 - DNA, 25 bp, Mus musculus
tgaagtggaactggtaagcaataac

SEQ ID NO: 974987 - DNA, 25 bp, Mus musculus
tgaagtggagaagcacggccggggc

SEQ ID NO: 974988 - DNA, 25 bp, Mus musculus
tgaagtggaggcccctccgcctcag

SEQ ID NO: 974989 - DNA, 25 bp, Mus musculus
tgaagtggaggcgcctccgcctcag

SEQ ID NO: 974990 - DNA, 25 bp, Mus musculus
tgaagtggagtagcacggccggggc

SEQ ID NO: 974991 - DNA, 25 bp, Mus musculus
tgaagttaaaaactggaatgcagtg

SEQ ID NO: 974992 - DNA, 25 bp, Mus musculus
tgaagttaaaaagtggaatgcagtg

SEQ ID NO: 974993 - DNA, 25 bp, Mus musculus
tgaagttcaacctgtacgatcggag

SEQ ID NO: 974994 - DNA, 25 bp, Mus musculus
tgaagttcaagctgtacgatcggag

SEQ ID NO: 974995 - DNA, 25 bp, Mus musculus
tgaagttcactctacagtcttttat

SEQ ID NO: 974996 - DNA, 25 bp, Mus musculus
tgaagttcactctagagtcttttat

SEQ ID NO: 974997 - DNA, 25 bp, Mus musculus
tgaagttcagcaaggatttggctgg

SEQ ID NO: 974998 - DNA, 25 bp, Mus musculus
tgaagttcagcaattttatggtgat

SEQ ID NO: 974999 - DNA, 25 bp, Mus musculus
tgaagttcaggaaggatttggctgg

SEQ ID NO: 975000 - DNA, 25 bp, Mus musculus
tgaagttcaggaattttatggtgat

SEQ ID NO: 975001 - DNA, 25 bp, Mus musculus
tgaagttctcacagcacatgaaggc

SEQ ID NO: 975002 - DNA, 25 bp, Mus musculus
tgaagttctcacaggacatgaaggc

SEQ ID NO: 975003 - DNA, 25 bp, Mus musculus
tgaagtttgtcgcttccaaccagag

SEQ ID NO: 975004 - DNA, 25 bp, Mus musculus
tgaagtttgtcggttccaaccagag

SEQ ID NO: 975005 - DNA, 25 bp, Mus musculus
tgaataaaacaacacattgttcagc

SEQ ID NO: 975006 - DNA, 25 bp, Mus musculus
tgaataaaacaacagattgttcagc

SEQ ID NO: 975007 - DNA, 25 bp, Mus musculus
tgaataaaagacagctgatcacaga

SEQ ID NO: 975008 - DNA, 25 bp, Mus musculus
tgaataaaagtcagctgatcacaga

SEQ ID NO: 975009 - DNA, 25 bp, Mus musculus
tgaataagcacgctaagcagatcca

SEQ ID NO: 975010 - DNA, 25 bp, Mus musculus
tgaataagcacggtaagcagatcca

SEQ ID NO: 975011 - DNA, 25 bp, Mus musculus
tgaatacaagcgcgagtggaaacca

SEQ ID NO: 975012 - DNA, 25 bp, Mus musculus
tgaatacaagggcgagtggaaacca

SEQ ID NO: 975013 - DNA, 25 bp, Mus musculus
tgaatacacaattgccaacactcct

SEQ ID NO: 975014 - DNA, 25 bp, Mus musculus
tgaatacacatttgccaacactcct

SEQ ID NO: 975015 - DNA, 25 bp, Mus musculus
tgaatacaccaccgacaaagagccc

SEQ ID NO: 975016 - DNA, 25 bp, Mus musculus
tgaatacaccacggacaaagagccc

SEQ ID NO: 975017 - DNA, 25 bp, Mus musculus
tgaatacccctcaataaaactggtg

SEQ ID NO: 975018 - DNA, 25 bp, Mus musculus
tgaatacccctcactggtggtggag

SEQ ID NO: 975019 - DNA, 25 bp, Mus musculus
tgaatacccctctataaaactggtg

SEQ ID NO: 975020 - DNA, 25 bp, Mus musculus
tgaatacccctctctggtggtggag

SEQ ID NO: 975021 - DNA, 25 bp, Mus musculus
tgaatacgtgcacactgatttatgt

SEQ ID NO: 975022 - DNA, 25 bp, Mus musculus
tgaatacgtggacactgatttatgt

SEQ ID NO: 975023 - DNA, 25 bp, Mus musculus
tgaatactaccacgagagcaatggt

SEQ ID NO: 975024 - DNA, 25 bp, Mus musculus
tgaatactaccaggagagcaatggt

SEQ ID NO: 975025 - DNA, 25 bp, Mus musculus
tgaatagttttgccttggatgccat

SEQ ID NO: 975026 - DNA, 25 bp, Mus musculus
tgaatagttttggcttggatgccat

SEQ ID NO: 975027 - DNA, 25 bp, Mus musculus
tgaatatcaaggcgctgagaaagaa

SEQ ID NO: 975028 - DNA, 25 bp, Mus musculus
tgaatatcaaggggctgagaaagaa

SEQ ID NO: 975029 - DNA, 25 bp, Mus musculus
tgaatatgaaaatgaaacattttta

SEQ ID NO: 975030 - DNA, 25 bp, Mus musculus
tgaatatgaatatgaaacattttta

SEQ ID NO: 975031 - DNA, 25 bp, Mus musculus
tgaatatgagatgtgcataatgcgt

SEQ ID NO: 975032 - DNA, 25 bp, Mus musculus
tgaatatgagctgtcagctgtgcct

SEQ ID NO: 975033 - DNA, 25 bp, Mus musculus
tgaatatgaggtgtcagctgtgcct

SEQ ID NO: 975034 - DNA, 25 bp, Mus musculus
tgaatatgagttgtgcataatgcgt

SEQ ID NO: 975035 - DNA, 25 bp, Mus musculus
tgaatcaccggcgacgagtctgcag

SEQ ID NO: 975036 - DNA, 25 bp, Mus musculus
tgaatcaccggcgaggagtctgcag

SEQ ID NO: 975037 - DNA, 25 bp, Mus musculus
tgaatcagaaaacaggtcttgcccc

SEQ ID NO: 975038 - DNA, 25 bp, Mus musculus
tgaatcagaaaacgtcttgcccctc

SEQ ID NO: 975039 - DNA, 25 bp, Mus musculus
tgaatcagaaaagaggtcttgcccc

SEQ ID NO: 975040 - DNA, 25 bp, Mus musculus
tgaatcagaaaaggtcttgcccctc

SEQ ID NO: 975041 - DNA, 25 bp, Mus musculus
tgaatcagagagcctgccatatcct

SEQ ID NO: 975042 - DNA, 25 bp, Mus musculus
tgaatcagagaggctgccatatcct

SEQ ID NO: 975043 - DNA, 25 bp, Mus musculus
tgaatcagcacaacctcatattcag

SEQ ID NO: 975044 - DNA, 25 bp, Mus musculus
tgaatcagcacatcctcatattcag

SEQ ID NO: 975045 - DNA, 25 bp, Mus musculus
tgaatccagaagacattgatcagct

SEQ ID NO: 975046 - DNA, 25 bp, Mus musculus
tgaatccagaagtcattgatcagct

SEQ ID NO: 975047 - DNA, 25 bp, Mus musculus
tgaatccagcagaactggtgaaaca

SEQ ID NO: 975048 - DNA, 25 bp, Mus musculus
tgaatccagcagaagtggtgaaaca

SEQ ID NO: 975049 - DNA, 25 bp, Mus musculus
tgaatcccgaatatgattatttatt

SEQ ID NO: 975050 - DNA, 25 bp, Mus musculus
tgaatcccgaatttgattatttatt

SEQ ID NO: 975051 - DNA, 25 bp, Mus musculus
tgaatcctcttgcttcagacaatga

SEQ ID NO: 975052 - DNA, 25 bp, Mus musculus
tgaatcctcttggttcagacaatga

SEQ ID NO: 975053 - DNA, 25 bp, Mus musculus
tgaatcgaagagaccgagctggtgg

SEQ ID NO: 975054 - DNA, 25 bp, Mus musculus
tgaatcgaagagacggagctggtgg

SEQ ID NO: 975055 - DNA, 25 bp, Mus musculus
tgaatcgccacacagcctacagagt

SEQ ID NO: 975056 - DNA, 25 bp, Mus musculus
tgaatcgccacagagcctacagagt

SEQ ID NO: 975057 - DNA, 25 bp, Mus musculus
tgaatcggatgcatggtttgaagaa

SEQ ID NO: 975058 - DNA, 25 bp, Mus musculus
tgaatcggatgcttggtttgaagaa

SEQ ID NO: 975059 - DNA, 25 bp, Mus musculus
tgaatctctgaaccagttccagcta

SEQ ID NO: 975060 - DNA, 25 bp, Mus musculus
tgaatctctgaacctgttccagcta

SEQ ID NO: 975061 - DNA, 25 bp, Mus musculus
tgaatgaaacaacattttggtatca

SEQ ID NO: 975062 - DNA, 25 bp, Mus musculus
tgaatgaaacaagattttggtatca

SEQ ID NO: 975063 - DNA, 25 bp, Mus musculus
tgaatgaacttgcgggactgcaggc

SEQ ID NO: 975064 - DNA, 25 bp, Mus musculus
tgaatgaacttgggggactgcaggc

SEQ ID NO: 975065 - DNA, 25 bp, Mus musculus
tgaatgagcacaccctggtgatcga

SEQ ID NO: 975066 - DNA, 25 bp, Mus musculus
tgaatgagcacagcctggtgatcga

SEQ ID NO: 975067 - DNA, 25 bp, Mus musculus
tgaatgagccaacgaccagagtgag

SEQ ID NO: 975068 - DNA, 25 bp, Mus musculus
tgaatgagccaaggaccagagtgag

SEQ ID NO: 975069 - DNA, 25 bp, Mus musculus
tgaatgcaagcatcagaccatgaag

SEQ ID NO: 975070 - DNA, 25 bp, Mus musculus
tgaatgcaaggatcagaccatgaag

SEQ ID NO: 975071 - DNA, 25 bp, Mus musculus
tgaatgcaggacagtctccttagtg

SEQ ID NO: 975072 - DNA, 25 bp, Mus musculus
tgaatgcaggactgtctccttagtg

SEQ ID NO: 975073 - DNA, 25 bp, Mus musculus
tgaatgccttctcacgtgtcatgat

SEQ ID NO: 975074 - DNA, 25 bp, Mus musculus
tgaatgccttctcaggtgtcatgat

SEQ ID NO: 975075 - DNA, 25 bp, Mus musculus
tgaatgctccagcactcaattactg

SEQ ID NO: 975076 - DNA, 25 bp, Mus musculus
tgaatgctccaggactcaattactg

SEQ ID NO: 975077 - DNA, 25 bp, Mus musculus
tgaatggtcttgcgagtcccaaaga

SEQ ID NO: 975078 - DNA, 25 bp, Mus musculus
tgaatggtcttgggagtcccaaaga

SEQ ID NO: 975079 - DNA, 25 bp, Mus musculus
tgaatgtaacagattgccacactgt

SEQ ID NO: 975080 - DNA, 25 bp, Mus musculus
tgaatgtaacagtttgccacactgt

SEQ ID NO: 975081 - DNA, 25 bp, Mus musculus
tgaatgtcacagatgccatctcatc

SEQ ID NO: 975082 - DNA, 25 bp, Mus musculus
tgaatgtcacagttgccatctcatc

SEQ ID NO: 975083 - DNA, 25 bp, Mus musculus
tgaatgtcagacctgatgtgaacta

SEQ ID NO: 975084 - DNA, 25 bp, Mus musculus
tgaatgtcagcccacgtgctgtgag

SEQ ID NO: 975085 - DNA, 25 bp, Mus musculus
tgaatgtcagcccaggtgctgtgag

SEQ ID NO: 975086 - DNA, 25 bp, Mus musculus
tgaatgtcagtcctgatgtgaacta

SEQ ID NO: 975087 - DNA, 25 bp, Mus musculus
tgaatgtgagctaataaatctgcgc

SEQ ID NO: 975088 - DNA, 25 bp, Mus musculus
tgaatgtgaggtaataaatctgcgc

SEQ ID NO: 975089 - DNA, 25 bp, Mus musculus
tgaatgtttatgagaacactgataa

SEQ ID NO: 975090 - DNA, 25 bp, Mus musculus
tgaatgtttatgtgaacactgataa

SEQ ID NO: 975091 - DNA, 25 bp, Mus musculus
tgaattagatataatgtttaatttg

SEQ ID NO: 975092 - DNA, 25 bp, Mus musculus
tgaattagatttaatgtttaatttg

SEQ ID NO: 975093 - DNA, 25 bp, Mus musculus
tgaattagttcgagatgaccttggg

SEQ ID NO: 975094 - DNA, 25 bp, Mus musculus
tgaattagttcgtgatgaccttggg

SEQ ID NO: 975095 - DNA, 25 bp, Mus musculus
tgaattctactactcggactcgtac

SEQ ID NO: 975096 - DNA, 25 bp, Mus musculus
tgaattctactactgggactcgtac

SEQ ID NO: 975097 - DNA, 25 bp, Mus musculus
tgaattcttgcacacacctttgtcc

SEQ ID NO: 975098 - DNA, 25 bp, Mus musculus
tgaattcttgcacatccgtctacct

SEQ ID NO: 975099 - DNA, 25 bp, Mus musculus
tgaattcttgcagacacctttgtcc

SEQ ID NO: 975100 - DNA, 25 bp, Mus musculus
tgaattcttgcagatccgtctacct

SEQ ID NO: 975101 - DNA, 25 bp, Mus musculus
tgaattggaacgggtatttctctgg

SEQ ID NO: 975102 - DNA, 25 bp, Mus musculus
tgaattggaaggggtatttctctgg

SEQ ID NO: 975103 - DNA, 25 bp, Mus musculus
tgaatttacgctcaccattcttgtc

SEQ ID NO: 975104 - DNA, 25 bp, Mus musculus
tgaatttacgctggctctcccaaaa

SEQ ID NO: 975105 - DNA, 25 bp, Mus musculus
tgaatttacggtcaccattcttgtc

SEQ ID NO: 975106 - DNA, 25 bp, Mus musculus
tgaatttacggtggctctcccaaaa

SEQ ID NO: 975107 - DNA, 25 bp, Mus musculus
tgaatttagccactgtcttgagctg

SEQ ID NO: 975108 - DNA, 25 bp, Mus musculus
tgaatttagccagtgtcttgagctg

SEQ ID NO: 975109 - DNA, 25 bp, Mus musculus
tgaatttcaacgggctgaggcgatg

SEQ ID NO: 975110 - DNA, 25 bp, Mus musculus
tgaatttcaaggggctgaggcgatg

SEQ ID NO: 975111 - DNA, 25 bp, Mus musculus
tgaatttcagagcgccttcagcggc

SEQ ID NO: 975112 - DNA, 25 bp, Mus musculus
tgaatttcagagggccttcagcggc

SEQ ID NO: 975113 - DNA, 25 bp, Mus musculus
tgaatttcagcatgtttgatgtggg

SEQ ID NO: 975114 - DNA, 25 bp, Mus musculus
tgaatttcaggatgtttgatgtggg

SEQ ID NO: 975115 - DNA, 25 bp, Mus musculus
tgaattttagagaacgagttagtac

SEQ ID NO: 975116 - DNA, 25 bp, Mus musculus
tgaattttagagaatggctctgaag

SEQ ID NO: 975117 - DNA, 25 bp, Mus musculus
tgaattttagtgaacgagttagtac

SEQ ID NO: 975118 - DNA, 25 bp, Mus musculus
tgaattttagtgaatggctctgaag

SEQ ID NO: 975119 - DNA, 25 bp, Mus musculus
tgaattttgcaccgactcacctgtt

SEQ ID NO: 975120 - DNA, 25 bp, Mus musculus
tgaattttgcacggactcacctgtt

SEQ ID NO: 975121 - DNA, 25 bp, Mus musculus
tgaatttttcagcccgtttgcttat

SEQ ID NO: 975122 - DNA, 25 bp, Mus musculus
tgaatttttcaggccgtttgcttat

SEQ ID NO: 975123 - DNA, 25 bp, Mus musculus
tgacaaaaacagcttatagagcaca

SEQ ID NO: 975124 - DNA, 25 bp, Mus musculus
tgacaaaaacaggttatagagcaca

SEQ ID NO: 975125 - DNA, 25 bp, Mus musculus
tgacaaagcagacaatgaggaacaa

SEQ ID NO: 975126 - DNA, 25 bp, Mus musculus
tgacaaagcagagaatgaggaacaa

SEQ ID NO: 975127 - DNA, 25 bp, Mus musculus
tgacaaagccagctaccgagtctat

SEQ ID NO: 975128 - DNA, 25 bp, Mus musculus
tgacaaagccaggtaccgagtctat

SEQ ID NO: 975129 - DNA, 25 bp, Mus musculus
tgacaaagttaattccacaaacggc

SEQ ID NO: 975130 - DNA, 25 bp, Mus musculus
tgacaaagtttattccacaaacggc

SEQ ID NO: 975131 - DNA, 25 bp, Mus musculus
tgacaaatgacacccagtcttctgg

SEQ ID NO: 975132 - DNA, 25 bp, Mus musculus
tgacaaatgacagccagtcttctgg

SEQ ID NO: 975133 - DNA, 25 bp, Mus musculus
tgacaacaagaacctctgtgtccag

SEQ ID NO: 975134 - DNA, 25 bp, Mus musculus
tgacaacaagaagctctgtgtccag

SEQ ID NO: 975135 - DNA, 25 bp, Mus musculus
tgacaacaagagcctggccatccct

SEQ ID NO: 975136 - DNA, 25 bp, Mus musculus
tgacaacaagtgcctggccatccct

SEQ ID NO: 975137 - DNA, 25 bp, Mus musculus
tgacaacaccatcacgctgtgggac

SEQ ID NO: 975138 - DNA, 25 bp, Mus musculus
tgacaacaccatcaggctgtgggac

SEQ ID NO: 975139 - DNA, 25 bp, Mus musculus
tgacaacatcagcgcctggctcaca

SEQ ID NO: 975140 - DNA, 25 bp, Mus musculus
tgacaacatcagggcctggctcaca

SEQ ID NO: 975141 - DNA, 25 bp, Mus musculus
tgacaacgatcacgaaatcatcccc

SEQ ID NO: 975142 - DNA, 25 bp, Mus musculus
tgacaacgatcaggaaatcatcccc

SEQ ID NO: 975143 - DNA, 25 bp, Mus musculus
tgacaagaaaaaaatcgctgtagtg

SEQ ID NO: 975144 - DNA, 25 bp, Mus musculus
tgacaagaaaaatatcgctgtagtg

SEQ ID NO: 975145 - DNA, 25 bp, Mus musculus
tgacaagaagatggccctctctttc

SEQ ID NO: 975146 - DNA, 25 bp, Mus musculus
tgacaagaagatggccgtggcaacc

SEQ ID NO: 975147 - DNA, 25 bp, Mus musculus
tgacaagaagatgggcctctctttc

SEQ ID NO: 975148 - DNA, 25 bp, Mus musculus
tgacaagaagatgggcgtggcaacc

SEQ ID NO: 975149 - DNA, 25 bp, Mus musculus
tgacaagcaaatcatcaaacttcaa

SEQ ID NO: 975150 - DNA, 25 bp, Mus musculus
tgacaagcaaatgatcaaacttcaa

SEQ ID NO: 975151 - DNA, 25 bp, Mus musculus
tgacaagctctccacgcacagagtc

SEQ ID NO: 975152 - DNA, 25 bp, Mus musculus
tgacaagctctccaggcacagagtc

SEQ ID NO: 975153 - DNA, 25 bp, Mus musculus
tgacaaggaacacctgcaggcagga

SEQ ID NO: 975154 - DNA, 25 bp, Mus musculus
tgacaaggaacagctgcaggcagga

SEQ ID NO: 975155 - DNA, 25 bp, Mus musculus
tgacaaggcgagcctccagggactg

SEQ ID NO: 975156 - DNA, 25 bp, Mus musculus
tgacaaggcgtgcctccagggactg

SEQ ID NO: 975157 - DNA, 25 bp, Mus musculus
tgacaatatcagcctggtttacaac

SEQ ID NO: 975158 - DNA, 25 bp, Mus musculus
tgacaatatcaggctggtttacaac

SEQ ID NO: 975159 - DNA, 25 bp, Mus musculus
tgacaatatctgccaaaaaggataa

SEQ ID NO: 975160 - DNA, 25 bp, Mus musculus
tgacaatatctggcaaaaaggataa

SEQ ID NO: 975161 - DNA, 25 bp, Mus musculus
tgacaatcaaactggattatggaca

SEQ ID NO: 975162 - DNA, 25 bp, Mus musculus
tgacaatcaatctggattatggaca

SEQ ID NO: 975163 - DNA, 25 bp, Mus musculus
tgacaatcccctctaaggagactca

SEQ ID NO: 975164 - DNA, 25 bp, Mus musculus
tgacaatcccctgtaaggagactca

SEQ ID NO: 975165 - DNA, 25 bp, Mus musculus
tgacaatgtctgcacgtgccatgtt

SEQ ID NO: 975166 - DNA, 25 bp, Mus musculus
tgacaatgtctgcaggtgccatgtt

SEQ ID NO: 975167 - DNA, 25 bp, Mus musculus
tgacaatgtgatgacaaagttccat

SEQ ID NO: 975168 - DNA, 25 bp, Mus musculus
tgacaatgtgatgagaaagttccat

SEQ ID NO: 975169 - DNA, 25 bp, Mus musculus
tgacaattttcacggggtgctgcag

SEQ ID NO: 975170 - DNA, 25 bp, Mus musculus
tgacaattttcagggggtgctgcag

SEQ ID NO: 975171 - DNA, 25 bp, Mus musculus
tgacacaatgctcctaccagaacaa

SEQ ID NO: 975172 - DNA, 25 bp, Mus musculus
tgacacaatggtcctaccagaacaa

SEQ ID NO: 975173 - DNA, 25 bp, Mus musculus
tgacacacctcgcggccctcatggc

SEQ ID NO: 975174 - DNA, 25 bp, Mus musculus
tgacacacctcggggccctcatggc

SEQ ID NO: 975175 - DNA, 25 bp, Mus musculus
tgacacagagcggctggctgtgggc

SEQ ID NO: 975176 - DNA, 25 bp, Mus musculus
tgacacagagctggcggagaacaat

SEQ ID NO: 975177 - DNA, 25 bp, Mus musculus
tgacacagaggggctggctgtgggc

SEQ ID NO: 975178 - DNA, 25 bp, Mus musculus
tgacacagaggtggcggagaacaat

SEQ ID NO: 975179 - DNA, 25 bp, Mus musculus
tgacacagctaacttcacagccatg

SEQ ID NO: 975180 - DNA, 25 bp, Mus musculus
tgacacagctaagttcacagccatg

SEQ ID NO: 975181 - DNA, 25 bp, Mus musculus
tgacacagtggtcccagatacttca

SEQ ID NO: 975182 - DNA, 25 bp, Mus musculus
tgacacagtggtgccagatacttca

SEQ ID NO: 975183 - DNA, 25 bp, Mus musculus
tgacaccaccaacatcccatggttt

SEQ ID NO: 975184 - DNA, 25 bp, Mus musculus
tgacaccaccaagatcccatggttt

SEQ ID NO: 975185 - DNA, 25 bp, Mus musculus
tgacaccagcagacatagactgcca

SEQ ID NO: 975186 - DNA, 25 bp, Mus musculus
tgacaccagcagtcatagactgcca

SEQ ID NO: 975187 - DNA, 25 bp, Mus musculus
tgacaccatcaaccacccaggaggt

SEQ ID NO: 975188 - DNA, 25 bp, Mus musculus
tgacaccatcaacctctgggaaggt

SEQ ID NO: 975189 - DNA, 25 bp, Mus musculus
tgacaccatcaagcacccaggaggt

SEQ ID NO: 975190 - DNA, 25 bp, Mus musculus
tgacaccatcaagctctgggaaggt

SEQ ID NO: 975191 - DNA, 25 bp, Mus musculus
tgacacctgggaagccatggagaaa

SEQ ID NO: 975192 - DNA, 25 bp, Mus musculus
tgacacctgggatgccatggagaaa

SEQ ID NO: 975193 - DNA, 25 bp, Mus musculus
tgacacggagctcctccagcgcctg

SEQ ID NO: 975194 - DNA, 25 bp, Mus musculus
tgacacggaggtcctccagcgcctg

SEQ ID NO: 975195 - DNA, 25 bp, Mus musculus
tgacacggagtgcgagacttcttgg

SEQ ID NO: 975196 - DNA, 25 bp, Mus musculus
tgacacggagtgggagacttcttgg

SEQ ID NO: 975197 - DNA, 25 bp, Mus musculus
tgacactctgagcatcctggccatg

SEQ ID NO: 975198 - DNA, 25 bp, Mus musculus
tgacactctgaggatcctggccatg

SEQ ID NO: 975199 - DNA, 25 bp, Mus musculus
tgacactgagaatgagatggctatc

SEQ ID NO: 975200 - DNA, 25 bp, Mus musculus
tgacactgagtatgagatggctatc

SEQ ID NO: 975201 - DNA, 25 bp, Mus musculus
tgacacttgggacgccatggaggac

SEQ ID NO: 975202 - DNA, 25 bp, Mus musculus
tgacacttgggaggccatggaggac

SEQ ID NO: 975203 - DNA, 25 bp, Mus musculus
tgacagaaaccatacgggattctgg

SEQ ID NO: 975204 - DNA, 25 bp, Mus musculus
tgacagaaaccataggggattctgg

SEQ ID NO: 975205 - DNA, 25 bp, Mus musculus
tgacagactccccactttctcaagg

SEQ ID NO: 975206 - DNA, 25 bp, Mus musculus
tgacagactccccagtttctcaagg

SEQ ID NO: 975207 - DNA, 25 bp, Mus musculus
tgacagataccacttcgattccatg

SEQ ID NO: 975208 - DNA, 25 bp, Mus musculus
tgacagataccagttcgattccatg

SEQ ID NO: 975209 - DNA, 25 bp, Mus musculus
tgacagatacttctctgagtgcaaa

SEQ ID NO: 975210 - DNA, 25 bp, Mus musculus
tgacagatacttctgtgagtgcaaa

SEQ ID NO: 975211 - DNA, 25 bp, Mus musculus
tgacagatttaacagtttgtttcta

SEQ ID NO: 975212 - DNA, 25 bp, Mus musculus
tgacagatttaaccttccttccact

SEQ ID NO: 975213 - DNA, 25 bp, Mus musculus
tgacagatttaagagtttgtttcta

SEQ ID NO: 975214 - DNA, 25 bp, Mus musculus
tgacagatttaagcttccttccact

SEQ ID NO: 975215 - DNA, 25 bp, Mus musculus
tgacagcatcatgaacccagactat

SEQ ID NO: 975216 - DNA, 25 bp, Mus musculus
tgacagcatcatgatcccagactat

SEQ ID NO: 975217 - DNA, 25 bp, Mus musculus
tgacagccagaacaattggctggac

SEQ ID NO: 975218 - DNA, 25 bp, Mus musculus
tgacagccagaacgtagcccctgga

SEQ ID NO: 975219 - DNA, 25 bp, Mus musculus
tgacagccagaagaattggctggac

SEQ ID NO: 975220 - DNA, 25 bp, Mus musculus
tgacagccagaaggtagcccctgga

SEQ ID NO: 975221 - DNA, 25 bp, Mus musculus
tgacagccagttcacgaagacagaa

SEQ ID NO: 975222 - DNA, 25 bp, Mus musculus
tgacagccagttcaggaagacagaa

SEQ ID NO: 975223 - DNA, 25 bp, Mus musculus
tgacagccctgatacacccaactca

SEQ ID NO: 975224 - DNA, 25 bp, Mus musculus
tgacagccctgatagacccaactca

SEQ ID NO: 975225 - DNA, 25 bp, Mus musculus
tgacagcctgtgaatccctggccag

SEQ ID NO: 975226 - DNA, 25 bp, Mus musculus
tgacagcctgtgtatccctggccag

SEQ ID NO: 975227 - DNA, 25 bp, Mus musculus
tgacagccttcacgacagtggtgat

SEQ ID NO: 975228 - DNA, 25 bp, Mus musculus
tgacagccttcaggacagtggtgat

SEQ ID NO: 975229 - DNA, 25 bp, Mus musculus
tgacagctggcatctccatctttcc

SEQ ID NO: 975230 - DNA, 25 bp, Mus musculus
tgacagctgggatctccatctttcc

SEQ ID NO: 975231 - DNA, 25 bp, Mus musculus
tgacaggaggagcacgattttggca

SEQ ID NO: 975232 - DNA, 25 bp, Mus musculus
tgacaggaggagcaggattttggca

SEQ ID NO: 975233 - DNA, 25 bp, Mus musculus
tgacaggattttcgccagccgtatg

SEQ ID NO: 975234 - DNA, 25 bp, Mus musculus
tgacaggattttggccagccgtatg

SEQ ID NO: 975235 - DNA, 25 bp, Mus musculus
tgacaggcacgacctgcaggtcctg

SEQ ID NO: 975236 - DNA, 25 bp, Mus musculus
tgacaggcacgagctgcaggtcctg

SEQ ID NO: 975237 - DNA, 25 bp, Mus musculus
tgacaggcagcccaggagtgtgcct

SEQ ID NO: 975238 - DNA, 25 bp, Mus musculus
tgacaggcaggccaggagtgtgcct

SEQ ID NO: 975239 - DNA, 25 bp, Mus musculus
tgacagtcaattcgccccctcagtt

SEQ ID NO: 975240 - DNA, 25 bp, Mus musculus
tgacagtcaattggccccctcagtt

SEQ ID NO: 975241 - DNA, 25 bp, Mus musculus
tgacagtcgcagataatgagaagga

SEQ ID NO: 975242 - DNA, 25 bp, Mus musculus
tgacagtcgcagttaatgagaagga

SEQ ID NO: 975243 - DNA, 25 bp, Mus musculus
tgacagtgaaaacaatccatcgaag

SEQ ID NO: 975244 - DNA, 25 bp, Mus musculus
tgacagtgaaaagaatccatcgaag

SEQ ID NO: 975245 - DNA, 25 bp, Mus musculus
tgacagtgagcttggtggggccgag

SEQ ID NO: 975246 - DNA, 25 bp, Mus musculus
tgacagtgaggttggtggggccgag

SEQ ID NO: 975247 - DNA, 25 bp, Mus musculus
tgacagttctgccaccgcctgtgag

SEQ ID NO: 975248 - DNA, 25 bp, Mus musculus
tgacagttctgccagcgcctgtgag

SEQ ID NO: 975249 - DNA, 25 bp, Mus musculus
tgacataaagcagattgaagtaaca

SEQ ID NO: 975250 - DNA, 25 bp, Mus musculus
tgacataaaggagattgaagtaaca

SEQ ID NO: 975251 - DNA, 25 bp, Mus musculus
tgacatacgatgaggactaccagga

SEQ ID NO: 975252 - DNA, 25 bp, Mus musculus
tgacatacgatgtggactaccagga

SEQ ID NO: 975253 - DNA, 25 bp, Mus musculus
tgacatactccacaagctgtccggc

SEQ ID NO: 975254 - DNA, 25 bp, Mus musculus
tgacatactccagaagctgtccggc

SEQ ID NO: 975255 - DNA, 25 bp, Mus musculus
tgacatactgggctgagcatgccaa

SEQ ID NO: 975256 - DNA, 25 bp, Mus musculus
tgacatactggggtgagcatgccaa

SEQ ID NO: 975257 - DNA, 25 bp, Mus musculus
tgacatatttacagtgctggtgggg

SEQ ID NO: 975258 - DNA, 25 bp, Mus musculus
tgacatatttactgtgctggtgggg

SEQ ID NO: 975259 - DNA, 25 bp, Mus musculus
tgacatcaagaacggagaagaaatg

SEQ ID NO: 975260 - DNA, 25 bp, Mus musculus
tgacatcaagaaggcgtaccgaaag

SEQ ID NO: 975261 - DNA, 25 bp, Mus musculus
tgacatcaagaagggagaagaaatg

SEQ ID NO: 975262 - DNA, 25 bp, Mus musculus
tgacatcaagaaggggtaccgaaag

SEQ ID NO: 975263 - DNA, 25 bp, Mus musculus
tgacatcaccagccgagaaacctgc

SEQ ID NO: 975264 - DNA, 25 bp, Mus musculus
tgacatcaccaggcgagaaacctgc

SEQ ID NO: 975265 - DNA, 25 bp, Mus musculus
tgacatcatcaccatcatttcccag

SEQ ID NO: 975266 - DNA, 25 bp, Mus musculus
tgacatcatcacgatcatttcccag

SEQ ID NO: 975267 - DNA, 25 bp, Mus musculus
tgacatccagaggctaaaggaagag

SEQ ID NO: 975268 - DNA, 25 bp, Mus musculus
tgacatccagtggctaaaggaagag

SEQ ID NO: 975269 - DNA, 25 bp, Mus musculus
tgacatcctgttctacgtggtgatc

SEQ ID NO: 975270 - DNA, 25 bp, Mus musculus
tgacatcctgttgtacgtggtgatc

SEQ ID NO: 975271 - DNA, 25 bp, Mus musculus
tgacatcgcggacatggtttcaccc

SEQ ID NO: 975272 - DNA, 25 bp, Mus musculus
tgacatcgcggagatggtttcaccc

SEQ ID NO: 975273 - DNA, 25 bp, Mus musculus
tgacatctgtagcatagcccagagg

SEQ ID NO: 975274 - DNA, 25 bp, Mus musculus
tgacatctgtaggatagcccagagg

SEQ ID NO: 975275 - DNA, 25 bp, Mus musculus
tgacatcttcaacccgatctccctg

SEQ ID NO: 975276 - DNA, 25 bp, Mus musculus
tgacatcttcaaccggatctccctg

SEQ ID NO: 975277 - DNA, 25 bp, Mus musculus
tgacatgaagcccccctaggcccag

SEQ ID NO: 975278 - DNA, 25 bp, Mus musculus
tgacatgaaggccccctaggcccag

SEQ ID NO: 975279 - DNA, 25 bp, Mus musculus
tgacatgaatctggattttgatgct

SEQ ID NO: 975280 - DNA, 25 bp, Mus musculus
tgacatgaatgtggattttgatgct

SEQ ID NO: 975281 - DNA, 25 bp, Mus musculus
tgacatgacctctaaataaactgaa

SEQ ID NO: 975282 - DNA, 25 bp, Mus musculus
tgacatgacctctatataaactgaa

SEQ ID NO: 975283 - DNA, 25 bp, Mus musculus
tgacatgagacgcgagatggagcag

SEQ ID NO: 975284 - DNA, 25 bp, Mus musculus
tgacatgagacgggagatggagcag

SEQ ID NO: 975285 - DNA, 25 bp, Mus musculus
tgacatggcaacagaagttggtttc

SEQ ID NO: 975286 - DNA, 25 bp, Mus musculus
tgacatggcagtccccacaccccca

SEQ ID NO: 975287 - DNA, 25 bp, Mus musculus
tgacatggcagtgcccacaccccca

SEQ ID NO: 975288 - DNA, 25 bp, Mus musculus
tgacatggcatcagaagttggtttc

SEQ ID NO: 975289 - DNA, 25 bp, Mus musculus
tgacatgtacaacacaatgaccagt

SEQ ID NO: 975290 - DNA, 25 bp, Mus musculus
tgacatgtacaacagaatgaccagt

SEQ ID NO: 975291 - DNA, 25 bp, Mus musculus
tgacattatttgataatggccagcc

SEQ ID NO: 975292 - DNA, 25 bp, Mus musculus
tgacattatttgttaatggccagcc

SEQ ID NO: 975293 - DNA, 25 bp, Mus musculus
tgacattcaacttcattctggctag

SEQ ID NO: 975294 - DNA, 25 bp, Mus musculus
tgacattcaagttcattctggctag

SEQ ID NO: 975295 - DNA, 25 bp, Mus musculus
tgacattcagagttgaaactgtggg

SEQ ID NO: 975296 - DNA, 25 bp, Mus musculus
tgacattcagctgcagtctttgtca

SEQ ID NO: 975297 - DNA, 25 bp, Mus musculus
tgacattcaggtgcagtctttgtca

SEQ ID NO: 975298 - DNA, 25 bp, Mus musculus
tgacattcagtgttgaaactgtggg

SEQ ID NO: 975299 - DNA, 25 bp, Mus musculus
tgacattcgccccggtctctatggc

SEQ ID NO: 975300 - DNA, 25 bp, Mus musculus
tgacattcgcccgggtctctatggc

SEQ ID NO: 975301 - DNA, 25 bp, Mus musculus
tgacattgagctggataagaaggag

SEQ ID NO: 975302 - DNA, 25 bp, Mus musculus
tgacattgaggtggataagaaggag

SEQ ID NO: 975303 - DNA, 25 bp, Mus musculus
tgacattgtgatcacactgaactca

SEQ ID NO: 975304 - DNA, 25 bp, Mus musculus
tgacattgtgatcagactgaactca

SEQ ID NO: 975305 - DNA, 25 bp, Mus musculus
tgaccaaagaatacattccaccact

SEQ ID NO: 975306 - DNA, 25 bp, Mus musculus
tgaccaaagattacattccaccact

SEQ ID NO: 975307 - DNA, 25 bp, Mus musculus
tgaccaaatggagaaataatcatgt

SEQ ID NO: 975308 - DNA, 25 bp, Mus musculus
tgaccaaatggagatataatcatgt

SEQ ID NO: 975309 - DNA, 25 bp, Mus musculus
tgaccaactctgccttgttatggag

SEQ ID NO: 975310 - DNA, 25 bp, Mus musculus
tgaccaactctggcttgttatggag

SEQ ID NO: 975311 - DNA, 25 bp, Mus musculus
tgaccaagaccacgatggggatggt

SEQ ID NO: 975312 - DNA, 25 bp, Mus musculus
tgaccaagaccaggatggggatggt

SEQ ID NO: 975313 - DNA, 25 bp, Mus musculus
tgaccacacaagccttcctgaatta

SEQ ID NO: 975314 - DNA, 25 bp, Mus musculus
tgaccacacaaggcttcctgaatta

SEQ ID NO: 975315 - DNA, 25 bp, Mus musculus
tgaccacatgaacgtctgctttgga

SEQ ID NO: 975316 - DNA, 25 bp, Mus musculus
tgaccacatgaaggtctgctttgga

SEQ ID NO: 975317 - DNA, 25 bp, Mus musculus
tgaccaccacagagctccgatgtct

SEQ ID NO: 975318 - DNA, 25 bp, Mus musculus
tgaccaccacagtgctccgatgtct

SEQ ID NO: 975319 - DNA, 25 bp, Mus musculus
tgaccaccatgacaacaagtacttg

SEQ ID NO: 975320 - DNA, 25 bp, Mus musculus
tgaccaccatgagaacaagtacttg

SEQ ID NO: 975321 - DNA, 25 bp, Mus musculus
tgaccaccttcgaaactctgatcgt

SEQ ID NO: 975322 - DNA, 25 bp, Mus musculus
tgaccaccttcgaatctctgatcgt

SEQ ID NO: 975323 - DNA, 25 bp, Mus musculus
tgaccagaagcacctggtgaatgag

SEQ ID NO: 975324 - DNA, 25 bp, Mus musculus
tgaccagaagcacggaaaaggctct

SEQ ID NO: 975325 - DNA, 25 bp, Mus musculus
tgaccagaagcagctggtgaatgag

SEQ ID NO: 975326 - DNA, 25 bp, Mus musculus
tgaccagaagcagggaaaaggctct

SEQ ID NO: 975327 - DNA, 25 bp, Mus musculus
tgaccagctaagctttgcagccagc

SEQ ID NO: 975328 - DNA, 25 bp, Mus musculus
tgaccagctaaggtttgcagccagc

SEQ ID NO: 975329 - DNA, 25 bp, Mus musculus
tgaccagctggcaacgttatgaaaa

SEQ ID NO: 975330 - DNA, 25 bp, Mus musculus
tgaccagctggcaaggttatgaaaa

SEQ ID NO: 975331 - DNA, 25 bp, Mus musculus
tgaccagtctatatatattggggcc

SEQ ID NO: 975332 - DNA, 25 bp, Mus musculus
tgaccagtctccaacatggcggtaa

SEQ ID NO: 975333 - DNA, 25 bp, Mus musculus
tgaccagtctccaagatggcggtaa

SEQ ID NO: 975334 - DNA, 25 bp, Mus musculus
tgaccagtctttatatattggggcc

SEQ ID NO: 975335 - DNA, 25 bp, Mus musculus
tgaccagtgactccaatatgcctga

SEQ ID NO: 975336 - DNA, 25 bp, Mus musculus
tgaccagtgactgcaatatgcctga

SEQ ID NO: 975337 - DNA, 25 bp, Mus musculus
tgaccatcagcggctctccggtcaa

SEQ ID NO: 975338 - DNA, 25 bp, Mus musculus
tgaccatcagctactgcagggttgc

SEQ ID NO: 975339 - DNA, 25 bp, Mus musculus
tgaccatcaggggctctccggtcaa

SEQ ID NO: 975340 - DNA, 25 bp, Mus musculus
tgaccatcaggtactgcagggttgc

SEQ ID NO: 975341 - DNA, 25 bp, Mus musculus
tgaccatgagacgcttgccctggat

SEQ ID NO: 975342 - DNA, 25 bp, Mus musculus
tgaccatgagtcgcttgccctggat

SEQ ID NO: 975343 - DNA, 25 bp, Mus musculus
tgaccatgcgcatccttccattttc

SEQ ID NO: 975344 - DNA, 25 bp, Mus musculus
tgaccatgcggatccttccattttc

SEQ ID NO: 975345 - DNA, 25 bp, Mus musculus
tgaccatgggcaatcacacgtcccc

SEQ ID NO: 975346 - DNA, 25 bp, Mus musculus
tgaccatgggcaatgacacgtcccc

SEQ ID NO: 975347 - DNA, 25 bp, Mus musculus
tgaccattacagcaactcaacagtc

SEQ ID NO: 975348 - DNA, 25 bp, Mus musculus
tgaccattacaggaactcaacagtc

SEQ ID NO: 975349 - DNA, 25 bp, Mus musculus
tgaccattgtcaccaatgcatcctg

SEQ ID NO: 975350 - DNA, 25 bp, Mus musculus
tgaccattgtcagcaatgcatcctg

SEQ ID NO: 975351 - DNA, 25 bp, Mus musculus
tgacccacagaacgagagcgccatc

SEQ ID NO: 975352 - DNA, 25 bp, Mus musculus
tgacccacagaacgtgagcgccatc

SEQ ID NO: 975353 - DNA, 25 bp, Mus musculus
tgacccagacatcttagtgatcggc

SEQ ID NO: 975354 - DNA, 25 bp, Mus musculus
tgacccagacatgttagtgatcggc

SEQ ID NO: 975355 - DNA, 25 bp, Mus musculus
tgacccagagctctttgacccactg

SEQ ID NO: 975356 - DNA, 25 bp, Mus musculus
tgacccagaggtctttgacccactg

SEQ ID NO: 975357 - DNA, 25 bp, Mus musculus
tgacccagctcaaaccaaccagctc

SEQ ID NO: 975358 - DNA, 25 bp, Mus musculus
tgacccagctcaaagcaaccagctc

SEQ ID NO: 975359 - DNA, 25 bp, Mus musculus
tgacccagttagaccctggcaggct

SEQ ID NO: 975360 - DNA, 25 bp, Mus musculus
tgacccagttagtccctggcaggct

SEQ ID NO: 975361 - DNA, 25 bp, Mus musculus
tgacccatggagccagtttggttcc

SEQ ID NO: 975362 - DNA, 25 bp, Mus musculus
tgacccatggtgccagtttggttcc

SEQ ID NO: 975363 - DNA, 25 bp, Mus musculus
tgaccccatgtgcccacagtacacg

SEQ ID NO: 975364 - DNA, 25 bp, Mus musculus
tgaccccatgtggccacagtacacg

SEQ ID NO: 975365 - DNA, 25 bp, Mus musculus
tgacccccgctacactgccttgccc

SEQ ID NO: 975366 - DNA, 25 bp, Mus musculus
tgacccccgctacagtgccttgccc

SEQ ID NO: 975367 - DNA, 25 bp, Mus musculus
tgacccctaccacgagcccaagaga

SEQ ID NO: 975368 - DNA, 25 bp, Mus musculus
tgacccctaccaggagcccaagaga

SEQ ID NO: 975369 - DNA, 25 bp, Mus musculus
tgacccctataagccgtcaccttca

SEQ ID NO: 975370 - DNA, 25 bp, Mus musculus
tgacccctataagcggtcaccttca

SEQ ID NO: 975371 - DNA, 25 bp, Mus musculus
tgacccctgcgacgcggtgctggtg

SEQ ID NO: 975372 - DNA, 25 bp, Mus musculus
tgacccctgcgaggcggtgctggtg

SEQ ID NO: 975373 - DNA, 25 bp, Mus musculus
tgaccccttcttcgcagaatacaaa

SEQ ID NO: 975374 - DNA, 25 bp, Mus musculus
tgaccccttcttcgctgattctttt

SEQ ID NO: 975375 - DNA, 25 bp, Mus musculus
tgaccccttcttcggagaatacaaa

SEQ ID NO: 975376 - DNA, 25 bp, Mus musculus
tgaccccttcttcggtgattctttt

SEQ ID NO: 975377 - DNA, 25 bp, Mus musculus
tgaccctcagatagtgtttctagaa

SEQ ID NO: 975378 - DNA, 25 bp, Mus musculus
tgaccctcagttagtgtttctagaa

SEQ ID NO: 975379 - DNA, 25 bp, Mus musculus
tgaccctcctggagcaactggtgat

SEQ ID NO: 975380 - DNA, 25 bp, Mus musculus
tgaccctcctggtgcaactggtgat

SEQ ID NO: 975381 - DNA, 25 bp, Mus musculus
tgaccctctgaaacagtgccgatcc

SEQ ID NO: 975382 - DNA, 25 bp, Mus musculus
tgaccctctgaaactgtgccgatcc

SEQ ID NO: 975383 - DNA, 25 bp, Mus musculus
tgaccctgccttctgatgacactcc

SEQ ID NO: 975384 - DNA, 25 bp, Mus musculus
tgaccctgccttgtgatgacactcc

SEQ ID NO: 975385 - DNA, 25 bp, Mus musculus
tgaccctggagtaacctaccgcact

SEQ ID NO: 975386 - DNA, 25 bp, Mus musculus
tgaccctggagtaagctaccgcact

SEQ ID NO: 975387 - DNA, 25 bp, Mus musculus
tgacccttcgcttgatgttcttaaa

SEQ ID NO: 975388 - DNA, 25 bp, Mus musculus
tgacccttcggttgatgttcttaaa

SEQ ID NO: 975389 - DNA, 25 bp, Mus musculus
tgacccttggcacacagggtccctt

SEQ ID NO: 975390 - DNA, 25 bp, Mus musculus
tgacccttggcagacagggtccctt

SEQ ID NO: 975391 - DNA, 25 bp, Mus musculus
tgaccgaaagcacagccatcttgat

SEQ ID NO: 975392 - DNA, 25 bp, Mus musculus
tgaccgaaaggacagccatcttgat

SEQ ID NO: 975393 - DNA, 25 bp, Mus musculus
tgaccggcagcgtgatgctgagttc

SEQ ID NO: 975394 - DNA, 25 bp, Mus musculus
tgaccggcagggtgatgctgagttc

SEQ ID NO: 975395 - DNA, 25 bp, Mus musculus
tgaccggctgacctccaaatctggt

SEQ ID NO: 975396 - DNA, 25 bp, Mus musculus
tgaccggctgacctcgccctctgtc

SEQ ID NO: 975397 - DNA, 25 bp, Mus musculus
tgaccggctgacctcttgaacactc

SEQ ID NO: 975398 - DNA, 25 bp, Mus musculus
tgaccggctgacctgcaaatctggt

SEQ ID NO: 975399 - DNA, 25 bp, Mus musculus
tgaccggctgacctggccctctgtc

SEQ ID NO: 975400 - DNA, 25 bp, Mus musculus
tgaccggctgacctgttgaacactc

SEQ ID NO: 975401 - DNA, 25 bp, Mus musculus
tgaccgggagaacagagctctggct

SEQ ID NO: 975402 - DNA, 25 bp, Mus musculus
tgaccgggagaacctctggctgcag

SEQ ID NO: 975403 - DNA, 25 bp, Mus musculus
tgaccgggagaacctgagaaagaaa

SEQ ID NO: 975404 - DNA, 25 bp, Mus musculus
tgaccgggagaagagagctctggct

SEQ ID NO: 975405 - DNA, 25 bp, Mus musculus
tgaccgggagaagctctggctgcag

SEQ ID NO: 975406 - DNA, 25 bp, Mus musculus
tgaccgggagtacctgagaaagaaa

SEQ ID NO: 975407 - DNA, 25 bp, Mus musculus
tgaccgtaccaacggatagcccacc

SEQ ID NO: 975408 - DNA, 25 bp, Mus musculus
tgaccgtaccaagggatagcccacc

SEQ ID NO: 975409 - DNA, 25 bp, Mus musculus
tgaccgttctggaacccctggaaga

SEQ ID NO: 975410 - DNA, 25 bp, Mus musculus
tgaccgttctggaagccctggaaga

SEQ ID NO: 975411 - DNA, 25 bp, Mus musculus
tgacctagacagattgaaggataag

SEQ ID NO: 975412 - DNA, 25 bp, Mus musculus
tgacctagacagtttgaaggataag

SEQ ID NO: 975413 - DNA, 25 bp, Mus musculus
tgacctcaagcgctctctagtgtcc

SEQ ID NO: 975414 - DNA, 25 bp, Mus musculus
tgacctcaaggagcagtaggtggcg

SEQ ID NO: 975415 - DNA, 25 bp, Mus musculus
tgacctcaaggagctgtaggtggcg

SEQ ID NO: 975416 - DNA, 25 bp, Mus musculus
tgacctcaagggctctctagtgtcc

SEQ ID NO: 975417 - DNA, 25 bp, Mus musculus
tgacctcacctaaacatactgagcc

SEQ ID NO: 975418 - DNA, 25 bp, Mus musculus
tgacctcacctaaagatactgagcc

SEQ ID NO: 975419 - DNA, 25 bp, Mus musculus
tgacctcagactcacggttgagctc

SEQ ID NO: 975420 - DNA, 25 bp, Mus musculus
tgacctcagactcagggttgagctc

SEQ ID NO: 975421 - DNA, 25 bp, Mus musculus
tgacctcatcacagatctgctaaat

SEQ ID NO: 975422 - DNA, 25 bp, Mus musculus
tgacctcatcactgatctgctaaat

SEQ ID NO: 975423 - DNA, 25 bp, Mus musculus
tgacctccagaaaggtgctggatca

SEQ ID NO: 975424 - DNA, 25 bp, Mus musculus
tgacctccagtaaggtgctggatca

SEQ ID NO: 975425 - DNA, 25 bp, Mus musculus
tgacctcctgcattaccccaagctc

SEQ ID NO: 975426 - DNA, 25 bp, Mus musculus
tgacctcctggattaccccaagctc

SEQ ID NO: 975427 - DNA, 25 bp, Mus musculus
tgacctctatataaactgaagtgca

SEQ ID NO: 975428 - DNA, 25 bp, Mus musculus
tgacctctatttaaactgaagtgca

SEQ ID NO: 975429 - DNA, 25 bp, Mus musculus
tgacctctccatcgcatacagtagc

SEQ ID NO: 975430 - DNA, 25 bp, Mus musculus
tgacctctccatcggatacagtagc

SEQ ID NO: 975431 - DNA, 25 bp, Mus musculus
tgacctgaaaagcaaacctgcagat

SEQ ID NO: 975432 - DNA, 25 bp, Mus musculus
tgacctgaaaaggaaacctgcagat

SEQ ID NO: 975433 - DNA, 25 bp, Mus musculus
tgacctgaagcccgagaacatcatg

SEQ ID NO: 975434 - DNA, 25 bp, Mus musculus
tgacctgaaggccgagaacatcatg

SEQ ID NO: 975435 - DNA, 25 bp, Mus musculus
tgacctgagtcgccagaacgctttc

SEQ ID NO: 975436 - DNA, 25 bp, Mus musculus
tgacctgagtcggcagaacgctttc

SEQ ID NO: 975437 - DNA, 25 bp, Mus musculus
tgacctggccaacaaccgcctctat

SEQ ID NO: 975438 - DNA, 25 bp, Mus musculus
tgacctggccaagaaccgcctctat

SEQ ID NO: 975439 - DNA, 25 bp, Mus musculus
tgacctgtcttcaacgtgccgccat

SEQ ID NO: 975440 - DNA, 25 bp, Mus musculus
tgacctgtcttcaaggtgccgccat

SEQ ID NO: 975441 - DNA, 25 bp, Mus musculus
tgaccttactctcccttttgctcga

SEQ ID NO: 975442 - DNA, 25 bp, Mus musculus
tgaccttactgtcccttttgctcga

SEQ ID NO: 975443 - DNA, 25 bp, Mus musculus
tgaccttcaggaaacgctgcacaag

SEQ ID NO: 975444 - DNA, 25 bp, Mus musculus
tgaccttcaggaaaggctgcacaag

SEQ ID NO: 975445 - DNA, 25 bp, Mus musculus
tgacgaagtgaatcgcatgcacgag

SEQ ID NO: 975446 - DNA, 25 bp, Mus musculus
tgacgaagtgtatcgcatgcacgag

SEQ ID NO: 975447 - DNA, 25 bp, Mus musculus
tgacgacaccaaaacggctcaggat

SEQ ID NO: 975448 - DNA, 25 bp, Mus musculus
tgacgacaccaaaagggctcaggat

SEQ ID NO: 975449 - DNA, 25 bp, Mus musculus
tgacgagacgctaaaggtgctgaag

SEQ ID NO: 975450 - DNA, 25 bp, Mus musculus
tgacgagacggtaaaggtgctgaag

SEQ ID NO: 975451 - DNA, 25 bp, Mus musculus
tgacgagcagcactcggtgcggctg

SEQ ID NO: 975452 - DNA, 25 bp, Mus musculus
tgacgagcaggactcggtgcggctg

SEQ ID NO: 975453 - DNA, 25 bp, Mus musculus
tgacgatgagcctgactttgaactc

SEQ ID NO: 975454 - DNA, 25 bp, Mus musculus
tgacgatgaggctgactttgaactc

SEQ ID NO: 975455 - DNA, 25 bp, Mus musculus
tgacgattacaacgatgtgcagaac

SEQ ID NO: 975456 - DNA, 25 bp, Mus musculus
tgacgattacaaggatgtgcagaac

SEQ ID NO: 975457 - DNA, 25 bp, Mus musculus
tgacgcacagcttctccacaaagtc

SEQ ID NO: 975458 - DNA, 25 bp, Mus musculus
tgacgcacaggttctccacaaagtc

SEQ ID NO: 975459 - DNA, 25 bp, Mus musculus
tgacgcacccttcactacaagccca

SEQ ID NO: 975460 - DNA, 25 bp, Mus musculus
tgacgcacccttcagtacaagccca

SEQ ID NO: 975461 - DNA, 25 bp, Mus musculus
tgacgcagaaccaggctcggctgac

SEQ ID NO: 975462 - DNA, 25 bp, Mus musculus
tgacgcagaacctggctcggctgac

SEQ ID NO: 975463 - DNA, 25 bp, Mus musculus
tgacgccataaacagcaacgggaga

SEQ ID NO: 975464 - DNA, 25 bp, Mus musculus
tgacgccataaagagcaacgggaga

SEQ ID NO: 975465 - DNA, 25 bp, Mus musculus
tgacgcctgagacgtgactctgtcc

SEQ ID NO: 975466 - DNA, 25 bp, Mus musculus
tgacgcctgagaggtgactctgtcc

SEQ ID NO: 975467 - DNA, 25 bp, Mus musculus
tgacgcgcggggaacagtcttgcgc

SEQ ID NO: 975468 - DNA, 25 bp, Mus musculus
tgacgcgcggggaagagtcttgcgc

SEQ ID NO: 975469 - DNA, 25 bp, Mus musculus
tgacgcttttgccacacaagcagtg

SEQ ID NO: 975470 - DNA, 25 bp, Mus musculus
tgacgcttttgccacgtgatggaaa

SEQ ID NO: 975471 - DNA, 25 bp, Mus musculus
tgacgcttttgccagacaagcagtg

SEQ ID NO: 975472 - DNA, 25 bp, Mus musculus
tgacgcttttgccaggtgatggaaa

SEQ ID NO: 975473 - DNA, 25 bp, Mus musculus
tgacggaagattaaagtgtggagac

SEQ ID NO: 975474 - DNA, 25 bp, Mus musculus
tgacggaagattaatgtgtggagac

SEQ ID NO: 975475 - DNA, 25 bp, Mus musculus
tgacggagactccacatgaggacga

SEQ ID NO: 975476 - DNA, 25 bp, Mus musculus
tgacggagactccacgccacaatgg

SEQ ID NO: 975477 - DNA, 25 bp, Mus musculus
tgacggagactccagatgaggacga

SEQ ID NO: 975478 - DNA, 25 bp, Mus musculus
tgacggagactccaggccacaatgg

SEQ ID NO: 975479 - DNA, 25 bp, Mus musculus
tgacggcaccatcgcgtttatgttt

SEQ ID NO: 975480 - DNA, 25 bp, Mus musculus
tgacggcaccatggcgtttatgttt

SEQ ID NO: 975481 - DNA, 25 bp, Mus musculus
tgacggtcagatatatgaaatcttc

SEQ ID NO: 975482 - DNA, 25 bp, Mus musculus
tgacggtcagttatatgaaatcttc

SEQ ID NO: 975483 - DNA, 25 bp, Mus musculus
tgacggtgtgcaagcattcctgacc

SEQ ID NO: 975484 - DNA, 25 bp, Mus musculus
tgacggtgtgcatgcattcctgacc

SEQ ID NO: 975485 - DNA, 25 bp, Mus musculus
tgacgtcaaaagcgtcatcttcaaa

SEQ ID NO: 975486 - DNA, 25 bp, Mus musculus
tgacgtcaaaagggtcatcttcaaa

SEQ ID NO: 975487 - DNA, 25 bp, Mus musculus
tgacgtcagaccacctcgtgctgtg

SEQ ID NO: 975488 - DNA, 25 bp, Mus musculus
tgacgtcagacctcctcgtgctgtg

SEQ ID NO: 975489 - DNA, 25 bp, Mus musculus
tgacgtcatagtacaggattcatcc

SEQ ID NO: 975490 - DNA, 25 bp, Mus musculus
tgacgtcatagttcaggattcatcc

SEQ ID NO: 975491 - DNA, 25 bp, Mus musculus
tgacgtccaccactgaaaatgtgct

SEQ ID NO: 975492 - DNA, 25 bp, Mus musculus
tgacgtccaccagtgaaaatgtgct

SEQ ID NO: 975493 - DNA, 25 bp, Mus musculus
tgacgtgaaaaactatcttggaaga

SEQ ID NO: 975494 - DNA, 25 bp, Mus musculus
tgacgtgaaaaagtatcttggaaga

SEQ ID NO: 975495 - DNA, 25 bp, Mus musculus
tgacgtgcagcctgtgatgtcacac

SEQ ID NO: 975496 - DNA, 25 bp, Mus musculus
tgacgtgcaggctgtgatgtcacac

SEQ ID NO: 975497 - DNA, 25 bp, Mus musculus
tgacgtgtgttgagcagcccaccgc

SEQ ID NO: 975498 - DNA, 25 bp, Mus musculus
tgacgtgtgttgaggagcccaccgc

SEQ ID NO: 975499 - DNA, 25 bp, Mus musculus
tgacgttatgctcaaggaaggatat

SEQ ID NO: 975500 - DNA, 25 bp, Mus musculus
tgacgttatgctcatggaaggatat

SEQ ID NO: 975501 - DNA, 25 bp, Mus musculus
tgacgttcagagcttcatcgtggga

SEQ ID NO: 975502 - DNA, 25 bp, Mus musculus
tgacgttcagaggttcatcgtggga

SEQ ID NO: 975503 - DNA, 25 bp, Mus musculus
tgactaaaagaagtagaaggaggag

SEQ ID NO: 975504 - DNA, 25 bp, Mus musculus
tgactaaaagtagtagaaggaggag

SEQ ID NO: 975505 - DNA, 25 bp, Mus musculus
tgactacatgcccacctggaacatg

SEQ ID NO: 975506 - DNA, 25 bp, Mus musculus
tgactacatggccacctggaacatg

SEQ ID NO: 975507 - DNA, 25 bp, Mus musculus
tgactacattagcttatttgggaat

SEQ ID NO: 975508 - DNA, 25 bp, Mus musculus
tgactacattaggttatttgggaat

SEQ ID NO: 975509 - DNA, 25 bp, Mus musculus
tgactaccagcttatttctgacaga

SEQ ID NO: 975510 - DNA, 25 bp, Mus musculus
tgactaccaggttatttctgacaga

SEQ ID NO: 975511 - DNA, 25 bp, Mus musculus
tgactacctgagcctttttggcacc

SEQ ID NO: 975512 - DNA, 25 bp, Mus musculus
tgactacctgaggctttttggcacc

SEQ ID NO: 975513 - DNA, 25 bp, Mus musculus
tgactactacagcaaacttctgcgc

SEQ ID NO: 975514 - DNA, 25 bp, Mus musculus
tgactactacaggaaacttctgcgc

SEQ ID NO: 975515 - DNA, 25 bp, Mus musculus
tgactactgcagccagcggccccgc

SEQ ID NO: 975516 - DNA, 25 bp, Mus musculus
tgactactgcaggcagcggccccgc

SEQ ID NO: 975517 - DNA, 25 bp, Mus musculus
tgactacttcaacgataaaagagta

SEQ ID NO: 975518 - DNA, 25 bp, Mus musculus
tgactacttcaaggataaaagagta

SEQ ID NO: 975519 - DNA, 25 bp, Mus musculus
tgactatgaacaaataggagacagc

SEQ ID NO: 975520 - DNA, 25 bp, Mus musculus
tgactatgaacatataggagacagc

SEQ ID NO: 975521 - DNA, 25 bp, Mus musculus
tgactattgcaatacaaagtgccag

SEQ ID NO: 975522 - DNA, 25 bp, Mus musculus
tgactattgcaatagaaagtgccag

SEQ ID NO: 975523 - DNA, 25 bp, Mus musculus
tgactcacccaacatctggatcctg

SEQ ID NO: 975524 - DNA, 25 bp, Mus musculus
tgactcacccaagatctggatcctg

SEQ ID NO: 975525 - DNA, 25 bp, Mus musculus
tgactcagccgcttactacctgaat

SEQ ID NO: 975526 - DNA, 25 bp, Mus musculus
tgactcagccgctttctacctgaat

SEQ ID NO: 975527 - DNA, 25 bp, Mus musculus
tgactcattattctcaagtggctga

SEQ ID NO: 975528 - DNA, 25 bp, Mus musculus
tgactcattattctgaagtggctga

SEQ ID NO: 975529 - DNA, 25 bp, Mus musculus
tgactccaaataaacgtgcaatgat

SEQ ID NO: 975530 - DNA, 25 bp, Mus musculus
tgactccaaataaaggtgcaatgat

SEQ ID NO: 975531 - DNA, 25 bp, Mus musculus
tgactccaggagcagcgacagtttt

SEQ ID NO: 975532 - DNA, 25 bp, Mus musculus
tgactccaggagccttccagcttgt

SEQ ID NO: 975533 - DNA, 25 bp, Mus musculus
tgactccaggaggagcgacagtttt

SEQ ID NO: 975534 - DNA, 25 bp, Mus musculus
tgactccaggaggcttccagcttgt

SEQ ID NO: 975535 - DNA, 25 bp, Mus musculus
tgactcccacagaggagaggcgcat

SEQ ID NO: 975536 - DNA, 25 bp, Mus musculus
tgactcccacagtggagaggcgcat

SEQ ID NO: 975537 - DNA, 25 bp, Mus musculus
tgactccccacaagctccctgggga

SEQ ID NO: 975538 - DNA, 25 bp, Mus musculus
tgactccccacatgctccctgggga

SEQ ID NO: 975539 - DNA, 25 bp, Mus musculus
tgactccctcaacaacaaagtcaca

SEQ ID NO: 975540 - DNA, 25 bp, Mus musculus
tgactccctcaacattcaaacagac

SEQ ID NO: 975541 - DNA, 25 bp, Mus musculus
tgactccctcaagaacaaagtcaca

SEQ ID NO: 975542 - DNA, 25 bp, Mus musculus
tgactccctcaagattcaaacagac

SEQ ID NO: 975543 - DNA, 25 bp, Mus musculus
tgactccgccggctactatctctca

SEQ ID NO: 975544 - DNA, 25 bp, Mus musculus
tgactccgccggcttctatctctca

SEQ ID NO: 975545 - DNA, 25 bp, Mus musculus
tgactccttgaacctggctgtcttc

SEQ ID NO: 975546 - DNA, 25 bp, Mus musculus
tgactccttgaagctggctgtcttc

SEQ ID NO: 975547 - DNA, 25 bp, Mus musculus
tgactcctttgccaagctttcactg

SEQ ID NO: 975548 - DNA, 25 bp, Mus musculus
tgactcctttgccatgctttcactg

SEQ ID NO: 975549 - DNA, 25 bp, Mus musculus
tgactcgatgccaccgcatgcgtgg

SEQ ID NO: 975550 - DNA, 25 bp, Mus musculus
tgactcgatggcaccgcatgcgtgg

SEQ ID NO: 975551 - DNA, 25 bp, Mus musculus
tgactcggcatcttactacctgaac

SEQ ID NO: 975552 - DNA, 25 bp, Mus musculus
tgactcggcatctttctacctgaac

SEQ ID NO: 975553 - DNA, 25 bp, Mus musculus
tgactctaagaaaagagaaggcttc

SEQ ID NO: 975554 - DNA, 25 bp, Mus musculus
tgactctaagtaaagagaaggcttc

SEQ ID NO: 975555 - DNA, 25 bp, Mus musculus
tgactctcagattcatgaagtattg

SEQ ID NO: 975556 - DNA, 25 bp, Mus musculus
tgactctcagtttcatgaagtattg

SEQ ID NO: 975557 - DNA, 25 bp, Mus musculus
tgactctgagcccgttggtatttgc

SEQ ID NO: 975558 - DNA, 25 bp, Mus musculus
tgactctgaggccgttggtatttgc

SEQ ID NO: 975559 - DNA, 25 bp, Mus musculus
tgactctgccaaatactacctggac

SEQ ID NO: 975560 - DNA, 25 bp, Mus musculus
tgactctgccaaattctacctggac

SEQ ID NO: 975561 - DNA, 25 bp, Mus musculus
tgactctgtggacaacagggtcctg

SEQ ID NO: 975562 - DNA, 25 bp, Mus musculus
tgactctgtggacaaggtcctgtca

SEQ ID NO: 975563 - DNA, 25 bp, Mus musculus
tgactctgtggacatcagggtcctg

SEQ ID NO: 975564 - DNA, 25 bp, Mus musculus
tgactctgtggacatggtcctgtca

SEQ ID NO: 975565 - DNA, 25 bp, Mus musculus
tgactgaaaaagatccaccaggtga

SEQ ID NO: 975566 - DNA, 25 bp, Mus musculus
tgactgaaaaagttccaccaggtga

SEQ ID NO: 975567 - DNA, 25 bp, Mus musculus
tgactgaaatctacttaaaattctg

SEQ ID NO: 975568 - DNA, 25 bp, Mus musculus
tgactgaaatgtacttaaaattctg

SEQ ID NO: 975569 - DNA, 25 bp, Mus musculus
tgactgacaaagaacgctggattct

SEQ ID NO: 975570 - DNA, 25 bp, Mus musculus
tgactgacaaagaaggctggattct

SEQ ID NO: 975571 - DNA, 25 bp, Mus musculus
tgactgactgtgaacaggctgccct

SEQ ID NO: 975572 - DNA, 25 bp, Mus musculus
tgactgactgtgaagaggctgccct

SEQ ID NO: 975573 - DNA, 25 bp, Mus musculus
tgactgagagaggaatgcagtggcc

SEQ ID NO: 975574 - DNA, 25 bp, Mus musculus
tgactgagagtggaatgcagtggcc

SEQ ID NO: 975575 - DNA, 25 bp, Mus musculus
tgactgcaccccaaccctccatgat

SEQ ID NO: 975576 - DNA, 25 bp, Mus musculus
tgactgcaccccaagcctccatgat

SEQ ID NO: 975577 - DNA, 25 bp, Mus musculus
tgactgcacgcacaaagatgacagg

SEQ ID NO: 975578 - DNA, 25 bp, Mus musculus
tgactgcacgcagaaagatgacagg

SEQ ID NO: 975579 - DNA, 25 bp, Mus musculus
tgactgcatacactcagccctctca

SEQ ID NO: 975580 - DNA, 25 bp, Mus musculus
tgactgcatacactgagccctctca

SEQ ID NO: 975581 - DNA, 25 bp, Mus musculus
tgactgccaacattcatgaataaaa

SEQ ID NO: 975582 - DNA, 25 bp, Mus musculus
tgactgccaagattcatgaataaaa

SEQ ID NO: 975583 - DNA, 25 bp, Mus musculus
tgactgcccgcaccccatcttctgt

SEQ ID NO: 975584 - DNA, 25 bp, Mus musculus
tgactgcccgcaccgcatcttctgt

SEQ ID NO: 975585 - DNA, 25 bp, Mus musculus
tgactggcctggcaggggagcacaa

SEQ ID NO: 975586 - DNA, 25 bp, Mus musculus
tgactggcctgggaggggagcacaa

SEQ ID NO: 975587 - DNA, 25 bp, Mus musculus
tgactgtactgagacctcctgcttc

SEQ ID NO: 975588 - DNA, 25 bp, Mus musculus
tgactgtactgagagctcctgcttc

SEQ ID NO: 975589 - DNA, 25 bp, Mus musculus
tgactgtagccccgacatcaccttg

SEQ ID NO: 975590 - DNA, 25 bp, Mus musculus
tgactgtagcccggacatcaccttg

SEQ ID NO: 975591 - DNA, 25 bp, Mus musculus
tgactgtcagcaacatgacattgaa

SEQ ID NO: 975592 - DNA, 25 bp, Mus musculus
tgactgtcaggaacatgacattgaa

SEQ ID NO: 975593 - DNA, 25 bp, Mus musculus
tgactgtcttgactgtctagctgcc

SEQ ID NO: 975594 - DNA, 25 bp, Mus musculus
tgactgtcttgagtgtctagctgcc

SEQ ID NO: 975595 - DNA, 25 bp, Mus musculus
tgactgtgaacagtacaaattccat

SEQ ID NO: 975596 - DNA, 25 bp, Mus musculus
tgactgtgaacagtataaagcatgc

SEQ ID NO: 975597 - DNA, 25 bp, Mus musculus
tgactgtgaacagttcaaattccat

SEQ ID NO: 975598 - DNA, 25 bp, Mus musculus
tgactgtgaacagtttaaagcatgc

SEQ ID NO: 975599 - DNA, 25 bp, Mus musculus
tgactgtgagatcgcggcgcccctg

SEQ ID NO: 975600 - DNA, 25 bp, Mus musculus
tgactgtgagatggcggcgcccctg

SEQ ID NO: 975601 - DNA, 25 bp, Mus musculus
tgactgtgcacaaggcccccagagt

SEQ ID NO: 975602 - DNA, 25 bp, Mus musculus
tgactgtgcacatggcccccagagt

SEQ ID NO: 975603 - DNA, 25 bp, Mus musculus
tgactgtgtctaaacggcttctctg

SEQ ID NO: 975604 - DNA, 25 bp, Mus musculus
tgactgtgtctaaacgtaaaacaga

SEQ ID NO: 975605 - DNA, 25 bp, Mus musculus
tgactgtgtctaaagggcttctctg

SEQ ID NO: 975606 - DNA, 25 bp, Mus musculus
tgactgtgtctaaaggtaaaacaga

SEQ ID NO: 975607 - DNA, 25 bp, Mus musculus
tgactgtgttagatgaacccacagt

SEQ ID NO: 975608 - DNA, 25 bp, Mus musculus
tgactgtgttagatgctcctgaagt

SEQ ID NO: 975609 - DNA, 25 bp, Mus musculus
tgactgtgttagttgaacccacagt

SEQ ID NO: 975610 - DNA, 25 bp, Mus musculus
tgactgtgttagttgctcctgaagt

SEQ ID NO: 975611 - DNA, 25 bp, Mus musculus
tgactgtgtttgcgtttccacaggc

SEQ ID NO: 975612 - DNA, 25 bp, Mus musculus
tgactgtgtttgggtttccacaggc

SEQ ID NO: 975613 - DNA, 25 bp, Mus musculus
tgactgttcatgcgcttgtgaaccc

SEQ ID NO: 975614 - DNA, 25 bp, Mus musculus
tgactgttcatgggcttgtgaaccc

SEQ ID NO: 975615 - DNA, 25 bp, Mus musculus
tgactgtttcagaaatgctgcaacc

SEQ ID NO: 975616 - DNA, 25 bp, Mus musculus
tgactgtttcagtaatgctgcaacc

SEQ ID NO: 975617 - DNA, 25 bp, Mus musculus
tgacttaaagcaactagaggctgcc

SEQ ID NO: 975618 - DNA, 25 bp, Mus musculus
tgacttaaagcccaatgtggagcat

SEQ ID NO: 975619 - DNA, 25 bp, Mus musculus
tgacttaaaggaactagaggctgcc

SEQ ID NO: 975620 - DNA, 25 bp, Mus musculus
tgacttaaaggccaatgtggagcat

SEQ ID NO: 975621 - DNA, 25 bp, Mus musculus
tgacttacattgatgaaccagagcc

SEQ ID NO: 975622 - DNA, 25 bp, Mus musculus
tgacttacattgttgaaccagagcc

SEQ ID NO: 975623 - DNA, 25 bp, Mus musculus
tgacttagaagaatttcagacctgc

SEQ ID NO: 975624 - DNA, 25 bp, Mus musculus
tgacttagaagattttcagacctgc

SEQ ID NO: 975625 - DNA, 25 bp, Mus musculus
tgacttagagcagtgtgaccaggtg

SEQ ID NO: 975626 - DNA, 25 bp, Mus musculus
tgacttagaggagtgtgaccaggtg

SEQ ID NO: 975627 - DNA, 25 bp, Mus musculus
tgacttcaaatgcacagtgttctct

SEQ ID NO: 975628 - DNA, 25 bp, Mus musculus
tgacttcaaatgcagagtgttctct

SEQ ID NO: 975629 - DNA, 25 bp, Mus musculus
tgacttcaagccatttttcatcgag

SEQ ID NO: 975630 - DNA, 25 bp, Mus musculus
tgacttcaagcctgacatctggtcc

SEQ ID NO: 975631 - DNA, 25 bp, Mus musculus
tgacttcaagcgtttgatttccaac

SEQ ID NO: 975632 - DNA, 25 bp, Mus musculus
tgacttcaaggcatttttcatcgag

SEQ ID NO: 975633 - DNA, 25 bp, Mus musculus
tgacttcaaggctgacatctggtcc

SEQ ID NO: 975634 - DNA, 25 bp, Mus musculus
tgacttcaagggtttgatttccaac

SEQ ID NO: 975635 - DNA, 25 bp, Mus musculus
tgacttcaagtgcacgatcttctct

SEQ ID NO: 975636 - DNA, 25 bp, Mus musculus
tgacttcaagtgcaggatcttctct

SEQ ID NO: 975637 - DNA, 25 bp, Mus musculus
tgacttcaggaccaagtatgagtca

SEQ ID NO: 975638 - DNA, 25 bp, Mus musculus
tgacttcaggaccatgtatgagtca

SEQ ID NO: 975639 - DNA, 25 bp, Mus musculus
tgacttcaggcgcgcttttgcaggg

SEQ ID NO: 975640 - DNA, 25 bp, Mus musculus
tgacttcaggcgggcttttgcaggg

SEQ ID NO: 975641 - DNA, 25 bp, Mus musculus
tgacttccatataagtttctttgct

SEQ ID NO: 975642 - DNA, 25 bp, Mus musculus
tgacttccatttaagtttctttgct

SEQ ID NO: 975643 - DNA, 25 bp, Mus musculus
tgacttcccgctcctggtcccgtac

SEQ ID NO: 975644 - DNA, 25 bp, Mus musculus
tgacttcccgctgctggtcccgtac

SEQ ID NO: 975645 - DNA, 25 bp, Mus musculus
tgacttccggagggctttgagtcaa

SEQ ID NO: 975646 - DNA, 25 bp, Mus musculus
tgacttccggtgggctttgagtcaa

SEQ ID NO: 975647 - DNA, 25 bp, Mus musculus
tgacttccgtggagggattttcctg

SEQ ID NO: 975648 - DNA, 25 bp, Mus musculus
tgacttccgtggtgggattttcctg

SEQ ID NO: 975649 - DNA, 25 bp, Mus musculus
tgacttcctgcacgaatatgtcacc

SEQ ID NO: 975650 - DNA, 25 bp, Mus musculus
tgacttcctgcaggaatatgtcacc

SEQ ID NO: 975651 - DNA, 25 bp, Mus musculus
tgacttcgacagctatctcctgtta

SEQ ID NO: 975652 - DNA, 25 bp, Mus musculus
tgacttcgacaggtatctcctgtta

SEQ ID NO: 975653 - DNA, 25 bp, Mus musculus
tgacttctataaaatacaaggagtg

SEQ ID NO: 975654 - DNA, 25 bp, Mus musculus
tgacttctataatatacaaggagtg

SEQ ID NO: 975655 - DNA, 25 bp, Mus musculus
tgacttgagaaacctggggatccaa

SEQ ID NO: 975656 - DNA, 25 bp, Mus musculus
tgacttgagaaagctggggatccaa

SEQ ID NO: 975657 - DNA, 25 bp, Mus musculus
tgacttgtctgaccagatcctgacg

SEQ ID NO: 975658 - DNA, 25 bp, Mus musculus
tgacttgtctgacctgatcctgacg

SEQ ID NO: 975659 - DNA, 25 bp, Mus musculus
tgactttaagcacgtgctgctggtg

SEQ ID NO: 975660 - DNA, 25 bp, Mus musculus
tgactttaagcaggtgctgctggtg

SEQ ID NO: 975661 - DNA, 25 bp, Mus musculus
tgactttgagcgcaaaaaagacgtg

SEQ ID NO: 975662 - DNA, 25 bp, Mus musculus
tgactttgagggcaaaaaagacgtg

SEQ ID NO: 975663 - DNA, 25 bp, Mus musculus
tgactttgcactttcaccaaacctc

SEQ ID NO: 975664 - DNA, 25 bp, Mus musculus
tgactttgcagtttcaccaaacctc

SEQ ID NO: 975665 - DNA, 25 bp, Mus musculus
tgactttgtcaacttgagctcaggg

SEQ ID NO: 975666 - DNA, 25 bp, Mus musculus
tgactttgtcaagttgagctcaggg

SEQ ID NO: 975667 - DNA, 25 bp, Mus musculus
tgactttgtgctgacgatgaacaag

SEQ ID NO: 975668 - DNA, 25 bp, Mus musculus
tgactttgtgctgaggatgaacaag

SEQ ID NO: 975669 - DNA, 25 bp, Mus musculus
tgagaaaaagattgaagacccacta

SEQ ID NO: 975670 - DNA, 25 bp, Mus musculus
tgagaaaaagtttgaagacccacta

SEQ ID NO: 975671 - DNA, 25 bp, Mus musculus
tgagaaaaggtgcacatcctggggc

SEQ ID NO: 975672 - DNA, 25 bp, Mus musculus
tgagaaaaggtgcaccaactgcttt

SEQ ID NO: 975673 - DNA, 25 bp, Mus musculus
tgagaaaaggtgcagatcctggggc

SEQ ID NO: 975674 - DNA, 25 bp, Mus musculus
tgagaaaaggtgcagcaactgcttt

SEQ ID NO: 975675 - DNA, 25 bp, Mus musculus
tgagaaacctaacaattgtggattc

SEQ ID NO: 975676 - DNA, 25 bp, Mus musculus
tgagaaaccttacaattgtggattc

SEQ ID NO: 975677 - DNA, 25 bp, Mus musculus
tgagaaacgctgcccccaagttgaa

SEQ ID NO: 975678 - DNA, 25 bp, Mus musculus
tgagaaacgctgccgccaagttgaa

SEQ ID NO: 975679 - DNA, 25 bp, Mus musculus
tgagaaagaagaccaagagaaactg

SEQ ID NO: 975680 - DNA, 25 bp, Mus musculus
tgagaaagaagagcaagagaaactg

SEQ ID NO: 975681 - DNA, 25 bp, Mus musculus
tgagaaagagtgcctcgcccacgtc

SEQ ID NO: 975682 - DNA, 25 bp, Mus musculus
tgagaaagagtggctcgcccacgtc

SEQ ID NO: 975683 - DNA, 25 bp, Mus musculus
tgagaaagatgacaagttgacccca

SEQ ID NO: 975684 - DNA, 25 bp, Mus musculus
tgagaaagatgacatgttgacccca

SEQ ID NO: 975685 - DNA, 25 bp, Mus musculus
tgagaaataccactccctggcctac

SEQ ID NO: 975686 - DNA, 25 bp, Mus musculus
tgagaaataccagtccctggcctac

SEQ ID NO: 975687 - DNA, 25 bp, Mus musculus
tgagaaatgcagcaatctccggttc

SEQ ID NO: 975688 - DNA, 25 bp, Mus musculus
tgagaaatgcaggaatctccggttc

SEQ ID NO: 975689 - DNA, 25 bp, Mus musculus
tgagaacaacagcaacctgaggaga

SEQ ID NO: 975690 - DNA, 25 bp, Mus musculus
tgagaacaacagcactccgggagaa

SEQ ID NO: 975691 - DNA, 25 bp, Mus musculus
tgagaacaacaggaacctgaggaga

SEQ ID NO: 975692 - DNA, 25 bp, Mus musculus
tgagaacaacaggactccgggagaa

SEQ ID NO: 975693 - DNA, 25 bp, Mus musculus
tgagaacacccgcaatgattacagc

SEQ ID NO: 975694 - DNA, 25 bp, Mus musculus
tgagaacacccgcattgattacagc

SEQ ID NO: 975695 - DNA, 25 bp, Mus musculus
tgagaacagaaaccttgaggaaaaa

SEQ ID NO: 975696 - DNA, 25 bp, Mus musculus
tgagaacagataccttgaggaaaaa

SEQ ID NO: 975697 - DNA, 25 bp, Mus musculus
tgagaacatgagcacctgcgacaca

SEQ ID NO: 975698 - DNA, 25 bp, Mus musculus
tgagaacatgtgcacctgcgacaca

SEQ ID NO: 975699 - DNA, 25 bp, Mus musculus
tgagaaccagagcatcgtgctggag

SEQ ID NO: 975700 - DNA, 25 bp, Mus musculus
tgagaaccagagcgacagcatcgtg

SEQ ID NO: 975701 - DNA, 25 bp, Mus musculus
tgagaaccagaggatcgtgctggag

SEQ ID NO: 975702 - DNA, 25 bp, Mus musculus
tgagaaccagagggacagcatcgtg

SEQ ID NO: 975703 - DNA, 25 bp, Mus musculus
tgagaaccatcccaagcactacaag

SEQ ID NO: 975704 - DNA, 25 bp, Mus musculus
tgagaaccatcccatgcactacaag

SEQ ID NO: 975705 - DNA, 25 bp, Mus musculus
tgagaaccccagcgtccattcacac

SEQ ID NO: 975706 - DNA, 25 bp, Mus musculus
tgagaaccccagggtccattcacac

SEQ ID NO: 975707 - DNA, 25 bp, Mus musculus
tgagaacctgccctgcagttaaacg

SEQ ID NO: 975708 - DNA, 25 bp, Mus musculus
tgagaacctggcctgcagttaaacg

SEQ ID NO: 975709 - DNA, 25 bp, Mus musculus
tgagaaccttaaagagaaactagag

SEQ ID NO: 975710 - DNA, 25 bp, Mus musculus
tgagaaccttaaagtgaaactagag

SEQ ID NO: 975711 - DNA, 25 bp, Mus musculus
tgagaacgctcacccactgccctct

SEQ ID NO: 975712 - DNA, 25 bp, Mus musculus
tgagaacgctcagccactgccctct

SEQ ID NO: 975713 - DNA, 25 bp, Mus musculus
tgagaacgggacgtcctctggctgt

SEQ ID NO: 975714 - DNA, 25 bp, Mus musculus
tgagaacgggtcgtcctctggctgt

SEQ ID NO: 975715 - DNA, 25 bp, Mus musculus
tgagaacgtcagcaggctgtcgcgc

SEQ ID NO: 975716 - DNA, 25 bp, Mus musculus
tgagaacgtcaggaggctgtcgcgc

SEQ ID NO: 975717 - DNA, 25 bp, Mus musculus
tgagaacttcagcctcctgggcaat

SEQ ID NO: 975718 - DNA, 25 bp, Mus musculus
tgagaacttcaggctcctgggcaat

SEQ ID NO: 975719 - DNA, 25 bp, Mus musculus
tgagaagaagaacctggcagagaag

SEQ ID NO: 975720 - DNA, 25 bp, Mus musculus
tgagaagaagaagctggcagagaag

SEQ ID NO: 975721 - DNA, 25 bp, Mus musculus
tgagaagaagctgagcccacctttc

SEQ ID NO: 975722 - DNA, 25 bp, Mus musculus
tgagaagaaggtgagcccacctttc

SEQ ID NO: 975723 - DNA, 25 bp, Mus musculus
tgagaagatatatcaaggaatatgt

SEQ ID NO: 975724 - DNA, 25 bp, Mus musculus
tgagaagatatatctaggaatatgt

SEQ ID NO: 975725 - DNA, 25 bp, Mus musculus
tgagaagatgatcgaagatatgaat

SEQ ID NO: 975726 - DNA, 25 bp, Mus musculus
tgagaagatgatggaagatatgaat

SEQ ID NO: 975727 - DNA, 25 bp, Mus musculus
tgagaagattaagaaagaccccgct

SEQ ID NO: 975728 - DNA, 25 bp, Mus musculus
tgagaagatttagaaagaccccgct

SEQ ID NO: 975729 - DNA, 25 bp, Mus musculus
tgagaagcagcctgtgcagctatcg

SEQ ID NO: 975730 - DNA, 25 bp, Mus musculus
tgagaagcagctctgttctcctggc

SEQ ID NO: 975731 - DNA, 25 bp, Mus musculus
tgagaagcaggctgtgcagctatcg

SEQ ID NO: 975732 - DNA, 25 bp, Mus musculus
tgagaagcaggtctgttctcctggc

SEQ ID NO: 975733 - DNA, 25 bp, Mus musculus
tgagaagccgcctgtccctgagact

SEQ ID NO: 975734 - DNA, 25 bp, Mus musculus
tgagaagccggctgtccctgagact

SEQ ID NO: 975735 - DNA, 25 bp, Mus musculus
tgagaagcctaacaacgcaattcac

SEQ ID NO: 975736 - DNA, 25 bp, Mus musculus
tgagaagcctaagaacgcaattcac

SEQ ID NO: 975737 - DNA, 25 bp, Mus musculus
tgagaagctgcacgccgactttaaa

SEQ ID NO: 975738 - DNA, 25 bp, Mus musculus
tgagaagctgcaggccgactttaaa

SEQ ID NO: 975739 - DNA, 25 bp, Mus musculus
tgagaaggagggcgagctcaactaa

SEQ ID NO: 975740 - DNA, 25 bp, Mus musculus
tgagaaggagggcttccccatcaca

SEQ ID NO: 975741 - DNA, 25 bp, Mus musculus
tgagaaggagggggagctcaactaa

SEQ ID NO: 975742 - DNA, 25 bp, Mus musculus
tgagaaggaggggttccccatcaca

SEQ ID NO: 975743 - DNA, 25 bp, Mus musculus
tgagaagtataacacacagattgac

SEQ ID NO: 975744 - DNA, 25 bp, Mus musculus
tgagaagtataagacacagattgac

SEQ ID NO: 975745 - DNA, 25 bp, Mus musculus
tgagaataagcatattgccaattac

SEQ ID NO: 975746 - DNA, 25 bp, Mus musculus
tgagaataaggatattgccaattac

SEQ ID NO: 975747 - DNA, 25 bp, Mus musculus
tgagaatcttcgccggcaggcctgt

SEQ ID NO: 975748 - DNA, 25 bp, Mus musculus
tgagaatcttcggcggcaggcctgt

SEQ ID NO: 975749 - DNA, 25 bp, Mus musculus
tgagaatgactgctgggtgagcaag

SEQ ID NO: 975750 - DNA, 25 bp, Mus musculus
tgagaatgactggtgggtgagcaag

SEQ ID NO: 975751 - DNA, 25 bp, Mus musculus
tgagaatgatccagctacatcaaaa

SEQ ID NO: 975752 - DNA, 25 bp, Mus musculus
tgagaatgatcctgctacatcaaaa

SEQ ID NO: 975753 - DNA, 25 bp, Mus musculus
tgagaatgccacagtggccacagag

SEQ ID NO: 975754 - DNA, 25 bp, Mus musculus
tgagaatgccactgtggccacagag

SEQ ID NO: 975755 - DNA, 25 bp, Mus musculus
tgagacaccgagagtgtgggttcgc

SEQ ID NO: 975756 - DNA, 25 bp, Mus musculus
tgagacaccgagtgtgtgggttcgc

SEQ ID NO: 975757 - DNA, 25 bp, Mus musculus
tgagacattgaggaaaaaaggttta

SEQ ID NO: 975758 - DNA, 25 bp, Mus musculus
tgagacattgtggaaaaaaggttta

SEQ ID NO: 975759 - DNA, 25 bp, Mus musculus
tgagaccaagaacatggagaagcag

SEQ ID NO: 975760 - DNA, 25 bp, Mus musculus
tgagaccaagtacatggagaagcag

SEQ ID NO: 975761 - DNA, 25 bp, Mus musculus
tgagaccacgcagacgaaagatggt

SEQ ID NO: 975762 - DNA, 25 bp, Mus musculus
tgagaccacgcagacggaaggtgtg

SEQ ID NO: 975763 - DNA, 25 bp, Mus musculus
tgagaccacgcagaggaaagatggt

SEQ ID NO: 975764 - DNA, 25 bp, Mus musculus
tgagaccacgcagagggaaggtgtg

SEQ ID NO: 975765 - DNA, 25 bp, Mus musculus
tgagaccatgcttgatgccctctca

SEQ ID NO: 975766 - DNA, 25 bp, Mus musculus
tgagaccatggttgatgccctctca

SEQ ID NO: 975767 - DNA, 25 bp, Mus musculus
tgagaccattaacgatctaatgcgt

SEQ ID NO: 975768 - DNA, 25 bp, Mus musculus
tgagaccattaaggatctaatgcgt

SEQ ID NO: 975769 - DNA, 25 bp, Mus musculus
tgagacccacatcgaatggacctgt

SEQ ID NO: 975770 - DNA, 25 bp, Mus musculus
tgagacccacatggaatggacctgt

SEQ ID NO: 975771 - DNA, 25 bp, Mus musculus
tgagacccagctactaaatcaaaca

SEQ ID NO: 975772 - DNA, 25 bp, Mus musculus
tgagacccaggtactaaatcaaaca

SEQ ID NO: 975773 - DNA, 25 bp, Mus musculus
tgagaccccaagagaagggagtgga

SEQ ID NO: 975774 - DNA, 25 bp, Mus musculus
tgagaccccaagagagacaacaatc

SEQ ID NO: 975775 - DNA, 25 bp, Mus musculus
tgagaccccaagagtagggagtgga

SEQ ID NO: 975776 - DNA, 25 bp, Mus musculus
tgagaccccaagagtgacaacaatc

SEQ ID NO: 975777 - DNA, 25 bp, Mus musculus
tgagaccctgaacatgggctgtgtg

SEQ ID NO: 975778 - DNA, 25 bp, Mus musculus
tgagaccctgcacatgaacaagctg

SEQ ID NO: 975779 - DNA, 25 bp, Mus musculus
tgagaccctggacatgaacaagctg

SEQ ID NO: 975780 - DNA, 25 bp, Mus musculus
tgagaccctgtacatgggctgtgtg

SEQ ID NO: 975781 - DNA, 25 bp, Mus musculus
tgagacctgataacacaaagcctcc

SEQ ID NO: 975782 - DNA, 25 bp, Mus musculus
tgagacctgataactcaaagcctcc

SEQ ID NO: 975783 - DNA, 25 bp, Mus musculus
tgagacgaccctcaagtgccctgtg

SEQ ID NO: 975784 - DNA, 25 bp, Mus musculus
tgagacgaccctcatgtgccctgtg

SEQ ID NO: 975785 - DNA, 25 bp, Mus musculus
tgagacgagtgacgtggtggatgtg

SEQ ID NO: 975786 - DNA, 25 bp, Mus musculus
tgagacgagtgaggtggtggatgtg

SEQ ID NO: 975787 - DNA, 25 bp, Mus musculus
tgagacgggaagctgtacagagagg

SEQ ID NO: 975788 - DNA, 25 bp, Mus musculus
tgagacgggaaggtgtacagagagg

SEQ ID NO: 975789 - DNA, 25 bp, Mus musculus
tgagactggctcttcgcgacaactg

SEQ ID NO: 975790 - DNA, 25 bp, Mus musculus
tgagactggctcttggcgacaactg

SEQ ID NO: 975791 - DNA, 25 bp, Mus musculus
tgagagaagcctgtgctaatgaaaa

SEQ ID NO: 975792 - DNA, 25 bp, Mus musculus
tgagagaagcgtgtgctaatgaaaa

SEQ ID NO: 975793 - DNA, 25 bp, Mus musculus
tgagagagaaaaagaagcccgtgcc

SEQ ID NO: 975794 - DNA, 25 bp, Mus musculus
tgagagagaaaatgaagcccgtgcc

SEQ ID NO: 975795 - DNA, 25 bp, Mus musculus
tgagagatctcgctgtgccaccagg

SEQ ID NO: 975796 - DNA, 25 bp, Mus musculus
tgagagatctcggtgtgccaccagg

SEQ ID NO: 975797 - DNA, 25 bp, Mus musculus
tgagagatgcaacctgataggagca

SEQ ID NO: 975798 - DNA, 25 bp, Mus musculus
tgagagatgcaagctgataggagca

SEQ ID NO: 975799 - DNA, 25 bp, Mus musculus
tgagagcagcaagactacaaactca

SEQ ID NO: 975800 - DNA, 25 bp, Mus musculus
tgagagcagcaagagtacaaactca

SEQ ID NO: 975801 - DNA, 25 bp, Mus musculus
tgagagccaaattgttcagaaggag

SEQ ID NO: 975802 - DNA, 25 bp, Mus musculus
tgagagccaacaacccagagcagaa

SEQ ID NO: 975803 - DNA, 25 bp, Mus musculus
tgagagccaacatcccagagcagaa

SEQ ID NO: 975804 - DNA, 25 bp, Mus musculus
tgagagccaatttgttcagaaggag

SEQ ID NO: 975805 - DNA, 25 bp, Mus musculus
tgagagccagagccactgagagtat

SEQ ID NO: 975806 - DNA, 25 bp, Mus musculus
tgagagccagaggcactgagagtat

SEQ ID NO: 975807 - DNA, 25 bp, Mus musculus
tgagagcgttcactgtgcagagaac

SEQ ID NO: 975808 - DNA, 25 bp, Mus musculus
tgagagcgttcagtgtgcagagaac

SEQ ID NO: 975809 - DNA, 25 bp, Mus musculus
tgagagctacggatatgttctacca

SEQ ID NO: 975810 - DNA, 25 bp, Mus musculus
tgagagctacggttatgttctacca

SEQ ID NO: 975811 - DNA, 25 bp, Mus musculus
tgagagctagcacacatctctgtga

SEQ ID NO: 975812 - DNA, 25 bp, Mus musculus
tgagagctagcacttccagtgcaga

SEQ ID NO: 975813 - DNA, 25 bp, Mus musculus
tgagagctagcagacatctctgtga

SEQ ID NO: 975814 - DNA, 25 bp, Mus musculus
tgagagctagcagttccagtgcaga

SEQ ID NO: 975815 - DNA, 25 bp, Mus musculus
tgagaggaagacactgcagcttcaa

SEQ ID NO: 975816 - DNA, 25 bp, Mus musculus
tgagaggaagactctgcagcttcaa

SEQ ID NO: 975817 - DNA, 25 bp, Mus musculus
tgagaggaccaacgcaatacagtgt

SEQ ID NO: 975818 - DNA, 25 bp, Mus musculus
tgagaggaccaaggcaatacagtgt

SEQ ID NO: 975819 - DNA, 25 bp, Mus musculus
tgagaggataaaagatgaagaagat

SEQ ID NO: 975820 - DNA, 25 bp, Mus musculus
tgagaggataaatgatgaagaagat

SEQ ID NO: 975821 - DNA, 25 bp, Mus musculus
tgagaggcagcgcttgtcaatgagg

SEQ ID NO: 975822 - DNA, 25 bp, Mus musculus
tgagaggcagggcttgtcaatgagg

SEQ ID NO: 975823 - DNA, 25 bp, Mus musculus
tgagaggggcagctggcagctcagc

SEQ ID NO: 975824 - DNA, 25 bp, Mus musculus
tgagaggggcaggtggcagctcagc

SEQ ID NO: 975825 - DNA, 25 bp, Mus musculus
tgagagtaagatctcgttttatatt

SEQ ID NO: 975826 - DNA, 25 bp, Mus musculus
tgagagtaagccttcctccacgtca

SEQ ID NO: 975827 - DNA, 25 bp, Mus musculus
tgagagtaaggcttcctccacgtca

SEQ ID NO: 975828 - DNA, 25 bp, Mus musculus
tgagagtaagttctcgttttatatt

SEQ ID NO: 975829 - DNA, 25 bp, Mus musculus
tgagagtcagctttcccaacctctt

SEQ ID NO: 975830 - DNA, 25 bp, Mus musculus
tgagagtcaggtttcccaacctctt

SEQ ID NO: 975831 - DNA, 25 bp, Mus musculus
tgagagtccgaaaacagtgtgcctt

SEQ ID NO: 975832 - DNA, 25 bp, Mus musculus
tgagagtccgaatacagtgtgcctt

SEQ ID NO: 975833 - DNA, 25 bp, Mus musculus
tgagagtcctgacgattgtgaacag

SEQ ID NO: 975834 - DNA, 25 bp, Mus musculus
tgagagtcctgaggattgtgaacag

SEQ ID NO: 975835 - DNA, 25 bp, Mus musculus
tgagagtcgtgcaacagcattttgc

SEQ ID NO: 975836 - DNA, 25 bp, Mus musculus
tgagagtcgtgcaagagcattttgc

SEQ ID NO: 975837 - DNA, 25 bp, Mus musculus
tgagagtctaacaccactactttaa

SEQ ID NO: 975838 - DNA, 25 bp, Mus musculus
tgagagtctatcaccactactttaa

SEQ ID NO: 975839 - DNA, 25 bp, Mus musculus
tgagagtgagaaccatttcttcact

SEQ ID NO: 975840 - DNA, 25 bp, Mus musculus
tgagagtgagaagcatttcttcact

SEQ ID NO: 975841 - DNA, 25 bp, Mus musculus
tgagagtgagagaggcatgaaagtc

SEQ ID NO: 975842 - DNA, 25 bp, Mus musculus
tgagagtgagagaggtatgaaggtg

SEQ ID NO: 975843 - DNA, 25 bp, Mus musculus
tgagagtgagagtggcatgaaagtc

SEQ ID NO: 975844 - DNA, 25 bp, Mus musculus
tgagagtgagagtggtatgaaggtg

SEQ ID NO: 975845 - DNA, 25 bp, Mus musculus
tgagagttgtgacgagatcccccaa

SEQ ID NO: 975846 - DNA, 25 bp, Mus musculus
tgagagttgtgaggagatcccccaa

SEQ ID NO: 975847 - DNA, 25 bp, Mus musculus
tgagatatatacatacattgggagc

SEQ ID NO: 975848 - DNA, 25 bp, Mus musculus
tgagatatattcatacattgggagc

SEQ ID NO: 975849 - DNA, 25 bp, Mus musculus
tgagatcattagcaaacaggtctca

SEQ ID NO: 975850 - DNA, 25 bp, Mus musculus
tgagatcattagctctcagccacta

SEQ ID NO: 975851 - DNA, 25 bp, Mus musculus
tgagatcattaggaaacaggtctca

SEQ ID NO: 975852 - DNA, 25 bp, Mus musculus
tgagatcattaggtctcagccacta

SEQ ID NO: 975853 - DNA, 25 bp, Mus musculus
tgagatccagctgcaggcagtagca

SEQ ID NO: 975854 - DNA, 25 bp, Mus musculus
tgagatccaggtgcaggcagtagca

SEQ ID NO: 975855 - DNA, 25 bp, Mus musculus
tgagatcgccttcacgttgcaggaa

SEQ ID NO: 975856 - DNA, 25 bp, Mus musculus
tgagatcgccttcaggttgcaggaa

SEQ ID NO: 975857 - DNA, 25 bp, Mus musculus
tgagatcttaaacgttgccaggatg

SEQ ID NO: 975858 - DNA, 25 bp, Mus musculus
tgagatcttaaaggttgccaggatg

SEQ ID NO: 975859 - DNA, 25 bp, Mus musculus
tgagatgagttacaggctaacggcc

SEQ ID NO: 975860 - DNA, 25 bp, Mus musculus
tgagatgagttacgctaacggccag

SEQ ID NO: 975861 - DNA, 25 bp, Mus musculus
tgagatgagttactttagaggctaa

SEQ ID NO: 975862 - DNA, 25 bp, Mus musculus
tgagatgagttagaggctaacggcc

SEQ ID NO: 975863 - DNA, 25 bp, Mus musculus
tgagatgagttaggctaacggccag

SEQ ID NO: 975864 - DNA, 25 bp, Mus musculus
tgagatgagttagtttagaggctaa

SEQ ID NO: 975865 - DNA, 25 bp, Mus musculus
tgagatgtttcacacggaagcagat

SEQ ID NO: 975866 - DNA, 25 bp, Mus musculus
tgagatgtttcacagggaagcagat

SEQ ID NO: 975867 - DNA, 25 bp, Mus musculus
tgagattaagaaatgtgaccttcat

SEQ ID NO: 975868 - DNA, 25 bp, Mus musculus
tgagattaagcaagcctgctgcgtg

SEQ ID NO: 975869 - DNA, 25 bp, Mus musculus
tgagattaaggaagcctgctgcgtg

SEQ ID NO: 975870 - DNA, 25 bp, Mus musculus
tgagattaagtaatgtgaccttcat

SEQ ID NO: 975871 - DNA, 25 bp, Mus musculus
tgagattaggaattgttggccacct

SEQ ID NO: 975872 - DNA, 25 bp, Mus musculus
tgagattaggtattgttggccacct

SEQ ID NO: 975873 - DNA, 25 bp, Mus musculus
tgagattgccagattctataagctt

SEQ ID NO: 975874 - DNA, 25 bp, Mus musculus
tgagattgccagtttctataagctt

SEQ ID NO: 975875 - DNA, 25 bp, Mus musculus
tgagcaaattcacatataaaaagat

SEQ ID NO: 975876 - DNA, 25 bp, Mus musculus
tgagcaaattcacctaataattttc

SEQ ID NO: 975877 - DNA, 25 bp, Mus musculus
tgagcaaattcagatataaaaagat

SEQ ID NO: 975878 - DNA, 25 bp, Mus musculus
tgagcaaattcagctaataattttc

SEQ ID NO: 975879 - DNA, 25 bp, Mus musculus
tgagcaaccaagagtgtcacttgta

SEQ ID NO: 975880 - DNA, 25 bp, Mus musculus
tgagcaaccaagtgtgtcacttgta

SEQ ID NO: 975881 - DNA, 25 bp, Mus musculus
tgagcaagatgacctggactatcac

SEQ ID NO: 975882 - DNA, 25 bp, Mus musculus
tgagcaagatgagctggactatcac

SEQ ID NO: 975883 - DNA, 25 bp, Mus musculus
tgagcaagcgccccttgattgtgat

SEQ ID NO: 975884 - DNA, 25 bp, Mus musculus
tgagcaagcgccttgttatgctgcc

SEQ ID NO: 975885 - DNA, 25 bp, Mus musculus
tgagcaagcggcccttgattgtgat

SEQ ID NO: 975886 - DNA, 25 bp, Mus musculus
tgagcaagcggcttgttatgctgcc

SEQ ID NO: 975887 - DNA, 25 bp, Mus musculus
tgagcacagccaaacatgaactgac

SEQ ID NO: 975888 - DNA, 25 bp, Mus musculus
tgagcacagccaaagatgaactgac

SEQ ID NO: 975889 - DNA, 25 bp, Mus musculus
tgagcacaggagacaatctggagca

SEQ ID NO: 975890 - DNA, 25 bp, Mus musculus
tgagcacaggagtcaatctggagca

SEQ ID NO: 975891 - DNA, 25 bp, Mus musculus
tgagcactaccgcgtcctgggcagc

SEQ ID NO: 975892 - DNA, 25 bp, Mus musculus
tgagcactaccgggtcctgggcagc

SEQ ID NO: 975893 - DNA, 25 bp, Mus musculus
tgagcagaaatgcacaaagttttta

SEQ ID NO: 975894 - DNA, 25 bp, Mus musculus
tgagcagaaatgcagaaagttttta

SEQ ID NO: 975895 - DNA, 25 bp, Mus musculus
tgagcagaagcgccttcttgaagta

SEQ ID NO: 975896 - DNA, 25 bp, Mus musculus
tgagcagaagggccttcttgaagta

SEQ ID NO: 975897 - DNA, 25 bp, Mus musculus
tgagcagactctctgtgtggtctgc

SEQ ID NO: 975898 - DNA, 25 bp, Mus musculus
tgagcagactctgtgtgtggtctgc

SEQ ID NO: 975899 - DNA, 25 bp, Mus musculus
tgagcagagagacgtctggaagcgc

SEQ ID NO: 975900 - DNA, 25 bp, Mus musculus
tgagcagagagaggtctggaagcgc

SEQ ID NO: 975901 - DNA, 25 bp, Mus musculus
tgagcagatccacaaagtccaggtg

SEQ ID NO: 975902 - DNA, 25 bp, Mus musculus
tgagcagatccagaaagtccaggtg

SEQ ID NO: 975903 - DNA, 25 bp, Mus musculus
tgagcagcaatgctaaatatgtgtg

SEQ ID NO: 975904 - DNA, 25 bp, Mus musculus
tgagcagcaatggtaaatatgtgtg

SEQ ID NO: 975905 - DNA, 25 bp, Mus musculus
tgagcagcagcaaaaagatggaacc

SEQ ID NO: 975906 - DNA, 25 bp, Mus musculus
tgagcagcaggaaaaagatggaacc

SEQ ID NO: 975907 - DNA, 25 bp, Mus musculus
tgagcagccgggcacgtttgccaag

SEQ ID NO: 975908 - DNA, 25 bp, Mus musculus
tgagcagccgggcaggtttgccaag

SEQ ID NO: 975909 - DNA, 25 bp, Mus musculus
tgagcagctgaacaagaaggcagaa

SEQ ID NO: 975910 - DNA, 25 bp, Mus musculus
tgagcagctgaacatgaaggcagaa

SEQ ID NO: 975911 - DNA, 25 bp, Mus musculus
tgagcaggagaacagtatcgatgat

SEQ ID NO: 975912 - DNA, 25 bp, Mus musculus
tgagcaggagaagagtatcgatgat

SEQ ID NO: 975913 - DNA, 25 bp, Mus musculus
tgagcaggccatcgacctcgtgaag

SEQ ID NO: 975914 - DNA, 25 bp, Mus musculus
tgagcaggccatggacctcgtgaag

SEQ ID NO: 975915 - DNA, 25 bp, Mus musculus
tgagcagtacagcgattgtgcagag

SEQ ID NO: 975916 - DNA, 25 bp, Mus musculus
tgagcagtacagggattgtgcagag

SEQ ID NO: 975917 - DNA, 25 bp, Mus musculus
tgagcatcacagagcctgcgctacc

SEQ ID NO: 975918 - DNA, 25 bp, Mus musculus
tgagcatcacagtgcctgcgctacc

SEQ ID NO: 975919 - DNA, 25 bp, Mus musculus
tgagcatgagatggatatacaaccg

SEQ ID NO: 975920 - DNA, 25 bp, Mus musculus
tgagcatgagcttgtctattacact

SEQ ID NO: 975921 - DNA, 25 bp, Mus musculus
tgagcatgaggttgtctattacact

SEQ ID NO: 975922 - DNA, 25 bp, Mus musculus
tgagcatgagttggatatacaaccg

SEQ ID NO: 975923 - DNA, 25 bp, Mus musculus
tgagcatgctggcacagcccaacga

SEQ ID NO: 975924 - DNA, 25 bp, Mus musculus
tgagcatgctggcagagcccaacga

SEQ ID NO: 975925 - DNA, 25 bp, Mus musculus
tgagcattgctgtcactgaaaaatg

SEQ ID NO: 975926 - DNA, 25 bp, Mus musculus
tgagcattgctgtctctgaaaaatg

SEQ ID NO: 975927 - DNA, 25 bp, Mus musculus
tgagccaacatgctcgtgaaaatac

SEQ ID NO: 975928 - DNA, 25 bp, Mus musculus
tgagccaacatggtcgtgaaaatac

SEQ ID NO: 975929 - DNA, 25 bp, Mus musculus
tgagccacagactctacgagagatt

SEQ ID NO: 975930 - DNA, 25 bp, Mus musculus
tgagccacagtcaacgactcattgt

SEQ ID NO: 975931 - DNA, 25 bp, Mus musculus
tgagccacagtcaaggactcattgt

SEQ ID NO: 975932 - DNA, 25 bp, Mus musculus
tgagccacagtctctacgagagatt

SEQ ID NO: 975933 - DNA, 25 bp, Mus musculus
tgagccaccaagagttcttcatgcc

SEQ ID NO: 975934 - DNA, 25 bp, Mus musculus
tgagccaccacacgttggcactgaa

SEQ ID NO: 975935 - DNA, 25 bp, Mus musculus
tgagccaccacaggttggcactgaa

SEQ ID NO: 975936 - DNA, 25 bp, Mus musculus
tgagccaccatgagttcttcatgcc

SEQ ID NO: 975937 - DNA, 25 bp, Mus musculus
tgagccaggagaatcgtccgtctcc

SEQ ID NO: 975938 - DNA, 25 bp, Mus musculus
tgagccaggagaatggtccgtctcc

SEQ ID NO: 975939 - DNA, 25 bp, Mus musculus
tgagccatttagaacgtgtgccgat

SEQ ID NO: 975940 - DNA, 25 bp, Mus musculus
tgagccatttagaaggtgtgccgat

SEQ ID NO: 975941 - DNA, 25 bp, Mus musculus
tgagcccatgagaggaaacaagttg

SEQ ID NO: 975942 - DNA, 25 bp, Mus musculus
tgagcccatgagtggaaacaagttg

SEQ ID NO: 975943 - DNA, 25 bp, Mus musculus
tgagccccagaccacctcatcctcc

SEQ ID NO: 975944 - DNA, 25 bp, Mus musculus
tgagccccagctctgtctccgtgcc

SEQ ID NO: 975945 - DNA, 25 bp, Mus musculus
tgagccccaggtctgtctccgtgcc

SEQ ID NO: 975946 - DNA, 25 bp, Mus musculus
tgagccccagtccacctcatcctcc

SEQ ID NO: 975947 - DNA, 25 bp, Mus musculus
tgagcccgagaccgtcagtgggcca

SEQ ID NO: 975948 - DNA, 25 bp, Mus musculus
tgagcccgagacggtcagtgggcca

SEQ ID NO: 975949 - DNA, 25 bp, Mus musculus
tgagccctcacaactttgctttgtc

SEQ ID NO: 975950 - DNA, 25 bp, Mus musculus
tgagccctcacatctttgctttgtc

SEQ ID NO: 975951 - DNA, 25 bp, Mus musculus
tgagccgacccacgtctgtgcagac

SEQ ID NO: 975952 - DNA, 25 bp, Mus musculus
tgagccgacccaggtctgtgcagac

SEQ ID NO: 975953 - DNA, 25 bp, Mus musculus
tgagccgagacaagagccctgggga

SEQ ID NO: 975954 - DNA, 25 bp, Mus musculus
tgagccgagagaagagccctgggga

SEQ ID NO: 975955 - DNA, 25 bp, Mus musculus
tgagcctagcgggaacagcagtagc

SEQ ID NO: 975956 - DNA, 25 bp, Mus musculus
tgagcctagcgggatcagcagtagc

SEQ ID NO: 975957 - DNA, 25 bp, Mus musculus
tgagcctcactgctgggtgtgcaaa

SEQ ID NO: 975958 - DNA, 25 bp, Mus musculus
tgagcctcactggtgggtgtgcaaa

SEQ ID NO: 975959 - DNA, 25 bp, Mus musculus
tgagcctcttaacgtcattttcttg

SEQ ID NO: 975960 - DNA, 25 bp, Mus musculus
tgagcctcttaaggtcattttcttg

SEQ ID NO: 975961 - DNA, 25 bp, Mus musculus
tgagcctgggacactgttctgggag

SEQ ID NO: 975962 - DNA, 25 bp, Mus musculus
tgagcctgggcaacaaaaactgcac

SEQ ID NO: 975963 - DNA, 25 bp, Mus musculus
tgagcctggggaacaaaaactgcac

SEQ ID NO: 975964 - DNA, 25 bp, Mus musculus
tgagcctgggtcactgttctgggag

SEQ ID NO: 975965 - DNA, 25 bp, Mus musculus
tgagcctggtcacgcagtccctcga

SEQ ID NO: 975966 - DNA, 25 bp, Mus musculus
tgagcctggtcacgtgaaagcagcc

SEQ ID NO: 975967 - DNA, 25 bp, Mus musculus
tgagcctggtcaggcagtccctcga

SEQ ID NO: 975968 - DNA, 25 bp, Mus musculus
tgagcctggtcaggtgaaagcagcc

SEQ ID NO: 975969 - DNA, 25 bp, Mus musculus
tgagccttctagacctcacccctac

SEQ ID NO: 975970 - DNA, 25 bp, Mus musculus
tgagccttctagtcctcacccctac

SEQ ID NO: 975971 - DNA, 25 bp, Mus musculus
tgagcgacaggacgtgaacatcccg

SEQ ID NO: 975972 - DNA, 25 bp, Mus musculus
tgagcgacaggaggtgaacatcccg

SEQ ID NO: 975973 - DNA, 25 bp, Mus musculus
tgagcgactccacgaaactaatcac

SEQ ID NO: 975974 - DNA, 25 bp, Mus musculus
tgagcgactccaggaaactaatcac

SEQ ID NO: 975975 - DNA, 25 bp, Mus musculus
tgagcgactgagccaattaaaaacc

SEQ ID NO: 975976 - DNA, 25 bp, Mus musculus
tgagcgactgagctctgccgacggg

SEQ ID NO: 975977 - DNA, 25 bp, Mus musculus
tgagcgactgaggcaattaaaaacc

SEQ ID NO: 975978 - DNA, 25 bp, Mus musculus
tgagcgactgaggtctgccgacggg

SEQ ID NO: 975979 - DNA, 25 bp, Mus musculus
tgagcgagagagcgaactggaggag

SEQ ID NO: 975980 - DNA, 25 bp, Mus musculus
tgagcgagagagggaactggaggag

SEQ ID NO: 975981 - DNA, 25 bp, Mus musculus
tgagcgaggcgaccgtgcacagtgc

SEQ ID NO: 975982 - DNA, 25 bp, Mus musculus
tgagcgaggcgacgcaccatgacaa

SEQ ID NO: 975983 - DNA, 25 bp, Mus musculus
tgagcgaggcgagcgtgcacagtgc

SEQ ID NO: 975984 - DNA, 25 bp, Mus musculus
tgagcgaggcgaggcaccatgacaa

SEQ ID NO: 975985 - DNA, 25 bp, Mus musculus
tgagcggcagcagcgagaggatgaa

SEQ ID NO: 975986 - DNA, 25 bp, Mus musculus
tgagcggcaggagcgagaggatgaa

SEQ ID NO: 975987 - DNA, 25 bp, Mus musculus
tgagcgggccaacagcaaagcccag

SEQ ID NO: 975988 - DNA, 25 bp, Mus musculus
tgagcgggccaaccagagcaaagcc

SEQ ID NO: 975989 - DNA, 25 bp, Mus musculus
tgagcgggccaagagcaaagcccag

SEQ ID NO: 975990 - DNA, 25 bp, Mus musculus
tgagcgggccaagcagagcaaagcc

SEQ ID NO: 975991 - DNA, 25 bp, Mus musculus
tgagcggggctgtgcatctttccag

SEQ ID NO: 975992 - DNA, 25 bp, Mus musculus
tgagcggggctgtggatctttccag

SEQ ID NO: 975993 - DNA, 25 bp, Mus musculus
tgagcggtgagccacatgtccttcc

SEQ ID NO: 975994 - DNA, 25 bp, Mus musculus
tgagcggtgagcgacatgtccttcc

SEQ ID NO: 975995 - DNA, 25 bp, Mus musculus
tgagctaaaacaaatgctcaccgag

SEQ ID NO: 975996 - DNA, 25 bp, Mus musculus
tgagctaaaagaaatgctcaccgag

SEQ ID NO: 975997 - DNA, 25 bp, Mus musculus
tgagctaaagatcttgcgtcgggga

SEQ ID NO: 975998 - DNA, 25 bp, Mus musculus
tgagctaaagttcttgcgtcgggga

SEQ ID NO: 975999 - DNA, 25 bp, Mus musculus
tgagctacacagcttttgtccaagg

SEQ ID NO: 976000 - DNA, 25 bp, Mus musculus
tgagctacacaggttttgtccaagg

SEQ ID NO: 976001 - DNA, 25 bp, Mus musculus
tgagctacctcactcgccaagagtg

SEQ ID NO: 976002 - DNA, 25 bp, Mus musculus
tgagctacctcagtcgccaagagtg

SEQ ID NO: 976003 - DNA, 25 bp, Mus musculus
tgagctactcagccctgcctacttt

SEQ ID NO: 976004 - DNA, 25 bp, Mus musculus
tgagctactcagctcaaggctttga

SEQ ID NO: 976005 - DNA, 25 bp, Mus musculus
tgagctactcaggcctgcctacttt

SEQ ID NO: 976006 - DNA, 25 bp, Mus musculus
tgagctactcaggtcaaggctttga

SEQ ID NO: 976007 - DNA, 25 bp, Mus musculus
tgagctcaaaccaacaccctccacc

SEQ ID NO: 976008 - DNA, 25 bp, Mus musculus
tgagctcaaaccaagaccctccacc

SEQ ID NO: 976009 - DNA, 25 bp, Mus musculus
tgagctcaaccgctacatccccaca

SEQ ID NO: 976010 - DNA, 25 bp, Mus musculus
tgagctcaaccggtacatccccaca

SEQ ID NO: 976011 - DNA, 25 bp, Mus musculus
tgagctcaagactgaagtgtcctgg

SEQ ID NO: 976012 - DNA, 25 bp, Mus musculus
tgagctcaagattctggattttggg

SEQ ID NO: 976013 - DNA, 25 bp, Mus musculus
tgagctcaagcgtttagcctggttc

SEQ ID NO: 976014 - DNA, 25 bp, Mus musculus
tgagctcaagggtttagcctggttc

SEQ ID NO: 976015 - DNA, 25 bp, Mus musculus
tgagctcaagtctgaagtgtcctgg

SEQ ID NO: 976016 - DNA, 25 bp, Mus musculus
tgagctcaagtttctggattttggg

SEQ ID NO: 976017 - DNA, 25 bp, Mus musculus
tgagctcatggacagagcagtagag

SEQ ID NO: 976018 - DNA, 25 bp, Mus musculus
tgagctcatggaccttgagatcttc

SEQ ID NO: 976019 - DNA, 25 bp, Mus musculus
tgagctcatggagagagcagtagag

SEQ ID NO: 976020 - DNA, 25 bp, Mus musculus
tgagctcatggagcttgagatcttc

SEQ ID NO: 976021 - DNA, 25 bp, Mus musculus
tgagctctcacacttaaaggaatcc

SEQ ID NO: 976022 - DNA, 25 bp, Mus musculus
tgagctctcacagttaaaggaatcc

SEQ ID NO: 976023 - DNA, 25 bp, Mus musculus
tgagctctcagaagccaaatgtgcc

SEQ ID NO: 976024 - DNA, 25 bp, Mus musculus
tgagctctcagaagcccaagttcga

SEQ ID NO: 976025 - DNA, 25 bp, Mus musculus
tgagctctcagaaggcaaatgtgcc

SEQ ID NO: 976026 - DNA, 25 bp, Mus musculus
tgagctctcagaaggccaagttcga

SEQ ID NO: 976027 - DNA, 25 bp, Mus musculus
tgagctcttccaacacttcgacaaa

SEQ ID NO: 976028 - DNA, 25 bp, Mus musculus
tgagctcttccatcacttcgacaaa

SEQ ID NO: 976029 - DNA, 25 bp, Mus musculus
tgagctgaagatcctagactttggc

SEQ ID NO: 976030 - DNA, 25 bp, Mus musculus
tgagctgaagttcctagactttggc

SEQ ID NO: 976031 - DNA, 25 bp, Mus musculus
tgagctgctccacgagcctgaagct

SEQ ID NO: 976032 - DNA, 25 bp, Mus musculus
tgagctgctccaggagcctgaagct

SEQ ID NO: 976033 - DNA, 25 bp, Mus musculus
tgagctggcagagtcccgttgccga

SEQ ID NO: 976034 - DNA, 25 bp, Mus musculus
tgagctggcagagtctaagtgttct

SEQ ID NO: 976035 - DNA, 25 bp, Mus musculus
tgagctggcagagtgccgttgccga

SEQ ID NO: 976036 - DNA, 25 bp, Mus musculus
tgagctggcagagtgtaagtgttct

SEQ ID NO: 976037 - DNA, 25 bp, Mus musculus
tgagctggctggagctggcatgaac

SEQ ID NO: 976038 - DNA, 25 bp, Mus musculus
tgagctggctggctttgactctgct

SEQ ID NO: 976039 - DNA, 25 bp, Mus musculus
tgagctggctgggtttgactctgct

SEQ ID NO: 976040 - DNA, 25 bp, Mus musculus
tgagctggctggtgctggcatgaac

SEQ ID NO: 976041 - DNA, 25 bp, Mus musculus
tgagcttgccctcgtcaggcagcag

SEQ ID NO: 976042 - DNA, 25 bp, Mus musculus
tgagcttgccctggtcaggcagcag

SEQ ID NO: 976043 - DNA, 25 bp, Mus musculus
tgagcttgctaacctacaagaagac

SEQ ID NO: 976044 - DNA, 25 bp, Mus musculus
tgagcttgctaacgtggaagaagaa

SEQ ID NO: 976045 - DNA, 25 bp, Mus musculus
tgagcttgctaagctacaagaagac

SEQ ID NO: 976046 - DNA, 25 bp, Mus musculus
tgagcttgctaaggtggaagaagaa

SEQ ID NO: 976047 - DNA, 25 bp, Mus musculus
tgagcttgtctgtccggtgctccag

SEQ ID NO: 976048 - DNA, 25 bp, Mus musculus
tgagcttgtctgtcgggtgctccag

SEQ ID NO: 976049 - DNA, 25 bp, Mus musculus
tgaggaaaagcacgcatatattcag

SEQ ID NO: 976050 - DNA, 25 bp, Mus musculus
tgaggaaaagcaggcatatattcag

SEQ ID NO: 976051 - DNA, 25 bp, Mus musculus
tgaggaaacccactcgcatagggca

SEQ ID NO: 976052 - DNA, 25 bp, Mus musculus
tgaggaaacccagtcgcatagggca

SEQ ID NO: 976053 - DNA, 25 bp, Mus musculus
tgaggaaagacaagatactgtcagc

SEQ ID NO: 976054 - DNA, 25 bp, Mus musculus
tgaggaaagacatgatactgtcagc

SEQ ID NO: 976055 - DNA, 25 bp, Mus musculus
tgaggaacagcaatggtaatgctat

SEQ ID NO: 976056 - DNA, 25 bp, Mus musculus
tgaggaacaggaatggtaatgctat

SEQ ID NO: 976057 - DNA, 25 bp, Mus musculus
tgaggaactgcctaaggagcctcaa

SEQ ID NO: 976058 - DNA, 25 bp, Mus musculus
tgaggaactgcctatggagcctcaa

SEQ ID NO: 976059 - DNA, 25 bp, Mus musculus
tgaggaactgggcctttgaaccaga

SEQ ID NO: 976060 - DNA, 25 bp, Mus musculus
tgaggaactggggctttgaaccaga

SEQ ID NO: 976061 - DNA, 25 bp, Mus musculus
tgaggaagaaaacacgaatctgcaa

SEQ ID NO: 976062 - DNA, 25 bp, Mus musculus
tgaggaagaaaacaggaatctgcaa

SEQ ID NO: 976063 - DNA, 25 bp, Mus musculus
tgaggaagagagttcccatatccaa

SEQ ID NO: 976064 - DNA, 25 bp, Mus musculus
tgaggaagaggacctccctgtgctg

SEQ ID NO: 976065 - DNA, 25 bp, Mus musculus
tgaggaagaggagctccctgtgctg

SEQ ID NO: 976066 - DNA, 25 bp, Mus musculus
tgaggaagagtgttcccatatccaa

SEQ ID NO: 976067 - DNA, 25 bp, Mus musculus
tgaggaagatgacaaaattccagtg

SEQ ID NO: 976068 - DNA, 25 bp, Mus musculus
tgaggaagatgagaaaattccagtg

SEQ ID NO: 976069 - DNA, 25 bp, Mus musculus
tgaggaatctttcggaagaactgct

SEQ ID NO: 976070 - DNA, 25 bp, Mus musculus
tgaggaatctttgggaagaactgct

SEQ ID NO: 976071 - DNA, 25 bp, Mus musculus
tgaggacaagagtgtggaaaatgct

SEQ ID NO: 976072 - DNA, 25 bp, Mus musculus
tgaggacaagtgtgtggaaaatgct

SEQ ID NO: 976073 - DNA, 25 bp, Mus musculus
tgaggacacagcgacaattggacaa

SEQ ID NO: 976074 - DNA, 25 bp, Mus musculus
tgaggacacagcgagaattggacaa

SEQ ID NO: 976075 - DNA, 25 bp, Mus musculus
tgaggacattaacacctgctgtaac

SEQ ID NO: 976076 - DNA, 25 bp, Mus musculus
tgaggacattaagacctgctgtaac

SEQ ID NO: 976077 - DNA, 25 bp, Mus musculus
tgaggaccagctggtagttaataaa

SEQ ID NO: 976078 - DNA, 25 bp, Mus musculus
tgaggaccaggtggtagttaataaa

SEQ ID NO: 976079 - DNA, 25 bp, Mus musculus
tgaggacccgcagctagaagcgatc

SEQ ID NO: 976080 - DNA, 25 bp, Mus musculus
tgaggacccggagctagaagcgatc

SEQ ID NO: 976081 - DNA, 25 bp, Mus musculus
tgaggacgttcaccttcgtctcaat

SEQ ID NO: 976082 - DNA, 25 bp, Mus musculus
tgaggacgttcagcttcgtctcaat

SEQ ID NO: 976083 - DNA, 25 bp, Mus musculus
tgaggactcgctctacctgtttgca

SEQ ID NO: 976084 - DNA, 25 bp, Mus musculus
tgaggactcgctgtacctgtttgca

SEQ ID NO: 976085 - DNA, 25 bp, Mus musculus
tgaggagaagagtgagaaactttac

SEQ ID NO: 976086 - DNA, 25 bp, Mus musculus
tgaggagaagcctatgggaaggtgt

SEQ ID NO: 976087 - DNA, 25 bp, Mus musculus
tgaggagaagctgcctttcattttt

SEQ ID NO: 976088 - DNA, 25 bp, Mus musculus
tgaggagaaggctatgggaaggtgt

SEQ ID NO: 976089 - DNA, 25 bp, Mus musculus
tgaggagaaggtgcctttcattttt

SEQ ID NO: 976090 - DNA, 25 bp, Mus musculus
tgaggagaagtgtgagaaactttac

SEQ ID NO: 976091 - DNA, 25 bp, Mus musculus
tgaggagacttgcgttgggggcatg

SEQ ID NO: 976092 - DNA, 25 bp, Mus musculus
tgaggagacttgggttgggggcatg

SEQ ID NO: 976093 - DNA, 25 bp, Mus musculus
tgaggagatatatgaccacaacatg

SEQ ID NO: 976094 - DNA, 25 bp, Mus musculus
tgaggagatatatgtccacaacatg

SEQ ID NO: 976095 - DNA, 25 bp, Mus musculus
tgaggagatcaacaggatagatagg

SEQ ID NO: 976096 - DNA, 25 bp, Mus musculus
tgaggagatcaacgacttgcaccag

SEQ ID NO: 976097 - DNA, 25 bp, Mus musculus
tgaggagatcaagaggatagatagg

SEQ ID NO: 976098 - DNA, 25 bp, Mus musculus
tgaggagatcaaggacttgcaccag

SEQ ID NO: 976099 - DNA, 25 bp, Mus musculus
tgaggagatgaaccgcatgcatgag

SEQ ID NO: 976100 - DNA, 25 bp, Mus musculus
tgaggagatggacacatctcaagct

SEQ ID NO: 976101 - DNA, 25 bp, Mus musculus
tgaggagatggagacatctcaagct

SEQ ID NO: 976102 - DNA, 25 bp, Mus musculus
tgaggagatgtaccgcatgcatgag

SEQ ID NO: 976103 - DNA, 25 bp, Mus musculus
tgaggagattgaatcggacgacctg

SEQ ID NO: 976104 - DNA, 25 bp, Mus musculus
tgaggagattgaatgggacgacctg

SEQ ID NO: 976105 - DNA, 25 bp, Mus musculus
tgaggagcaaagcctgtgaactcct

SEQ ID NO: 976106 - DNA, 25 bp, Mus musculus
tgaggagcaaaggctgtgaactcct

SEQ ID NO: 976107 - DNA, 25 bp, Mus musculus
tgaggagcagactttcctgcagcag

SEQ ID NO: 976108 - DNA, 25 bp, Mus musculus
tgaggagcagtctttcctgcagcag

SEQ ID NO: 976109 - DNA, 25 bp, Mus musculus
tgaggagcatctgcagagtgtcgac

SEQ ID NO: 976110 - DNA, 25 bp, Mus musculus
tgaggagcatgtgcagagtgtcgac

SEQ ID NO: 976111 - DNA, 25 bp, Mus musculus
tgaggaggagcaggtagagcggatc

SEQ ID NO: 976112 - DNA, 25 bp, Mus musculus
tgaggaggaggaggtagagcggatc

SEQ ID NO: 976113 - DNA, 25 bp, Mus musculus
tgaggaggattacgtgaacatgttt

SEQ ID NO: 976114 - DNA, 25 bp, Mus musculus
tgaggaggattaggtgaacatgttt

SEQ ID NO: 976115 - DNA, 25 bp, Mus musculus
tgaggaggtgctcgacttacctaag

SEQ ID NO: 976116 - DNA, 25 bp, Mus musculus
tgaggaggtgctggacttacctaag

SEQ ID NO: 976117 - DNA, 25 bp, Mus musculus
tgaggaggtgcttcaggttcttcgg

SEQ ID NO: 976118 - DNA, 25 bp, Mus musculus
tgaggaggtggttcaggttcttcgg

SEQ ID NO: 976119 - DNA, 25 bp, Mus musculus
tgaggagtaccacgagaccctgagc

SEQ ID NO: 976120 - DNA, 25 bp, Mus musculus
tgaggagtaccacgaggagctggag

SEQ ID NO: 976121 - DNA, 25 bp, Mus musculus
tgaggagtaccaggagaccctgagc

SEQ ID NO: 976122 - DNA, 25 bp, Mus musculus
tgaggagtaccaggaggagctggag

SEQ ID NO: 976123 - DNA, 25 bp, Mus musculus
tgaggagtcaatagagggagaagct

SEQ ID NO: 976124 - DNA, 25 bp, Mus musculus
tgaggagtcaattgagggagaagct

SEQ ID NO: 976125 - DNA, 25 bp, Mus musculus
tgaggagtcccgccgtggagcgtta

SEQ ID NO: 976126 - DNA, 25 bp, Mus musculus
tgaggagtcccgcctcatcactctt

SEQ ID NO: 976127 - DNA, 25 bp, Mus musculus
tgaggagtcccggcgtggagcgtta

SEQ ID NO: 976128 - DNA, 25 bp, Mus musculus
tgaggagtcccggctcatcactctt

SEQ ID NO: 976129 - DNA, 25 bp, Mus musculus
tgaggatctacaaactattatcaag

SEQ ID NO: 976130 - DNA, 25 bp, Mus musculus
tgaggatctacaaagtattatcaag

SEQ ID NO: 976131 - DNA, 25 bp, Mus musculus
tgaggatgaactcaagttccttcag

SEQ ID NO: 976132 - DNA, 25 bp, Mus musculus
tgaggatgaactgaagttccttcag

SEQ ID NO: 976133 - DNA, 25 bp, Mus musculus
tgaggatgaccctactgtattatac

SEQ ID NO: 976134 - DNA, 25 bp, Mus musculus
tgaggatgaccctagtgtattatac

SEQ ID NO: 976135 - DNA, 25 bp, Mus musculus
tgaggatgatgacgatgacgatgtg

SEQ ID NO: 976136 - DNA, 25 bp, Mus musculus
tgaggatgatgaggatgacgatgtg

SEQ ID NO: 976137 - DNA, 25 bp, Mus musculus
tgaggatgctctggatgaaccccag

SEQ ID NO: 976138 - DNA, 25 bp, Mus musculus
tgaggatgctgtggatgaaccccag

SEQ ID NO: 976139 - DNA, 25 bp, Mus musculus
tgaggatggacaccaacacccaagg

SEQ ID NO: 976140 - DNA, 25 bp, Mus musculus
tgaggatggacaccagcaacaccca

SEQ ID NO: 976141 - DNA, 25 bp, Mus musculus
tgaggatggacagcaacacccaagg

SEQ ID NO: 976142 - DNA, 25 bp, Mus musculus
tgaggatggacagcagcaacaccca

SEQ ID NO: 976143 - DNA, 25 bp, Mus musculus
tgaggatggagacacgctgctccac

SEQ ID NO: 976144 - DNA, 25 bp, Mus musculus
tgaggatggagacaggctgctccac

SEQ ID NO: 976145 - DNA, 25 bp, Mus musculus
tgaggatggcagcgtatttatgagc

SEQ ID NO: 976146 - DNA, 25 bp, Mus musculus
tgaggatggcagggtatttatgagc

SEQ ID NO: 976147 - DNA, 25 bp, Mus musculus
tgaggattattccactacttccagg

SEQ ID NO: 976148 - DNA, 25 bp, Mus musculus
tgaggattattccagtacttccagg

SEQ ID NO: 976149 - DNA, 25 bp, Mus musculus
tgaggattctgacaacctgcagagc

SEQ ID NO: 976150 - DNA, 25 bp, Mus musculus
tgaggattctgacaatgatggcgag

SEQ ID NO: 976151 - DNA, 25 bp, Mus musculus
tgaggattctgacatcctgcagagc

SEQ ID NO: 976152 - DNA, 25 bp, Mus musculus
tgaggattctgacattgatggcgag

SEQ ID NO: 976153 - DNA, 25 bp, Mus musculus
tgaggcaaagaacctagccagctat

SEQ ID NO: 976154 - DNA, 25 bp, Mus musculus
tgaggcaaagtacctagccagctat

SEQ ID NO: 976155 - DNA, 25 bp, Mus musculus
tgaggcacgagcaacagtactgttt

SEQ ID NO: 976156 - DNA, 25 bp, Mus musculus
tgaggcacgagcaagagtactgttt

SEQ ID NO: 976157 - DNA, 25 bp, Mus musculus
tgaggcactgtgatgatgatgccac

SEQ ID NO: 976158 - DNA, 25 bp, Mus musculus
tgaggcactgtgttgatgatgccac

SEQ ID NO: 976159 - DNA, 25 bp, Mus musculus
tgaggccaagcacgataaatacatg

SEQ ID NO: 976160 - DNA, 25 bp, Mus musculus
tgaggccaagcacgtggacgagaaa

SEQ ID NO: 976161 - DNA, 25 bp, Mus musculus
tgaggccaagcaggataaatacatg

SEQ ID NO: 976162 - DNA, 25 bp, Mus musculus
tgaggccaagcaggtggacgagaaa

SEQ ID NO: 976163 - DNA, 25 bp, Mus musculus
tgaggccctgggcacgctgctggtt

SEQ ID NO: 976164 - DNA, 25 bp, Mus musculus
tgaggccctgggcaggctgctggtt

SEQ ID NO: 976165 - DNA, 25 bp, Mus musculus
tgaggcctttggctggcacaccatc

SEQ ID NO: 976166 - DNA, 25 bp, Mus musculus
tgaggcctttgggtggcacaccatc

SEQ ID NO: 976167 - DNA, 25 bp, Mus musculus
tgaggcgaagcaaagctcacaacag

SEQ ID NO: 976168 - DNA, 25 bp, Mus musculus
tgaggcgaaggaaagctcacaacag

SEQ ID NO: 976169 - DNA, 25 bp, Mus musculus
tgaggcgagcagctggtggcccccg

SEQ ID NO: 976170 - DNA, 25 bp, Mus musculus
tgaggcgagcagctgtggcccctca

SEQ ID NO: 976171 - DNA, 25 bp, Mus musculus
tgaggcgagcaggtggtggcccccg

SEQ ID NO: 976172 - DNA, 25 bp, Mus musculus
tgaggcgagcaggtgtggcccctca

SEQ ID NO: 976173 - DNA, 25 bp, Mus musculus
tgaggcgcggcccagcactatggtg

SEQ ID NO: 976174 - DNA, 25 bp, Mus musculus
tgaggcgcgggccagcactatggtg

SEQ ID NO: 976175 - DNA, 25 bp, Mus musculus
tgaggcgcttggagaatggcagcag

SEQ ID NO: 976176 - DNA, 25 bp, Mus musculus
tgaggcgcttggagtatggcagcag

SEQ ID NO: 976177 - DNA, 25 bp, Mus musculus
tgaggctagcagaatttctcagaga

SEQ ID NO: 976178 - DNA, 25 bp, Mus musculus
tgaggctagcagtatttctcagaga

SEQ ID NO: 976179 - DNA, 25 bp, Mus musculus
tgagggactacactggacaaggcgt

SEQ ID NO: 976180 - DNA, 25 bp, Mus musculus
tgagggactacagtggacaaggcgt

SEQ ID NO: 976181 - DNA, 25 bp, Mus musculus
tgagggagacagaggcattcaaggt

SEQ ID NO: 976182 - DNA, 25 bp, Mus musculus
tgagggagacagtggcattcaaggt

SEQ ID NO: 976183 - DNA, 25 bp, Mus musculus
tgagggatggcacgctcaaagactt

SEQ ID NO: 976184 - DNA, 25 bp, Mus musculus
tgagggatggcaggctcaaagactt

SEQ ID NO: 976185 - DNA, 25 bp, Mus musculus
tgagggctcaagacgcaatgtgtct

SEQ ID NO: 976186 - DNA, 25 bp, Mus musculus
tgagggctcaagtcgcaatgtgtct

SEQ ID NO: 976187 - DNA, 25 bp, Mus musculus
tgaggggcagttatttcctgacatt

SEQ ID NO: 976188 - DNA, 25 bp, Mus musculus
tgaggggcagttttttcctgacatt

SEQ ID NO: 976189 - DNA, 25 bp, Mus musculus
tgaggggcgcgtgccattgagctgc

SEQ ID NO: 976190 - DNA, 25 bp, Mus musculus
tgaggggcgcgtgcgattgagctgc

SEQ ID NO: 976191 - DNA, 25 bp, Mus musculus
tgaggggggacacgtatatggaacc

SEQ ID NO: 976192 - DNA, 25 bp, Mus musculus
tgaggggggacaggtatatggaacc

SEQ ID NO: 976193 - DNA, 25 bp, Mus musculus
tgagggtaagaatcagatggagatg

SEQ ID NO: 976194 - DNA, 25 bp, Mus musculus
tgagggtaagtatcagatggagatg

SEQ ID NO: 976195 - DNA, 25 bp, Mus musculus
tgaggtacacagccgcaggtctgag

SEQ ID NO: 976196 - DNA, 25 bp, Mus musculus
tgaggtacacaggcgcaggtctgag

SEQ ID NO: 976197 - DNA, 25 bp, Mus musculus
tgaggtacagctgtcggctctgtcc

SEQ ID NO: 976198 - DNA, 25 bp, Mus musculus
tgaggtacaggtgtcggctctgtcc

SEQ ID NO: 976199 - DNA, 25 bp, Mus musculus
tgaggtcaatcattactatgtttga

SEQ ID NO: 976200 - DNA, 25 bp, Mus musculus
tgaggtcaatcatttctatgtttga

SEQ ID NO: 976201 - DNA, 25 bp, Mus musculus
tgaggtcacttcatcacacacagct

SEQ ID NO: 976202 - DNA, 25 bp, Mus musculus
tgaggtcacttcttcacacacagct

SEQ ID NO: 976203 - DNA, 25 bp, Mus musculus
tgaggtcttcacatttggaaataac

SEQ ID NO: 976204 - DNA, 25 bp, Mus musculus
tgaggtcttcacttttggaaataac

SEQ ID NO: 976205 - DNA, 25 bp, Mus musculus
tgaggtcttgccagctgagaaagct

SEQ ID NO: 976206 - DNA, 25 bp, Mus musculus
tgaggtcttgcctgctgagaaagct

SEQ ID NO: 976207 - DNA, 25 bp, Mus musculus
tgaggtctttcaagaaatgctgtcc

SEQ ID NO: 976208 - DNA, 25 bp, Mus musculus
tgaggtctttcatgaaatgctgtcc

SEQ ID NO: 976209 - DNA, 25 bp, Mus musculus
tgaggtgcacggcaaagatggtcca

SEQ ID NO: 976210 - DNA, 25 bp, Mus musculus
tgaggtgcacggcaggaaagatggt

SEQ ID NO: 976211 - DNA, 25 bp, Mus musculus
tgaggtgcacggctgtgtttggatg

SEQ ID NO: 976212 - DNA, 25 bp, Mus musculus
tgaggtgcacgggaaagatggtcca

SEQ ID NO: 976213 - DNA, 25 bp, Mus musculus
tgaggtgcacgggaggaaagatggt

SEQ ID NO: 976214 - DNA, 25 bp, Mus musculus
tgaggtgcacgggtgtgtttggatg

SEQ ID NO: 976215 - DNA, 25 bp, Mus musculus
tgaggtgctgtcctctctggccaac

SEQ ID NO: 976216 - DNA, 25 bp, Mus musculus
tgaggtgctgtcgtctctggccaac

SEQ ID NO: 976217 - DNA, 25 bp, Mus musculus
tgaggtggagaacgccaaggggaat

SEQ ID NO: 976218 - DNA, 25 bp, Mus musculus
tgaggtggagaaggccaaggggaat

SEQ ID NO: 976219 - DNA, 25 bp, Mus musculus
tgaggtggatgtctgggtgcaggtg

SEQ ID NO: 976220 - DNA, 25 bp, Mus musculus
tgaggtggatgtgtgggtgcaggtg

SEQ ID NO: 976221 - DNA, 25 bp, Mus musculus
tgaggtggtgcacgagatcccccaa

SEQ ID NO: 976222 - DNA, 25 bp, Mus musculus
tgaggtggtgcaggagatcccccaa

SEQ ID NO: 976223 - DNA, 25 bp, Mus musculus
tgaggtggttgcaacaaactagtaa

SEQ ID NO: 976224 - DNA, 25 bp, Mus musculus
tgaggtggttgcaagaaactagtaa

SEQ ID NO: 976225 - DNA, 25 bp, Mus musculus
tgaggtgtcaaatagctgaaacttt

SEQ ID NO: 976226 - DNA, 25 bp, Mus musculus
tgaggtgtcatatagctgaaacttt

SEQ ID NO: 976227 - DNA, 25 bp, Mus musculus
tgaggtgtcccgacggatcttgaag

SEQ ID NO: 976228 - DNA, 25 bp, Mus musculus
tgaggtgtcccgtcggatcttgaag

SEQ ID NO: 976229 - DNA, 25 bp, Mus musculus
tgagtaaaaatgaacaagtgtgtga

SEQ ID NO: 976230 - DNA, 25 bp, Mus musculus
tgagtaaaaatgtacaagtgtgtga

SEQ ID NO: 976231 - DNA, 25 bp, Mus musculus
tgagtaaacaagaattcctcagaga

SEQ ID NO: 976232 - DNA, 25 bp, Mus musculus
tgagtaaacaagtattcctcagaga

SEQ ID NO: 976233 - DNA, 25 bp, Mus musculus
tgagtaagccgacttctctagcctc

SEQ ID NO: 976234 - DNA, 25 bp, Mus musculus
tgagtaagccgagttctctagcctc

SEQ ID NO: 976235 - DNA, 25 bp, Mus musculus
tgagtacaagaacaatcgcggcggg

SEQ ID NO: 976236 - DNA, 25 bp, Mus musculus
tgagtacaagaagaatcgcggcggg

SEQ ID NO: 976237 - DNA, 25 bp, Mus musculus
tgagtacaagaatctgagtctgagt

SEQ ID NO: 976238 - DNA, 25 bp, Mus musculus
tgagtacaagtatctgagtctgagt

SEQ ID NO: 976239 - DNA, 25 bp, Mus musculus
tgagtacctcagcaaatctgtcatc

SEQ ID NO: 976240 - DNA, 25 bp, Mus musculus
tgagtacctcagcttcaggaaaagc

SEQ ID NO: 976241 - DNA, 25 bp, Mus musculus
tgagtacctcaggaaatctgtcatc

SEQ ID NO: 976242 - DNA, 25 bp, Mus musculus
tgagtacctcaggttcaggaaaagc

SEQ ID NO: 976243 - DNA, 25 bp, Mus musculus
tgagtagtggcatgagagtcattca

SEQ ID NO: 976244 - DNA, 25 bp, Mus musculus
tgagtagtgggatgagagtcattca

SEQ ID NO: 976245 - DNA, 25 bp, Mus musculus
tgagtatatgggaagtactggagaa

SEQ ID NO: 976246 - DNA, 25 bp, Mus musculus
tgagtatatgggccagagcccgggc

SEQ ID NO: 976247 - DNA, 25 bp, Mus musculus
tgagtatatggggcagagcccgggc

SEQ ID NO: 976248 - DNA, 25 bp, Mus musculus
tgagtatatgggtagtactggagaa

SEQ ID NO: 976249 - DNA, 25 bp, Mus musculus
tgagtatcttgacttgaactacagg

SEQ ID NO: 976250 - DNA, 25 bp, Mus musculus
tgagtatcttgagttgaactacagg

SEQ ID NO: 976251 - DNA, 25 bp, Mus musculus
tgagtattacagaggctggttttgg

SEQ ID NO: 976252 - DNA, 25 bp, Mus musculus
tgagtattacagtggctggttttgg

SEQ ID NO: 976253 - DNA, 25 bp, Mus musculus
tgagtcactcaacagcctcatcccc

SEQ ID NO: 976254 - DNA, 25 bp, Mus musculus
tgagtcactcaagagcctcatcccc

SEQ ID NO: 976255 - DNA, 25 bp, Mus musculus
tgagtcagcactgtccctgccaggg

SEQ ID NO: 976256 - DNA, 25 bp, Mus musculus
tgagtcagcactgtgcctgccaggg

SEQ ID NO: 976257 - DNA, 25 bp, Mus musculus
tgagtcagccagcattgaggatatg

SEQ ID NO: 976258 - DNA, 25 bp, Mus musculus
tgagtcagccaggattgaggatatg

SEQ ID NO: 976259 - DNA, 25 bp, Mus musculus
tgagtccaggtgatttggttcatct

SEQ ID NO: 976260 - DNA, 25 bp, Mus musculus
tgagtccaggtgcagctgctggacc

SEQ ID NO: 976261 - DNA, 25 bp, Mus musculus
tgagtccaggtggagctgctggacc

SEQ ID NO: 976262 - DNA, 25 bp, Mus musculus
tgagtccaggtgttttggttcatct

SEQ ID NO: 976263 - DNA, 25 bp, Mus musculus
tgagtcccaaagcatgcatgctgtt

SEQ ID NO: 976264 - DNA, 25 bp, Mus musculus
tgagtcccaaagcgtcttcagatta

SEQ ID NO: 976265 - DNA, 25 bp, Mus musculus
tgagtcccaaagctgtcctgcaggt

SEQ ID NO: 976266 - DNA, 25 bp, Mus musculus
tgagtcccaaaggatgcatgctgtt

SEQ ID NO: 976267 - DNA, 25 bp, Mus musculus
tgagtcccaaagggtcttcagatta

SEQ ID NO: 976268 - DNA, 25 bp, Mus musculus
tgagtcccaaaggtgtcctgcaggt

SEQ ID NO: 976269 - DNA, 25 bp, Mus musculus
tgagtcccaggacaaaaacctcagc

SEQ ID NO: 976270 - DNA, 25 bp, Mus musculus
tgagtcccaggacataaacctcagc

SEQ ID NO: 976271 - DNA, 25 bp, Mus musculus
tgagtcccgcagcctttggaaggat

SEQ ID NO: 976272 - DNA, 25 bp, Mus musculus
tgagtcccgcaggctttggaaggat

SEQ ID NO: 976273 - DNA, 25 bp, Mus musculus
tgagtcccggatctatggaaaatgg

SEQ ID NO: 976274 - DNA, 25 bp, Mus musculus
tgagtcccggttctatggaaaatgg

SEQ ID NO: 976275 - DNA, 25 bp, Mus musculus
tgagtcctttgacctgactgcattt

SEQ ID NO: 976276 - DNA, 25 bp, Mus musculus
tgagtcctttgagctgactgcattt

SEQ ID NO: 976277 - DNA, 25 bp, Mus musculus
tgagtctcagcaacctgacagaact

SEQ ID NO: 976278 - DNA, 25 bp, Mus musculus
tgagtctcagcttccacgagtaccc

SEQ ID NO: 976279 - DNA, 25 bp, Mus musculus
tgagtctcaggaacctgacagaact

SEQ ID NO: 976280 - DNA, 25 bp, Mus musculus
tgagtctcaggttccacgagtaccc

SEQ ID NO: 976281 - DNA, 25 bp, Mus musculus
tgagtctctccgaataccagaaggc

SEQ ID NO: 976282 - DNA, 25 bp, Mus musculus
tgagtctctccgtataccagaaggc

SEQ ID NO: 976283 - DNA, 25 bp, Mus musculus
tgagtctgagactcggacctatatg

SEQ ID NO: 976284 - DNA, 25 bp, Mus musculus
tgagtctgagtctcggacctatatg

SEQ ID NO: 976285 - DNA, 25 bp, Mus musculus
tgagtctgcaggctaggtttggcat

SEQ ID NO: 976286 - DNA, 25 bp, Mus musculus
tgagtctgcaggctttggcatgacg

SEQ ID NO: 976287 - DNA, 25 bp, Mus musculus
tgagtctgcagggtaggtttggcat

SEQ ID NO: 976288 - DNA, 25 bp, Mus musculus
tgagtctgcagggtttggcatgacg

SEQ ID NO: 976289 - DNA, 25 bp, Mus musculus
tgagtctgctgcatctaaataactt

SEQ ID NO: 976290 - DNA, 25 bp, Mus musculus
tgagtctgctgcttctaaataactt

SEQ ID NO: 976291 - DNA, 25 bp, Mus musculus
tgagtctgtgcgcatgcgaggggaa

SEQ ID NO: 976292 - DNA, 25 bp, Mus musculus
tgagtctgtgcggatgcgaggggaa

SEQ ID NO: 976293 - DNA, 25 bp, Mus musculus
tgagtcttatctatgttcaaaggat

SEQ ID NO: 976294 - DNA, 25 bp, Mus musculus
tgagtcttatgtatgttcaaaggat

SEQ ID NO: 976295 - DNA, 25 bp, Mus musculus
tgagtgagcacgcatgaaaattttt

SEQ ID NO: 976296 - DNA, 25 bp, Mus musculus
tgagtgagcacggatgaaaattttt

SEQ ID NO: 976297 - DNA, 25 bp, Mus musculus
tgagtgattacagacaattgtattt

SEQ ID NO: 976298 - DNA, 25 bp, Mus musculus
tgagtgattacagacgctttggtat

SEQ ID NO: 976299 - DNA, 25 bp, Mus musculus
tgagtgattacagacgttgccatga

SEQ ID NO: 976300 - DNA, 25 bp, Mus musculus
tgagtgattacagagaattgtattt

SEQ ID NO: 976301 - DNA, 25 bp, Mus musculus
tgagtgattacagaggctttggtat

SEQ ID NO: 976302 - DNA, 25 bp, Mus musculus
tgagtgattacagaggttgccatga

SEQ ID NO: 976303 - DNA, 25 bp, Mus musculus
tgagtgcaagaggcaagtgcaggtg

SEQ ID NO: 976304 - DNA, 25 bp, Mus musculus
tgagtgcaagccaccccggctggaa

SEQ ID NO: 976305 - DNA, 25 bp, Mus musculus
tgagtgcaaggcaccccggctggaa

SEQ ID NO: 976306 - DNA, 25 bp, Mus musculus
tgagtgcaagtggcaagtgcaggtg

SEQ ID NO: 976307 - DNA, 25 bp, Mus musculus
tgagtggaatccgctcttcgtggtg

SEQ ID NO: 976308 - DNA, 25 bp, Mus musculus
tgagtggaatgcgctcttcgtggtg

SEQ ID NO: 976309 - DNA, 25 bp, Mus musculus
tgagtgggagatccacttcacaggt

SEQ ID NO: 976310 - DNA, 25 bp, Mus musculus
tgagtgggagttccacttcacaggt

SEQ ID NO: 976311 - DNA, 25 bp, Mus musculus
tgagtgtcatggccattaccacagt

SEQ ID NO: 976312 - DNA, 25 bp, Mus musculus
tgagtgtcatgggcattaccacagt

SEQ ID NO: 976313 - DNA, 25 bp, Mus musculus
tgagtgtgcccacgagaaacatcct

SEQ ID NO: 976314 - DNA, 25 bp, Mus musculus
tgagtgtgcccaggagaaacatcct

SEQ ID NO: 976315 - DNA, 25 bp, Mus musculus
tgagtgtgggctcgtaccctctgcc

SEQ ID NO: 976316 - DNA, 25 bp, Mus musculus
tgagtgtgggctggtaccctctgcc

SEQ ID NO: 976317 - DNA, 25 bp, Mus musculus
tgagtgttttagagcgagtcctaat

SEQ ID NO: 976318 - DNA, 25 bp, Mus musculus
tgagtgttttagtgcgagtcctaat

SEQ ID NO: 976319 - DNA, 25 bp, Mus musculus
tgagttcaagcccttgctgtatcct

SEQ ID NO: 976320 - DNA, 25 bp, Mus musculus
tgagttcaagctggtggtcgtgcag

SEQ ID NO: 976321 - DNA, 25 bp, Mus musculus
tgagttcaaggccttgctgtatcct

SEQ ID NO: 976322 - DNA, 25 bp, Mus musculus
tgagttcaaggtggtggtcgtgcag

SEQ ID NO: 976323 - DNA, 25 bp, Mus musculus
tgagttcaccaacactggccgtgtg

SEQ ID NO: 976324 - DNA, 25 bp, Mus musculus
tgagttcaccaagactggccgtgtg

SEQ ID NO: 976325 - DNA, 25 bp, Mus musculus
tgagttctggcacacgttgcgagtt

SEQ ID NO: 976326 - DNA, 25 bp, Mus musculus
tgagttctggcacaggttgcgagtt

SEQ ID NO: 976327 - DNA, 25 bp, Mus musculus
tgagttctggctggatctgcagcat

SEQ ID NO: 976328 - DNA, 25 bp, Mus musculus
tgagttctgggtggatctgcagcat

SEQ ID NO: 976329 - DNA, 25 bp, Mus musculus
tgagtttaagacacagagtgtgaac

SEQ ID NO: 976330 - DNA, 25 bp, Mus musculus
tgagtttaagtcacagagtgtgaac

SEQ ID NO: 976331 - DNA, 25 bp, Mus musculus
tgagtttatcaacgtcttccatggc

SEQ ID NO: 976332 - DNA, 25 bp, Mus musculus
tgagtttatcaaggtcttccatggc

SEQ ID NO: 976333 - DNA, 25 bp, Mus musculus
tgagtttcagcatagtgatgcacct

SEQ ID NO: 976334 - DNA, 25 bp, Mus musculus
tgagtttcaggatagtgatgcacct

SEQ ID NO: 976335 - DNA, 25 bp, Mus musculus
tgagtttgacaacatgcgggaagat

SEQ ID NO: 976336 - DNA, 25 bp, Mus musculus
tgagtttgacaagatgcgggaagat

SEQ ID NO: 976337 - DNA, 25 bp, Mus musculus
tgagtttgaggacgctcaacgcaca

SEQ ID NO: 976338 - DNA, 25 bp, Mus musculus
tgagtttgaggaggctcaacgcaca

SEQ ID NO: 976339 - DNA, 25 bp, Mus musculus
tgataaaaacaaagcccactatgca

SEQ ID NO: 976340 - DNA, 25 bp, Mus musculus
tgataaaaacaatgcccactatgca

SEQ ID NO: 976341 - DNA, 25 bp, Mus musculus
tgataaaacatgccattctgcattt

SEQ ID NO: 976342 - DNA, 25 bp, Mus musculus
tgataaaacatgctggaggcattcc

SEQ ID NO: 976343 - DNA, 25 bp, Mus musculus
tgataaaacatggcattctgcattt

SEQ ID NO: 976344 - DNA, 25 bp, Mus musculus
tgataaaacatggtggaggcattcc

SEQ ID NO: 976345 - DNA, 25 bp, Mus musculus
tgataaaagcacaaaaaggtatatt

SEQ ID NO: 976346 - DNA, 25 bp, Mus musculus
tgataaaagcactaaaaggtatatt

SEQ ID NO: 976347 - DNA, 25 bp, Mus musculus
tgataaaagcatcacgcaagaggca

SEQ ID NO: 976348 - DNA, 25 bp, Mus musculus
tgataaaagcatcacttgtgactgt

SEQ ID NO: 976349 - DNA, 25 bp, Mus musculus
tgataaaagcatcaggcaagaggca

SEQ ID NO: 976350 - DNA, 25 bp, Mus musculus
tgataaaagcatcagttgtgactgt

SEQ ID NO: 976351 - DNA, 25 bp, Mus musculus
tgataaactgaaatcgtgtttgcga

SEQ ID NO: 976352 - DNA, 25 bp, Mus musculus
tgataaactgaaatggtgtttgcga

SEQ ID NO: 976353 - DNA, 25 bp, Mus musculus
tgataaagatgacgcaggttggtct

SEQ ID NO: 976354 - DNA, 25 bp, Mus musculus
tgataaagatgaggcaggttggtct

SEQ ID NO: 976355 - DNA, 25 bp, Mus musculus
tgataaagttcacctcctggctatt

SEQ ID NO: 976356 - DNA, 25 bp, Mus musculus
tgataaagttcagctcctggctatt

SEQ ID NO: 976357 - DNA, 25 bp, Mus musculus
tgataaatgtgacacggacttgtca

SEQ ID NO: 976358 - DNA, 25 bp, Mus musculus
tgataaatgtgacagggacttgtca

SEQ ID NO: 976359 - DNA, 25 bp, Mus musculus
tgataacaatgtatcgcaatcgcat

SEQ ID NO: 976360 - DNA, 25 bp, Mus musculus
tgataacaatgtatggcaatcgcat

SEQ ID NO: 976361 - DNA, 25 bp, Mus musculus
tgataacactcaagtaatccctcca

SEQ ID NO: 976362 - DNA, 25 bp, Mus musculus
tgataacactgaagtaatccctcca

SEQ ID NO: 976363 - DNA, 25 bp, Mus musculus
tgataacggagttgctgaatgatac

SEQ ID NO: 976364 - DNA, 25 bp, Mus musculus
tgataacggagttggtgaatgatac

SEQ ID NO: 976365 - DNA, 25 bp, Mus musculus
tgataagaataactttcccggagat

SEQ ID NO: 976366 - DNA, 25 bp, Mus musculus
tgataagaataagtttcccggagat

SEQ ID NO: 976367 - DNA, 25 bp, Mus musculus
tgataagctgaatgatatggaacct

SEQ ID NO: 976368 - DNA, 25 bp, Mus musculus
tgataagctgcgtaaaactccacca

SEQ ID NO: 976369 - DNA, 25 bp, Mus musculus
tgataagctgggtaaaactccacca

SEQ ID NO: 976370 - DNA, 25 bp, Mus musculus
tgataagctgtatgatatggaacct

SEQ ID NO: 976371 - DNA, 25 bp, Mus musculus
tgataagtaactatcttttagagaa

SEQ ID NO: 976372 - DNA, 25 bp, Mus musculus
tgataagtaactttcttttagagaa

SEQ ID NO: 976373 - DNA, 25 bp, Mus musculus
tgataataagattctgagggtcagg

SEQ ID NO: 976374 - DNA, 25 bp, Mus musculus
tgataataagcacaaccggatccag

SEQ ID NO: 976375 - DNA, 25 bp, Mus musculus
tgataataaggacaaccggatccag

SEQ ID NO: 976376 - DNA, 25 bp, Mus musculus
tgataataagtttctgagggtcagg

SEQ ID NO: 976377 - DNA, 25 bp, Mus musculus
tgataataccagcattgtctacaac

SEQ ID NO: 976378 - DNA, 25 bp, Mus musculus
tgataataccaggattgtctacaac

SEQ ID NO: 976379 - DNA, 25 bp, Mus musculus
tgataatctacacgtgaacagatgc

SEQ ID NO: 976380 - DNA, 25 bp, Mus musculus
tgataatctagacgtgaacagatgc

SEQ ID NO: 976381 - DNA, 25 bp, Mus musculus
tgataattcagacgtcagaaatacc

SEQ ID NO: 976382 - DNA, 25 bp, Mus musculus
tgataattcagaggtcagaaatacc

SEQ ID NO: 976383 - DNA, 25 bp, Mus musculus
tgataccacactgctgctgcctccg

SEQ ID NO: 976384 - DNA, 25 bp, Mus musculus
tgataccacagtgctgctgcctccg

SEQ ID NO: 976385 - DNA, 25 bp, Mus musculus
tgatacctgaccaccgtgattggga

SEQ ID NO: 976386 - DNA, 25 bp, Mus musculus
tgatacctgaccaccgtttggctcc

SEQ ID NO: 976387 - DNA, 25 bp, Mus musculus
tgatacctgaccacggtgattggga

SEQ ID NO: 976388 - DNA, 25 bp, Mus musculus
tgatacctgaccacggtttggctcc

SEQ ID NO: 976389 - DNA, 25 bp, Mus musculus
tgatactctactagaacttggagaa

SEQ ID NO: 976390 - DNA, 25 bp, Mus musculus
tgatactctacttgaacttggagaa

SEQ ID NO: 976391 - DNA, 25 bp, Mus musculus
tgatagaaacctcaaaacacaggca

SEQ ID NO: 976392 - DNA, 25 bp, Mus musculus
tgatagaaacctgaaaacacaggca

SEQ ID NO: 976393 - DNA, 25 bp, Mus musculus
tgatagtcacagagctctttgctgt

SEQ ID NO: 976394 - DNA, 25 bp, Mus musculus
tgatagtcacagtgctctttgctgt

SEQ ID NO: 976395 - DNA, 25 bp, Mus musculus
tgatagtctgaccaaccgcaccctt

SEQ ID NO: 976396 - DNA, 25 bp, Mus musculus
tgatagtctgtccaaccgcaccctt

SEQ ID NO: 976397 - DNA, 25 bp, Mus musculus
tgatatacatagcgccttcaagagg

SEQ ID NO: 976398 - DNA, 25 bp, Mus musculus
tgatatacatagggccttcaagagg

SEQ ID NO: 976399 - DNA, 25 bp, Mus musculus
tgatatacccagatccagacttcag

SEQ ID NO: 976400 - DNA, 25 bp, Mus musculus
tgatatacccagttccagacttcag

SEQ ID NO: 976401 - DNA, 25 bp, Mus musculus
tgatatcaacaacgttgtgctgtgt

SEQ ID NO: 976402 - DNA, 25 bp, Mus musculus
tgatatcaacaaggttgtgctgtgt

SEQ ID NO: 976403 - DNA, 25 bp, Mus musculus
tgatatctcttaccaggaaagatgg

SEQ ID NO: 976404 - DNA, 25 bp, Mus musculus
tgatatctcttacgaaagatggtcc

SEQ ID NO: 976405 - DNA, 25 bp, Mus musculus
tgatatctcttagcaggaaagatgg

SEQ ID NO: 976406 - DNA, 25 bp, Mus musculus
tgatatctcttaggaaagatggtcc

SEQ ID NO: 976407 - DNA, 25 bp, Mus musculus
tgatatctggaacacggtcgaacct

SEQ ID NO: 976408 - DNA, 25 bp, Mus musculus
tgatatctggaacagggtcgaacct

SEQ ID NO: 976409 - DNA, 25 bp, Mus musculus
tgatatgcagattgacaacaagtcc

SEQ ID NO: 976410 - DNA, 25 bp, Mus musculus
tgatatgcagctgacgcgtaagttg

SEQ ID NO: 976411 - DNA, 25 bp, Mus musculus
tgatatgcagctgactccacgtgaa

SEQ ID NO: 976412 - DNA, 25 bp, Mus musculus
tgatatgcagctgaggcgtaagttg

SEQ ID NO: 976413 - DNA, 25 bp, Mus musculus
tgatatgcagctgagtccacgtgaa

SEQ ID NO: 976414 - DNA, 25 bp, Mus musculus
tgatatgcagtttgacaacaagtcc

SEQ ID NO: 976415 - DNA, 25 bp, Mus musculus
tgatatggacagcggatagcccacc

SEQ ID NO: 976416 - DNA, 25 bp, Mus musculus
tgatatggacaggggatagcccacc

SEQ ID NO: 976417 - DNA, 25 bp, Mus musculus
tgatattagtagactgccctgctca

SEQ ID NO: 976418 - DNA, 25 bp, Mus musculus
tgatattagtagtctgccctgctca

SEQ ID NO: 976419 - DNA, 25 bp, Mus musculus
tgatattggtcatgtaaccattact

SEQ ID NO: 976420 - DNA, 25 bp, Mus musculus
tgatattggtgatgtaaccattact

SEQ ID NO: 976421 - DNA, 25 bp, Mus musculus
tgatatttctgacgctgttatccag

SEQ ID NO: 976422 - DNA, 25 bp, Mus musculus
tgatatttctgaggctgttatccag

SEQ ID NO: 976423 - DNA, 25 bp, Mus musculus
tgatcaaagcagtccggcatgagga

SEQ ID NO: 976424 - DNA, 25 bp, Mus musculus
tgatcaaagcagtcgggcatgagga

SEQ ID NO: 976425 - DNA, 25 bp, Mus musculus
tgatcaacagctctccattttgaca

SEQ ID NO: 976426 - DNA, 25 bp, Mus musculus
tgatcaacaggtctccattttgaca

SEQ ID NO: 976427 - DNA, 25 bp, Mus musculus
tgatcaatggatctccctgccagca

SEQ ID NO: 976428 - DNA, 25 bp, Mus musculus
tgatcaatggttctccctgccagca

SEQ ID NO: 976429 - DNA, 25 bp, Mus musculus
tgatcaattgctcacgaaactcaca

SEQ ID NO: 976430 - DNA, 25 bp, Mus musculus
tgatcaattgctcaggaaactcaca

SEQ ID NO: 976431 - DNA, 25 bp, Mus musculus
tgatcacggcctaccctggatgagc

SEQ ID NO: 976432 - DNA, 25 bp, Mus musculus
tgatcacggccttccctggatgagc

SEQ ID NO: 976433 - DNA, 25 bp, Mus musculus
tgatcagcagagtgaaatggttaag

SEQ ID NO: 976434 - DNA, 25 bp, Mus musculus
tgatcagcagtgtgaaatggttaag

SEQ ID NO: 976435 - DNA, 25 bp, Mus musculus
tgatcaggtccacggcaatggcagc

SEQ ID NO: 976436 - DNA, 25 bp, Mus musculus
tgatcaggtccagggcaatggcagc

SEQ ID NO: 976437 - DNA, 25 bp, Mus musculus
tgatcatcccagcctatgggaaggt

SEQ ID NO: 976438 - DNA, 25 bp, Mus musculus
tgatcatcccaggctatgggaaggt

SEQ ID NO: 976439 - DNA, 25 bp, Mus musculus
tgatcatctcactgacaatttagag

SEQ ID NO: 976440 - DNA, 25 bp, Mus musculus
tgatcatctcactgtcaatttagag

SEQ ID NO: 976441 - DNA, 25 bp, Mus musculus
tgatcatgatgatgccttcctctcc

SEQ ID NO: 976442 - DNA, 25 bp, Mus musculus
tgatcatgatgatggcttcctctcc

SEQ ID NO: 976443 - DNA, 25 bp, Mus musculus
tgatcattggctattctaccatcta

SEQ ID NO: 976444 - DNA, 25 bp, Mus musculus
tgatcattgggtattctaccatcta

SEQ ID NO: 976445 - DNA, 25 bp, Mus musculus
tgatccatgaaccacaacctcacat

SEQ ID NO: 976446 - DNA, 25 bp, Mus musculus
tgatccatgaaccagaacctcacat

SEQ ID NO: 976447 - DNA, 25 bp, Mus musculus
tgatccccaatgaggaaaccatcct

SEQ ID NO: 976448 - DNA, 25 bp, Mus musculus
tgatccccaatgtggaaaccatcct

SEQ ID NO: 976449 - DNA, 25 bp, Mus musculus
tgatccccacagcagaaatgctctt

SEQ ID NO: 976450 - DNA, 25 bp, Mus musculus
tgatccccacagctgatggacagaa

SEQ ID NO: 976451 - DNA, 25 bp, Mus musculus
tgatccccacaggagaaatgctctt

SEQ ID NO: 976452 - DNA, 25 bp, Mus musculus
tgatccccacaggtgatggacagaa

SEQ ID NO: 976453 - DNA, 25 bp, Mus musculus
tgatcccccagacaggccaggctgg

SEQ ID NO: 976454 - DNA, 25 bp, Mus musculus
tgatcccccagacagtcatggacca

SEQ ID NO: 976455 - DNA, 25 bp, Mus musculus
tgatcccccagagaggccaggctgg

SEQ ID NO: 976456 - DNA, 25 bp, Mus musculus
tgatcccccagagagtcatggacca

SEQ ID NO: 976457 - DNA, 25 bp, Mus musculus
tgatccccgcagttcgcctgaatgt

SEQ ID NO: 976458 - DNA, 25 bp, Mus musculus
tgatccccgcagttggcctgaatgt

SEQ ID NO: 976459 - DNA, 25 bp, Mus musculus
tgatccccggacaactggggcattc

SEQ ID NO: 976460 - DNA, 25 bp, Mus musculus
tgatccccggtcaactggggcattc

SEQ ID NO: 976461 - DNA, 25 bp, Mus musculus
tgatccggcacaaacgaacctacct

SEQ ID NO: 976462 - DNA, 25 bp, Mus musculus
tgatccggcacaaaggaacctacct

SEQ ID NO: 976463 - DNA, 25 bp, Mus musculus
tgatcctaaccacctaagatggaaa

SEQ ID NO: 976464 - DNA, 25 bp, Mus musculus
tgatcctaaccagctaagatggaaa

SEQ ID NO: 976465 - DNA, 25 bp, Mus musculus
tgatcctactgtgcaggactctagg

SEQ ID NO: 976466 - DNA, 25 bp, Mus musculus
tgatcctactgtgctggactctagg

SEQ ID NO: 976467 - DNA, 25 bp, Mus musculus
tgatcctgaaaatacaattgccaag

SEQ ID NO: 976468 - DNA, 25 bp, Mus musculus
tgatcctgaaaatagaattgccaag

SEQ ID NO: 976469 - DNA, 25 bp, Mus musculus
tgatcctgacgacggcatccgtttc

SEQ ID NO: 976470 - DNA, 25 bp, Mus musculus
tgatcctgacgagggcatccgtttc

SEQ ID NO: 976471 - DNA, 25 bp, Mus musculus
tgatcctgtcctctaatagctcctt

SEQ ID NO: 976472 - DNA, 25 bp, Mus musculus
tgatcctgtcctcttatagctcctt

SEQ ID NO: 976473 - DNA, 25 bp, Mus musculus
tgatccttcaaggcagtgaagaagc

SEQ ID NO: 976474 - DNA, 25 bp, Mus musculus
tgatccttcatggcagtgaagaagc

SEQ ID NO: 976475 - DNA, 25 bp, Mus musculus
tgatcgccgccttcagtcactgcac

SEQ ID NO: 976476 - DNA, 25 bp, Mus musculus
tgatcgccgccttctgtcactgcac

SEQ ID NO: 976477 - DNA, 25 bp, Mus musculus
tgatcggatgggccatccccagtgt

SEQ ID NO: 976478 - DNA, 25 bp, Mus musculus
tgatcggatggggcatccccagtgt

SEQ ID NO: 976479 - DNA, 25 bp, Mus musculus
tgatcgtaaagtctttgttggacga

SEQ ID NO: 976480 - DNA, 25 bp, Mus musculus
tgatcgtaaagtgtttgttggacga

SEQ ID NO: 976481 - DNA, 25 bp, Mus musculus
tgatcgtaggcactgggctcattgg

SEQ ID NO: 976482 - DNA, 25 bp, Mus musculus
tgatcgtaggcagtgggctcattgg

SEQ ID NO: 976483 - DNA, 25 bp, Mus musculus
tgatcgtcacccacagcaatgagag

SEQ ID NO: 976484 - DNA, 25 bp, Mus musculus
tgatcgtcacccactgcaatgagag

SEQ ID NO: 976485 - DNA, 25 bp, Mus musculus
tgatcgtgtacacggtgaagttgat

SEQ ID NO: 976486 - DNA, 25 bp, Mus musculus
tgatcgtgtacagggtgaagttgat

SEQ ID NO: 976487 - DNA, 25 bp, Mus musculus
tgatcgttagcactggagagagctc

SEQ ID NO: 976488 - DNA, 25 bp, Mus musculus
tgatcgttaggactggagagagctc

SEQ ID NO: 976489 - DNA, 25 bp, Mus musculus
tgatcgttttataacagagcagtat

SEQ ID NO: 976490 - DNA, 25 bp, Mus musculus
tgatcgttttataagagagcagtat

SEQ ID NO: 976491 - DNA, 25 bp, Mus musculus
tgatctaatgaacgtatttaatgat

SEQ ID NO: 976492 - DNA, 25 bp, Mus musculus
tgatctaatgaaggtatttaatgat

SEQ ID NO: 976493 - DNA, 25 bp, Mus musculus
tgatctacactgttcttggccgccc

SEQ ID NO: 976494 - DNA, 25 bp, Mus musculus
tgatctacactgttgttggccgccc

SEQ ID NO: 976495 - DNA, 25 bp, Mus musculus
tgatctacagaactcgttatgggag

SEQ ID NO: 976496 - DNA, 25 bp, Mus musculus
tgatctacagtactcgttatgggag

SEQ ID NO: 976497 - DNA, 25 bp, Mus musculus
tgatctcagagacacgaaacctatt

SEQ ID NO: 976498 - DNA, 25 bp, Mus musculus
tgatctcagagacaggaaacctatt

SEQ ID NO: 976499 - DNA, 25 bp, Mus musculus
tgatctcagggagtcgtggccgcac

SEQ ID NO: 976500 - DNA, 25 bp, Mus musculus
tgatctcagggagtggtggccgcac

SEQ ID NO: 976501 - DNA, 25 bp, Mus musculus
tgatctccatagagaaaacacgaga

SEQ ID NO: 976502 - DNA, 25 bp, Mus musculus
tgatctccatagtgaaaacacgaga

SEQ ID NO: 976503 - DNA, 25 bp, Mus musculus
tgatctgaccaacgtttggcctcac

SEQ ID NO: 976504 - DNA, 25 bp, Mus musculus
tgatctgaccaaggtttggcctcac

SEQ ID NO: 976505 - DNA, 25 bp, Mus musculus
tgatctgcaagctgcatgataagga

SEQ ID NO: 976506 - DNA, 25 bp, Mus musculus
tgatctgcaagctggatgataagga

SEQ ID NO: 976507 - DNA, 25 bp, Mus musculus
tgatctgcggcggtcagggaaactg

SEQ ID NO: 976508 - DNA, 25 bp, Mus musculus
tgatctgcgggggtcagggaaactg

SEQ ID NO: 976509 - DNA, 25 bp, Mus musculus
tgatctggagcagcagcctcagggc

SEQ ID NO: 976510 - DNA, 25 bp, Mus musculus
tgatctggagcagctgcctcagggc

SEQ ID NO: 976511 - DNA, 25 bp, Mus musculus
tgatcttcagggcgtgattagtgtt

SEQ ID NO: 976512 - DNA, 25 bp, Mus musculus
tgatcttcagggggtgattagtgtt

SEQ ID NO: 976513 - DNA, 25 bp, Mus musculus
tgatcttgctattgaagtggacctt

SEQ ID NO: 976514 - DNA, 25 bp, Mus musculus
tgatcttgcttttgaagtggacctt

SEQ ID NO: 976515 - DNA, 25 bp, Mus musculus
tgatctttccaaaaccaactgcttt

SEQ ID NO: 976516 - DNA, 25 bp, Mus musculus
tgatctttccaaaacctcctgggac

SEQ ID NO: 976517 - DNA, 25 bp, Mus musculus
tgatctttccaaaagcaactgcttt

SEQ ID NO: 976518 - DNA, 25 bp, Mus musculus
tgatctttccaaaagctcctgggac

SEQ ID NO: 976519 - DNA, 25 bp, Mus musculus
tgatctttccagaacggaagcaaaa

SEQ ID NO: 976520 - DNA, 25 bp, Mus musculus
tgatctttccagaagggaagcaaaa

SEQ ID NO: 976521 - DNA, 25 bp, Mus musculus
tgatgaaaatcgagtgctgaaagga

SEQ ID NO: 976522 - DNA, 25 bp, Mus musculus
tgatgaaaatggagtgctgaaagga

SEQ ID NO: 976523 - DNA, 25 bp, Mus musculus
tgatgaaacaagccgactgctggat

SEQ ID NO: 976524 - DNA, 25 bp, Mus musculus
tgatgaaacaaggcgactgctggat

SEQ ID NO: 976525 - DNA, 25 bp, Mus musculus
tgatgaaagcagaggtccatgccgt

SEQ ID NO: 976526 - DNA, 25 bp, Mus musculus
tgatgaaagcagccatgtactcggt

SEQ ID NO: 976527 - DNA, 25 bp, Mus musculus
tgatgaaagcaggcatgtactcggt

SEQ ID NO: 976528 - DNA, 25 bp, Mus musculus
tgatgaaagcagtggtccatgccgt

SEQ ID NO: 976529 - DNA, 25 bp, Mus musculus
tgatgaagaacgagaaagtcatgcc

SEQ ID NO: 976530 - DNA, 25 bp, Mus musculus
tgatgaagaacgtgaaagtcatgcc

SEQ ID NO: 976531 - DNA, 25 bp, Mus musculus
tgatgaagagagatacaactcagtg

SEQ ID NO: 976532 - DNA, 25 bp, Mus musculus
tgatgaagagagttacaactcagtg

SEQ ID NO: 976533 - DNA, 25 bp, Mus musculus
tgatgaagagcacaactttctacaa

SEQ ID NO: 976534 - DNA, 25 bp, Mus musculus
tgatgaagagcagaactttctacaa

SEQ ID NO: 976535 - DNA, 25 bp, Mus musculus
tgatgaagcatgcgcatccccggat

SEQ ID NO: 976536 - DNA, 25 bp, Mus musculus
tgatgaagcatgcgctttctgatgt

SEQ ID NO: 976537 - DNA, 25 bp, Mus musculus
tgatgaagcatgcggatccccggat

SEQ ID NO: 976538 - DNA, 25 bp, Mus musculus
tgatgaagcatgcggtttctgatgt

SEQ ID NO: 976539 - DNA, 25 bp, Mus musculus
tgatgaagtgcacctgacatcagcc

SEQ ID NO: 976540 - DNA, 25 bp, Mus musculus
tgatgaagtggacctgacatcagcc

SEQ ID NO: 976541 - DNA, 25 bp, Mus musculus
tgatgaatatgaaaatgaaacattt

SEQ ID NO: 976542 - DNA, 25 bp, Mus musculus
tgatgaatatgataatgaaacattt

SEQ ID NO: 976543 - DNA, 25 bp, Mus musculus
tgatgaatgacgaataggtgaaggg

SEQ ID NO: 976544 - DNA, 25 bp, Mus musculus
tgatgaatgacgtataggtgaaggg

SEQ ID NO: 976545 - DNA, 25 bp, Mus musculus
tgatgaccagcattacttacactcg

SEQ ID NO: 976546 - DNA, 25 bp, Mus musculus
tgatgaccaggattacttacactcg

SEQ ID NO: 976547 - DNA, 25 bp, Mus musculus
tgatgaccatactgtctgcctgtgg

SEQ ID NO: 976548 - DNA, 25 bp, Mus musculus
tgatgaccattctgtctgcctgtgg

SEQ ID NO: 976549 - DNA, 25 bp, Mus musculus
tgatgacccactcttatctcctctg

SEQ ID NO: 976550 - DNA, 25 bp, Mus musculus
tgatgacccagtcttatctcctctg

SEQ ID NO: 976551 - DNA, 25 bp, Mus musculus
tgatgacgatggaccgtgccacagg

SEQ ID NO: 976552 - DNA, 25 bp, Mus musculus
tgatgacgatggactcccttctcag

SEQ ID NO: 976553 - DNA, 25 bp, Mus musculus
tgatgacgatggatccgtgccacag

SEQ ID NO: 976554 - DNA, 25 bp, Mus musculus
tgatgacgatggtccgtgccacagg

SEQ ID NO: 976555 - DNA, 25 bp, Mus musculus
tgatgacgatggtctcccttctcag

SEQ ID NO: 976556 - DNA, 25 bp, Mus musculus
tgatgacgatggttccgtgccacag

SEQ ID NO: 976557 - DNA, 25 bp, Mus musculus
tgatgagaacatcagcacctgcgac

SEQ ID NO: 976558 - DNA, 25 bp, Mus musculus
tgatgagaacatgagcacctgcgac

SEQ ID NO: 976559 - DNA, 25 bp, Mus musculus
tgatgagagtgagacaggtatgaag

SEQ ID NO: 976560 - DNA, 25 bp, Mus musculus
tgatgagagtgagagaggtatgaag

SEQ ID NO: 976561 - DNA, 25 bp, Mus musculus
tgatgagcagagattctgcaacgta

SEQ ID NO: 976562 - DNA, 25 bp, Mus musculus
tgatgagcagtgattctgcaacgta

SEQ ID NO: 976563 - DNA, 25 bp, Mus musculus
tgatgagctcaacggtttagcctgg

SEQ ID NO: 976564 - DNA, 25 bp, Mus musculus
tgatgagctcaactctgaagtgtcc

SEQ ID NO: 976565 - DNA, 25 bp, Mus musculus
tgatgagctcaagggtttagcctgg

SEQ ID NO: 976566 - DNA, 25 bp, Mus musculus
tgatgagctcaagtctgaagtgtcc

SEQ ID NO: 976567 - DNA, 25 bp, Mus musculus
tgatgaggagcacactttcctgcag

SEQ ID NO: 976568 - DNA, 25 bp, Mus musculus
tgatgaggagcagactttcctgcag

SEQ ID NO: 976569 - DNA, 25 bp, Mus musculus
tgatgaggcgaacgaaagctcacaa

SEQ ID NO: 976570 - DNA, 25 bp, Mus musculus
tgatgaggcgaaggaaagctcacaa

SEQ ID NO: 976571 - DNA, 25 bp, Mus musculus
tgatgagggcagcttgatgctggag

SEQ ID NO: 976572 - DNA, 25 bp, Mus musculus
tgatgagggcaggttgatgctggag

SEQ ID NO: 976573 - DNA, 25 bp, Mus musculus
tgatgagggtaactatcagatggag

SEQ ID NO: 976574 - DNA, 25 bp, Mus musculus
tgatgagggtaagtatcagatggag

SEQ ID NO: 976575 - DNA, 25 bp, Mus musculus
tgatgagtaacgcgccggtttcagt

SEQ ID NO: 976576 - DNA, 25 bp, Mus musculus
tgatgagtaacgggccggtttcagt

SEQ ID NO: 976577 - DNA, 25 bp, Mus musculus
tgatgagtctgctgcatctaaataa

SEQ ID NO: 976578 - DNA, 25 bp, Mus musculus
tgatgagtctgctggatctaaataa

SEQ ID NO: 976579 - DNA, 25 bp, Mus musculus
tgatgatccacacacagaatttggt

SEQ ID NO: 976580 - DNA, 25 bp, Mus musculus
tgatgatccacagacagaatttggt

SEQ ID NO: 976581 - DNA, 25 bp, Mus musculus
tgatgatctaatggatgatacatgg

SEQ ID NO: 976582 - DNA, 25 bp, Mus musculus
tgatgatctattggatgatacatgg

SEQ ID NO: 976583 - DNA, 25 bp, Mus musculus
tgatgatgacaccaagtccaagtgg

SEQ ID NO: 976584 - DNA, 25 bp, Mus musculus
tgatgatgacacgaagtccaagtgg

SEQ ID NO: 976585 - DNA, 25 bp, Mus musculus
tgatgatgatcgtatatttgtaaca

SEQ ID NO: 976586 - DNA, 25 bp, Mus musculus
tgatgatgatgacacgaagtccaag

SEQ ID NO: 976587 - DNA, 25 bp, Mus musculus
tgatgatgatgacaggaagtccaag

SEQ ID NO: 976588 - DNA, 25 bp, Mus musculus
tgatgatgatggtatatttgtaaca

SEQ ID NO: 976589 - DNA, 25 bp, Mus musculus
tgatgatgcgggatgctgggatatg

SEQ ID NO: 976590 - DNA, 25 bp, Mus musculus
tgatgatgcgggttgctgggatatg

SEQ ID NO: 976591 - DNA, 25 bp, Mus musculus
tgatgcaaagatccaggtgttcctg

SEQ ID NO: 976592 - DNA, 25 bp, Mus musculus
tgatgcaaagttccaggtgttcctg

SEQ ID NO: 976593 - DNA, 25 bp, Mus musculus
tgatgcaaatagccagccgagagac

SEQ ID NO: 976594 - DNA, 25 bp, Mus musculus
tgatgcaaataggcagccgagagac

SEQ ID NO: 976595 - DNA, 25 bp, Mus musculus
tgatgcacatacggaaagcaatcat

SEQ ID NO: 976596 - DNA, 25 bp, Mus musculus
tgatgcacattcggaaagcaatcat

SEQ ID NO: 976597 - DNA, 25 bp, Mus musculus
tgatgcaccgagacatcaagcccgc

SEQ ID NO: 976598 - DNA, 25 bp, Mus musculus
tgatgcaccgagtcatcaagcccgc

SEQ ID NO: 976599 - DNA, 25 bp, Mus musculus
tgatgcagatctgctttgtctacag

SEQ ID NO: 976600 - DNA, 25 bp, Mus musculus
tgatgcagatgtgctttgtctacag

SEQ ID NO: 976601 - DNA, 25 bp, Mus musculus
tgatgcagctcacaagcagatccag

SEQ ID NO: 976602 - DNA, 25 bp, Mus musculus
tgatgcagctcagaagcagatccag

SEQ ID NO: 976603 - DNA, 25 bp, Mus musculus
tgatgcagtgcacgcaatacagagt

SEQ ID NO: 976604 - DNA, 25 bp, Mus musculus
tgatgcagtgcaggcaatacagagt

SEQ ID NO: 976605 - DNA, 25 bp, Mus musculus
tgatgccaagaaacggccatcgttc

SEQ ID NO: 976606 - DNA, 25 bp, Mus musculus
tgatgccaagtaacggccatcgttc

SEQ ID NO: 976607 - DNA, 25 bp, Mus musculus
tgatgccatgattaacaacaacctc

SEQ ID NO: 976608 - DNA, 25 bp, Mus musculus
tgatgccatgtttaacaacaacctc

SEQ ID NO: 976609 - DNA, 25 bp, Mus musculus
tgatgcccagaaggtgaccgagggt

SEQ ID NO: 976610 - DNA, 25 bp, Mus musculus
tgatgcccagacttaccatgagcgg

SEQ ID NO: 976611 - DNA, 25 bp, Mus musculus
tgatgcccagcacttagaagagttc

SEQ ID NO: 976612 - DNA, 25 bp, Mus musculus
tgatgcccaggacttagaagagttc

SEQ ID NO: 976613 - DNA, 25 bp, Mus musculus
tgatgcccagtaggtgaccgagggt

SEQ ID NO: 976614 - DNA, 25 bp, Mus musculus
tgatgcccagtcttaccatgagcgg

SEQ ID NO: 976615 - DNA, 25 bp, Mus musculus
tgatgccccaggaaacacaattaga

SEQ ID NO: 976616 - DNA, 25 bp, Mus musculus
tgatgccccaggtaacacaattaga

SEQ ID NO: 976617 - DNA, 25 bp, Mus musculus
tgatgcctgcataacgttataagta

SEQ ID NO: 976618 - DNA, 25 bp, Mus musculus
tgatgcctgcataactgagcaactg

SEQ ID NO: 976619 - DNA, 25 bp, Mus musculus
tgatgcctgcataaggttataagta

SEQ ID NO: 976620 - DNA, 25 bp, Mus musculus
tgatgcctgcataagtgagcaactg

SEQ ID NO: 976621 - DNA, 25 bp, Mus musculus
tgatgcggaaaaccacttcatcaaa

SEQ ID NO: 976622 - DNA, 25 bp, Mus musculus
tgatgcggaaaacctcttcatcaaa

SEQ ID NO: 976623 - DNA, 25 bp, Mus musculus
tgatgcgttgcaccccagcagctgc

SEQ ID NO: 976624 - DNA, 25 bp, Mus musculus
tgatgcgttggaccccagcagctgc

SEQ ID NO: 976625 - DNA, 25 bp, Mus musculus
tgatgctaagcgagacagtgaggac

SEQ ID NO: 976626 - DNA, 25 bp, Mus musculus
tgatgctaagggagacagtgaggac

SEQ ID NO: 976627 - DNA, 25 bp, Mus musculus
tgatgctaatgtgacttccaacgag

SEQ ID NO: 976628 - DNA, 25 bp, Mus musculus
tgatgctaatgtgagttccaacgag

SEQ ID NO: 976629 - DNA, 25 bp, Mus musculus
tgatgctcaagcaacgagcagactc

SEQ ID NO: 976630 - DNA, 25 bp, Mus musculus
tgatgctcaagcaaggagcagactc

SEQ ID NO: 976631 - DNA, 25 bp, Mus musculus
tgatgctgagagaatggtcaagaat

SEQ ID NO: 976632 - DNA, 25 bp, Mus musculus
tgatgctgagtgaatggtcaagaat

SEQ ID NO: 976633 - DNA, 25 bp, Mus musculus
tgatgcttgacccctcgatgggttc

SEQ ID NO: 976634 - DNA, 25 bp, Mus musculus
tgatgcttgagccctcgatgggttc

SEQ ID NO: 976635 - DNA, 25 bp, Mus musculus
tgatggaaagcacgtcacctgtctc

SEQ ID NO: 976636 - DNA, 25 bp, Mus musculus
tgatggaaagcaggtcacctgtctc

SEQ ID NO: 976637 - DNA, 25 bp, Mus musculus
tgatggaagaacaggagaagctgca

SEQ ID NO: 976638 - DNA, 25 bp, Mus musculus
tgatggaagaactggagaagctgca

SEQ ID NO: 976639 - DNA, 25 bp, Mus musculus
tgatggacagccctgggatcgatgt

SEQ ID NO: 976640 - DNA, 25 bp, Mus musculus
tgatggacaggcctgggatcgatgt

SEQ ID NO: 976641 - DNA, 25 bp, Mus musculus
tgatggcaacccaggtctcccggga

SEQ ID NO: 976642 - DNA, 25 bp, Mus musculus
tgatggcaaccctggtctcccggga

SEQ ID NO: 976643 - DNA, 25 bp, Mus musculus
tgatggcaagagctacagcagcggt

SEQ ID NO: 976644 - DNA, 25 bp, Mus musculus
tgatggcaagaggtacagcagcggt

SEQ ID NO: 976645 - DNA, 25 bp, Mus musculus
tgatggcaagatcttctgtgtgcat

SEQ ID NO: 976646 - DNA, 25 bp, Mus musculus
tgatggcaagcgtcatgtgggtaca

SEQ ID NO: 976647 - DNA, 25 bp, Mus musculus
tgatggcaagctgctgtctgaaacc

SEQ ID NO: 976648 - DNA, 25 bp, Mus musculus
tgatggcaagggtcatgtgggtaca

SEQ ID NO: 976649 - DNA, 25 bp, Mus musculus
tgatggcaaggtgctgtctgaaacc

SEQ ID NO: 976650 - DNA, 25 bp, Mus musculus
tgatggcaagttcttctgtgtgcat

SEQ ID NO: 976651 - DNA, 25 bp, Mus musculus
tgatggcaatgccacgtggcccaga

SEQ ID NO: 976652 - DNA, 25 bp, Mus musculus
tgatggcaatgccacgttgaacgac

SEQ ID NO: 976653 - DNA, 25 bp, Mus musculus
tgatggcaatgccaggtggcccaga

SEQ ID NO: 976654 - DNA, 25 bp, Mus musculus
tgatggcaatgccaggttgaacgac

SEQ ID NO: 976655 - DNA, 25 bp, Mus musculus
tgatggcatgggctatggcgactac

SEQ ID NO: 976656 - DNA, 25 bp, Mus musculus
tgatggcatggggtatggcgactac

SEQ ID NO: 976657 - DNA, 25 bp, Mus musculus
tgatggccagactctgtttgctggc

SEQ ID NO: 976658 - DNA, 25 bp, Mus musculus
tgatggccagattttcatttatgat

SEQ ID NO: 976659 - DNA, 25 bp, Mus musculus
tgatggccagtctctgtttgctggc

SEQ ID NO: 976660 - DNA, 25 bp, Mus musculus
tgatggccagtttttcatttatgat

SEQ ID NO: 976661 - DNA, 25 bp, Mus musculus
tgatggccggcaaattgtcttctac

SEQ ID NO: 976662 - DNA, 25 bp, Mus musculus
tgatggccgggaaattgtcttctac

SEQ ID NO: 976663 - DNA, 25 bp, Mus musculus
tgatggctattccgagaataatgtt

SEQ ID NO: 976664 - DNA, 25 bp, Mus musculus
tgatggctattcggagaataatgtt

SEQ ID NO: 976665 - DNA, 25 bp, Mus musculus
tgatggctgcatcaccatctctgct

SEQ ID NO: 976666 - DNA, 25 bp, Mus musculus
tgatggctgcatcagcatctctgct

SEQ ID NO: 976667 - DNA, 25 bp, Mus musculus
tgatggcttgcacgggtcaagtcat

SEQ ID NO: 976668 - DNA, 25 bp, Mus musculus
tgatggcttgcaggggtcaagtcat

SEQ ID NO: 976669 - DNA, 25 bp, Mus musculus
tgatgggaagctatggatgtattgt

SEQ ID NO: 976670 - DNA, 25 bp, Mus musculus
tgatgggaaggtatggatgtattgt

SEQ ID NO: 976671 - DNA, 25 bp, Mus musculus
tgatgggagacacaaagatgtagac

SEQ ID NO: 976672 - DNA, 25 bp, Mus musculus
tgatgggagacagaaagatgtagac

SEQ ID NO: 976673 - DNA, 25 bp, Mus musculus
tgatgggatgcacacacctctgggg

SEQ ID NO: 976674 - DNA, 25 bp, Mus musculus
tgatgggatggacacacctctgggg

SEQ ID NO: 976675 - DNA, 25 bp, Mus musculus
tgatgggcagcacagcgactccgac

SEQ ID NO: 976676 - DNA, 25 bp, Mus musculus
tgatgggcaggacagcgactccgac

SEQ ID NO: 976677 - DNA, 25 bp, Mus musculus
tgatggggagctgtttgcctggggt

SEQ ID NO: 976678 - DNA, 25 bp, Mus musculus
tgatggggaggtgtttgcctggggt

SEQ ID NO: 976679 - DNA, 25 bp, Mus musculus
tgatggtcagcaagcctgctgcgtg

SEQ ID NO: 976680 - DNA, 25 bp, Mus musculus
tgatggtcagctctgacggagtccc

SEQ ID NO: 976681 - DNA, 25 bp, Mus musculus
tgatggtcaggaagcctgctgcgtg

SEQ ID NO: 976682 - DNA, 25 bp, Mus musculus
tgatggtcaggtctgacggagtccc

SEQ ID NO: 976683 - DNA, 25 bp, Mus musculus
tgatggtgaccccgacaaggtgcag

SEQ ID NO: 976684 - DNA, 25 bp, Mus musculus
tgatggtgacccggacaaggtgcag

SEQ ID NO: 976685 - DNA, 25 bp, Mus musculus
tgatggtgagctctagtgacaggat

SEQ ID NO: 976686 - DNA, 25 bp, Mus musculus
tgatggtgaggtctagtgacaggat

SEQ ID NO: 976687 - DNA, 25 bp, Mus musculus
tgatggtgttactaagcttcctgtg

SEQ ID NO: 976688 - DNA, 25 bp, Mus musculus
tgatggtgttactatgcttcctgtg

SEQ ID NO: 976689 - DNA, 25 bp, Mus musculus
tgatgtacagcagggcacgagtgga

SEQ ID NO: 976690 - DNA, 25 bp, Mus musculus
tgatgtacaggagggcacgagtgga

SEQ ID NO: 976691 - DNA, 25 bp, Mus musculus
tgatgtatacagcttcgccattgtg

SEQ ID NO: 976692 - DNA, 25 bp, Mus musculus
tgatgtatacaggttcgccattgtg

SEQ ID NO: 976693 - DNA, 25 bp, Mus musculus
tgatgtatcaggctaagacatacaa

SEQ ID NO: 976694 - DNA, 25 bp, Mus musculus
tgatgtatcagggtaagacatacaa

SEQ ID NO: 976695 - DNA, 25 bp, Mus musculus
tgatgtcaatcacaacttgaaagat

SEQ ID NO: 976696 - DNA, 25 bp, Mus musculus
tgatgtcaatcacatcttgaaagat

SEQ ID NO: 976697 - DNA, 25 bp, Mus musculus
tgatgtcacgaagccagcgatctct

SEQ ID NO: 976698 - DNA, 25 bp, Mus musculus
tgatgtcacgctctattacaatggc

SEQ ID NO: 976699 - DNA, 25 bp, Mus musculus
tgatgtcacggtctattacaatggc

SEQ ID NO: 976700 - DNA, 25 bp, Mus musculus
tgatgtcacgtagccagcgatctct

SEQ ID NO: 976701 - DNA, 25 bp, Mus musculus
tgatgtcagcctcaatactatcaat

SEQ ID NO: 976702 - DNA, 25 bp, Mus musculus
tgatgtcagcgtcaatactatcaat

SEQ ID NO: 976703 - DNA, 25 bp, Mus musculus
tgatgtccagaggcacccctttttc

SEQ ID NO: 976704 - DNA, 25 bp, Mus musculus
tgatgtccagtggcacccctttttc

SEQ ID NO: 976705 - DNA, 25 bp, Mus musculus
tgatgtccctccaccagatggaaat

SEQ ID NO: 976706 - DNA, 25 bp, Mus musculus
tgatgtccctgcaccagatggaaat

SEQ ID NO: 976707 - DNA, 25 bp, Mus musculus
tgatgtccggctagccaaggtcttg

SEQ ID NO: 976708 - DNA, 25 bp, Mus musculus
tgatgtccgggtagccaaggtcttg

SEQ ID NO: 976709 - DNA, 25 bp, Mus musculus
tgatgtcgcaggcacactgggttcc

SEQ ID NO: 976710 - DNA, 25 bp, Mus musculus
tgatgtcgcagggacactgggttcc

SEQ ID NO: 976711 - DNA, 25 bp, Mus musculus
tgatgtctatttcgagtgtctaaaa

SEQ ID NO: 976712 - DNA, 25 bp, Mus musculus
tgatgtctatttggagtgtctaaaa

SEQ ID NO: 976713 - DNA, 25 bp, Mus musculus
tgatgtctggaccctaggctgtgtg

SEQ ID NO: 976714 - DNA, 25 bp, Mus musculus
tgatgtctggagccatctgccctgt

SEQ ID NO: 976715 - DNA, 25 bp, Mus musculus
tgatgtctggaggcatctgccctgt

SEQ ID NO: 976716 - DNA, 25 bp, Mus musculus
tgatgtctggtccctaggctgtgtg

SEQ ID NO: 976717 - DNA, 25 bp, Mus musculus
tgatgtgaagcccctgcttgacact

SEQ ID NO: 976718 - DNA, 25 bp, Mus musculus
tgatgtgaaggccctgcttgacact

SEQ ID NO: 976719 - DNA, 25 bp, Mus musculus
tgatgtgaataaaacacagctgatc

SEQ ID NO: 976720 - DNA, 25 bp, Mus musculus
tgatgtgaataaaagacagctgatc

SEQ ID NO: 976721 - DNA, 25 bp, Mus musculus
tgatgtgacgccgtgtgtggactgt

SEQ ID NO: 976722 - DNA, 25 bp, Mus musculus
tgatgtgacggcgtgtgtggactgt

SEQ ID NO: 976723 - DNA, 25 bp, Mus musculus
tgatgtgccaagaaatgtatattta

SEQ ID NO: 976724 - DNA, 25 bp, Mus musculus
tgatgtgccaagtaatgtatattta

SEQ ID NO: 976725 - DNA, 25 bp, Mus musculus
tgatgtggagagcaaagaaggcggc

SEQ ID NO: 976726 - DNA, 25 bp, Mus musculus
tgatgtggagtgcaaagaaggcggc

SEQ ID NO: 976727 - DNA, 25 bp, Mus musculus
tgatgtggcatgcttcctgacggaa

SEQ ID NO: 976728 - DNA, 25 bp, Mus musculus
tgatgtggcatggttcctgacggaa

SEQ ID NO: 976729 - DNA, 25 bp, Mus musculus
tgatgttaacaaaacattgcatctg

SEQ ID NO: 976730 - DNA, 25 bp, Mus musculus
tgatgttaacaatacattgcatctg

SEQ ID NO: 976731 - DNA, 25 bp, Mus musculus
tgatgttaggatggatgaaaccgaa

SEQ ID NO: 976732 - DNA, 25 bp, Mus musculus
tgatgttaggttggatgaaaccgaa

SEQ ID NO: 976733 - DNA, 25 bp, Mus musculus
tgatgttatctcacaatcctttgtg

SEQ ID NO: 976734 - DNA, 25 bp, Mus musculus
tgatgttatctcactatcctttgtg

SEQ ID NO: 976735 - DNA, 25 bp, Mus musculus
tgatgttgagcctttgttgaccact

SEQ ID NO: 976736 - DNA, 25 bp, Mus musculus
tgatgttgaggctttgttgaccact

SEQ ID NO: 976737 - DNA, 25 bp, Mus musculus
tgatgttgcacacaaaaaattacaa

SEQ ID NO: 976738 - DNA, 25 bp, Mus musculus
tgatgttgcacagaaaaaattacaa

SEQ ID NO: 976739 - DNA, 25 bp, Mus musculus
tgatgttgggaaagtattaatgaag

SEQ ID NO: 976740 - DNA, 25 bp, Mus musculus
tgatgttgggtaagtattaatgaag

SEQ ID NO: 976741 - DNA, 25 bp, Mus musculus
tgatgttggtcatctgaaaacatca

SEQ ID NO: 976742 - DNA, 25 bp, Mus musculus
tgatgttggtgatctgaaaacatca

SEQ ID NO: 976743 - DNA, 25 bp, Mus musculus
tgatgtttttgacgaatctgaagaa

SEQ ID NO: 976744 - DNA, 25 bp, Mus musculus
tgatgtttttgaggaatctgaagaa

SEQ ID NO: 976745 - DNA, 25 bp, Mus musculus
tgattaacagcggagcacatattga

SEQ ID NO: 976746 - DNA, 25 bp, Mus musculus
tgattaacaggggagcacatattga

SEQ ID NO: 976747 - DNA, 25 bp, Mus musculus
tgattacaacatccagaaagagtcg

SEQ ID NO: 976748 - DNA, 25 bp, Mus musculus
tgattacaacttccagaaagagtcg

SEQ ID NO: 976749 - DNA, 25 bp, Mus musculus
tgattacaataacgggtggtacaga

SEQ ID NO: 976750 - DNA, 25 bp, Mus musculus
tgattacaataaggggtggtacaga

SEQ ID NO: 976751 - DNA, 25 bp, Mus musculus
tgattacaatcaagggctcagtgca

SEQ ID NO: 976752 - DNA, 25 bp, Mus musculus
tgattacaatcatgggctcagtgca

SEQ ID NO: 976753 - DNA, 25 bp, Mus musculus
tgattactttaacacagagcacaaa

SEQ ID NO: 976754 - DNA, 25 bp, Mus musculus
tgattactttaacagcacaaattgg

SEQ ID NO: 976755 - DNA, 25 bp, Mus musculus
tgattactttaaccacaaattggag

SEQ ID NO: 976756 - DNA, 25 bp, Mus musculus
tgattactttaagacagagcacaaa

SEQ ID NO: 976757 - DNA, 25 bp, Mus musculus
tgattactttaagagcacaaattgg

SEQ ID NO: 976758 - DNA, 25 bp, Mus musculus
tgattactttaagcacaaattggag

SEQ ID NO: 976759 - DNA, 25 bp, Mus musculus
tgattagaggcggacatgtcaatct

SEQ ID NO: 976760 - DNA, 25 bp, Mus musculus
tgattagagggggacatgtcaatct

SEQ ID NO: 976761 - DNA, 25 bp, Mus musculus
tgattagcagccattacagcgacct

SEQ ID NO: 976762 - DNA, 25 bp, Mus musculus
tgattagcaggcattacagcgacct

SEQ ID NO: 976763 - DNA, 25 bp, Mus musculus
tgattatccaagactctccaaaaga

SEQ ID NO: 976764 - DNA, 25 bp, Mus musculus
tgattatccaagtctctccaaaaga

SEQ ID NO: 976765 - DNA, 25 bp, Mus musculus
tgattatgagatcagctttggaggg

SEQ ID NO: 976766 - DNA, 25 bp, Mus musculus
tgattatgagttcagctttggaggg

SEQ ID NO: 976767 - DNA, 25 bp, Mus musculus
tgattatggacacgactgaaagact

SEQ ID NO: 976768 - DNA, 25 bp, Mus musculus
tgattatggacaggactgaaagact

SEQ ID NO: 976769 - DNA, 25 bp, Mus musculus
tgattcacttcagtcttgcaaacaa

SEQ ID NO: 976770 - DNA, 25 bp, Mus musculus
tgattcacttgagtcttgcaaacaa

SEQ ID NO: 976771 - DNA, 25 bp, Mus musculus
tgattcatgagccacaaccgcatat

SEQ ID NO: 976772 - DNA, 25 bp, Mus musculus
tgattcatgagccagaaccgcatat

SEQ ID NO: 976773 - DNA, 25 bp, Mus musculus
tgattccacgtgcgagcttcttgcc

SEQ ID NO: 976774 - DNA, 25 bp, Mus musculus
tgattccacgtgcgtgcttcttgcc

SEQ ID NO: 976775 - DNA, 25 bp, Mus musculus
tgattccatttcacacttgtggaat

SEQ ID NO: 976776 - DNA, 25 bp, Mus musculus
tgattccatttcactcttgtggaat

SEQ ID NO: 976777 - DNA, 25 bp, Mus musculus
tgattccctgaactttgcagtgttg

SEQ ID NO: 976778 - DNA, 25 bp, Mus musculus
tgattccctgaagtttgcagtgttg

SEQ ID NO: 976779 - DNA, 25 bp, Mus musculus
tgattccctgaggaagcatgttcac

SEQ ID NO: 976780 - DNA, 25 bp, Mus musculus
tgattccctgaggatgcatgttcac

SEQ ID NO: 976781 - DNA, 25 bp, Mus musculus
tgattcctatggcgataacttcgga

SEQ ID NO: 976782 - DNA, 25 bp, Mus musculus
tgattcctatggggataacttcgga

SEQ ID NO: 976783 - DNA, 25 bp, Mus musculus
tgattcggctcacggaaaattgaag

SEQ ID NO: 976784 - DNA, 25 bp, Mus musculus
tgattcggctcagggaaaattgaag

SEQ ID NO: 976785 - DNA, 25 bp, Mus musculus
tgattctaaacgagatatcttgtcc

SEQ ID NO: 976786 - DNA, 25 bp, Mus musculus
tgattctaaacgtgatatcttgtcc

SEQ ID NO: 976787 - DNA, 25 bp, Mus musculus
tgattctgagcttctgctgtgaatg

SEQ ID NO: 976788 - DNA, 25 bp, Mus musculus
tgattctgaggttctgctgtgaatg

SEQ ID NO: 976789 - DNA, 25 bp, Mus musculus
tgattctgtttgcaacttccacgtg

SEQ ID NO: 976790 - DNA, 25 bp, Mus musculus
tgattctgtttggaacttccacgtg

SEQ ID NO: 976791 - DNA, 25 bp, Mus musculus
tgattgagggcctccagaatggctc

SEQ ID NO: 976792 - DNA, 25 bp, Mus musculus
tgattgagggcctcgagaatggctc

SEQ ID NO: 976793 - DNA, 25 bp, Mus musculus
tgattgccagagccatgaatcctac

SEQ ID NO: 976794 - DNA, 25 bp, Mus musculus
tgattgccagaggcatgaatcctac

SEQ ID NO: 976795 - DNA, 25 bp, Mus musculus
tgattgctgctgcacgttaccaaca

SEQ ID NO: 976796 - DNA, 25 bp, Mus musculus
tgattgctgctgcaggttaccaaca

SEQ ID NO: 976797 - DNA, 25 bp, Mus musculus
tgattggcaagcagtggtgacgtat

SEQ ID NO: 976798 - DNA, 25 bp, Mus musculus
tgattggcaagctgtggtgacgtat

SEQ ID NO: 976799 - DNA, 25 bp, Mus musculus
tgattgggggaaatctggtgacagc

SEQ ID NO: 976800 - DNA, 25 bp, Mus musculus
tgattgggggaaatgtggtgacagc

SEQ ID NO: 976801 - DNA, 25 bp, Mus musculus
tgattggtgaaaaccgctgtatgtg

SEQ ID NO: 976802 - DNA, 25 bp, Mus musculus
tgattggtgaaatccgctgtatgtg

SEQ ID NO: 976803 - DNA, 25 bp, Mus musculus
tgattggttatgacacaaacataaa

SEQ ID NO: 976804 - DNA, 25 bp, Mus musculus
tgattggttatgaggcagcagaaga

SEQ ID NO: 976805 - DNA, 25 bp, Mus musculus
tgattggttatgtcacaaacataaa

SEQ ID NO: 976806 - DNA, 25 bp, Mus musculus
tgattggttatgtggcagcagaaga

SEQ ID NO: 976807 - DNA, 25 bp, Mus musculus
tgatttaaagctcatccactggaac

SEQ ID NO: 976808 - DNA, 25 bp, Mus musculus
tgatttaaaggtcatccactggaac

SEQ ID NO: 976809 - DNA, 25 bp, Mus musculus
tgatttaaggccagcagggaacctt

SEQ ID NO: 976810 - DNA, 25 bp, Mus musculus
tgatttaaggcttttgcctaccaaa

SEQ ID NO: 976811 - DNA, 25 bp, Mus musculus
tgatttaagggcagcagggaacctt

SEQ ID NO: 976812 - DNA, 25 bp, Mus musculus
tgatttaagggttttgcctaccaaa

SEQ ID NO: 976813 - DNA, 25 bp, Mus musculus
tgatttcatcaactatcatgcttcg

SEQ ID NO: 976814 - DNA, 25 bp, Mus musculus
tgatttcatcaactttcatgcttcg

SEQ ID NO: 976815 - DNA, 25 bp, Mus musculus
tgatttccagaccctgcagggctca

SEQ ID NO: 976816 - DNA, 25 bp, Mus musculus
tgatttccagagagaagacctgatg

SEQ ID NO: 976817 - DNA, 25 bp, Mus musculus
tgatttccagcctcatgtcatagtg

SEQ ID NO: 976818 - DNA, 25 bp, Mus musculus
tgatttccaggctcatgtcatagtg

SEQ ID NO: 976819 - DNA, 25 bp, Mus musculus
tgatttccagtccctgcagggctca

SEQ ID NO: 976820 - DNA, 25 bp, Mus musculus
tgatttccagtgagaagacctgatg

SEQ ID NO: 976821 - DNA, 25 bp, Mus musculus
tgatttctcaaacgtgtgtgtgctg

SEQ ID NO: 976822 - DNA, 25 bp, Mus musculus
tgatttctcaaaggtgtgtgtgctg

SEQ ID NO: 976823 - DNA, 25 bp, Mus musculus
tgatttggagattttctggaaccaa

SEQ ID NO: 976824 - DNA, 25 bp, Mus musculus
tgatttggagtttttctggaaccaa

SEQ ID NO: 976825 - DNA, 25 bp, Mus musculus
tgatttggttcagactcttttacat

SEQ ID NO: 976826 - DNA, 25 bp, Mus musculus
tgatttggttcagacttgtcctggg

SEQ ID NO: 976827 - DNA, 25 bp, Mus musculus
tgatttggttcagagtcttttacat

SEQ ID NO: 976828 - DNA, 25 bp, Mus musculus
tgatttggttcagagttgtcctggg

SEQ ID NO: 976829 - DNA, 25 bp, Mus musculus
tgatttgttgcccacgttctcctgt

SEQ ID NO: 976830 - DNA, 25 bp, Mus musculus
tgatttgttgcccaggttctcctgt

SEQ ID NO: 976831 - DNA, 25 bp, Mus musculus
tgattttaagctgttcagatacagt

SEQ ID NO: 976832 - DNA, 25 bp, Mus musculus
tgattttaaggtgttcagatacagt

SEQ ID NO: 976833 - DNA, 25 bp, Mus musculus
tgattttaggatacagccaagctct

SEQ ID NO: 976834 - DNA, 25 bp, Mus musculus
tgattttaggttacagccaagctct

SEQ ID NO: 976835 - DNA, 25 bp, Mus musculus
tgattttcaataaacctgatgagta

SEQ ID NO: 976836 - DNA, 25 bp, Mus musculus
tgattttcaataaagctgatgagta

SEQ ID NO: 976837 - DNA, 25 bp, Mus musculus
tgattttcagcaaaagtgcaagaaa

SEQ ID NO: 976838 - DNA, 25 bp, Mus musculus
tgattttcaggaaaagtgcaagaaa

SEQ ID NO: 976839 - DNA, 25 bp, Mus musculus
tgattttgagaacgatgatgacagc

SEQ ID NO: 976840 - DNA, 25 bp, Mus musculus
tgattttgagaaggatgatgacagc

SEQ ID NO: 976841 - DNA, 25 bp, Mus musculus
tgatttttctataccgttattgtcg

SEQ ID NO: 976842 - DNA, 25 bp, Mus musculus
tgatttttctttaccgttattgtcg

SEQ ID NO: 976843 - DNA, 25 bp, Mus musculus
tgcaaaaacacctttcgatgaagcc

SEQ ID NO: 976844 - DNA, 25 bp, Mus musculus
tgcaaaaacagctttcgatgaagcc

SEQ ID NO: 976845 - DNA, 25 bp, Mus musculus
tgcaaaaacgacaatcagtgcctgg

SEQ ID NO: 976846 - DNA, 25 bp, Mus musculus
tgcaaaaacgtcaatcagtgcctgg

SEQ ID NO: 976847 - DNA, 25 bp, Mus musculus
tgcaaaaactagcctgcgggaagct

SEQ ID NO: 976848 - DNA, 25 bp, Mus musculus
tgcaaaaactaggctgcgggaagct

SEQ ID NO: 976849 - DNA, 25 bp, Mus musculus
tgcaaaaaggcgatggaattcgaag

SEQ ID NO: 976850 - DNA, 25 bp, Mus musculus
tgcaaaaaggggatggaattcgaag

SEQ ID NO: 976851 - DNA, 25 bp, Mus musculus
tgcaaaaatctcaaaggtggattac

SEQ ID NO: 976852 - DNA, 25 bp, Mus musculus
tgcaaaaatctcaatggtggattac

SEQ ID NO: 976853 - DNA, 25 bp, Mus musculus
tgcaaaacccaaagccctttgccat

SEQ ID NO: 976854 - DNA, 25 bp, Mus musculus
tgcaaaacccaatgccctttgccat

SEQ ID NO: 976855 - DNA, 25 bp, Mus musculus
tgcaaaagttgaaactggacaactg

SEQ ID NO: 976856 - DNA, 25 bp, Mus musculus
tgcaaaagttgatactggacaactg

SEQ ID NO: 976857 - DNA, 25 bp, Mus musculus
tgcaaaatatggacatcccaatggg

SEQ ID NO: 976858 - DNA, 25 bp, Mus musculus
tgcaaaatatggtcatcccaatggg

SEQ ID NO: 976859 - DNA, 25 bp, Mus musculus
tgcaaacaaacacgatttgccgaat

SEQ ID NO: 976860 - DNA, 25 bp, Mus musculus
tgcaaacaaacaggatttgccgaat

SEQ ID NO: 976861 - DNA, 25 bp, Mus musculus
tgcaaacaaattcctactgcttcgt

SEQ ID NO: 976862 - DNA, 25 bp, Mus musculus
tgcaaacaaattgctactgcttcgt

SEQ ID NO: 976863 - DNA, 25 bp, Mus musculus
tgcaaacaactgaacttcactgcct

SEQ ID NO: 976864 - DNA, 25 bp, Mus musculus
tgcaaacaactgtacttcactgcct

SEQ ID NO: 976865 - DNA, 25 bp, Mus musculus
tgcaaacaagcaacatttacatcca

SEQ ID NO: 976866 - DNA, 25 bp, Mus musculus
tgcaaacaaggaacatttacatcca

SEQ ID NO: 976867 - DNA, 25 bp, Mus musculus
tgcaaacctctgcgccggtatctga

SEQ ID NO: 976868 - DNA, 25 bp, Mus musculus
tgcaaacctctgcggcggtatctga

SEQ ID NO: 976869 - DNA, 25 bp, Mus musculus
tgcaaagaatggcgtaaccatagag

SEQ ID NO: 976870 - DNA, 25 bp, Mus musculus
tgcaaagaatggggtaaccatagag

SEQ ID NO: 976871 - DNA, 25 bp, Mus musculus
tgcaaagctctgatcctgggcatct

SEQ ID NO: 976872 - DNA, 25 bp, Mus musculus
tgcaaagctctgttcctgggcatct

SEQ ID NO: 976873 - DNA, 25 bp, Mus musculus
tgcaaagcttctctggttctctgcc

SEQ ID NO: 976874 - DNA, 25 bp, Mus musculus
tgcaaagcttctgtggttctctgcc

SEQ ID NO: 976875 - DNA, 25 bp, Mus musculus
tgcaaatcagaacgctaggcaagcc

SEQ ID NO: 976876 - DNA, 25 bp, Mus musculus
tgcaaatcagaaggctaggcaagcc

SEQ ID NO: 976877 - DNA, 25 bp, Mus musculus
tgcaaatcatcaggtggcctagaag

SEQ ID NO: 976878 - DNA, 25 bp, Mus musculus
tgcaaatcatgaggtggcctagaag

SEQ ID NO: 976879 - DNA, 25 bp, Mus musculus
tgcaaatgcacacgaaactttgctg

SEQ ID NO: 976880 - DNA, 25 bp, Mus musculus
tgcaaatgcacaggaaactttgctg

SEQ ID NO: 976881 - DNA, 25 bp, Mus musculus
tgcaaatggcagccgaacccatctc

SEQ ID NO: 976882 - DNA, 25 bp, Mus musculus
tgcaaatggcaggcgaacccatctc

SEQ ID NO: 976883 - DNA, 25 bp, Mus musculus
tgcaaatgggaacaactgtataaga

SEQ ID NO: 976884 - DNA, 25 bp, Mus musculus
tgcaaatgggtacaactgtataaga

SEQ ID NO: 976885 - DNA, 25 bp, Mus musculus
tgcaacaagcatcggatctcgggaa

SEQ ID NO: 976886 - DNA, 25 bp, Mus musculus
tgcaacaagcatgggatctcgggaa

SEQ ID NO: 976887 - DNA, 25 bp, Mus musculus
tgcaacacgccacgcgtcctctccg

SEQ ID NO: 976888 - DNA, 25 bp, Mus musculus
tgcaacacgccaggcgtcctctccg

SEQ ID NO: 976889 - DNA, 25 bp, Mus musculus
tgcaacagatacatgctgggctttg

SEQ ID NO: 976890 - DNA, 25 bp, Mus musculus
tgcaacagatacttgctgggctttg

SEQ ID NO: 976891 - DNA, 25 bp, Mus musculus
tgcaaccaagatgagtccttccacc

SEQ ID NO: 976892 - DNA, 25 bp, Mus musculus
tgcaaccaagccctttgtagatttc

SEQ ID NO: 976893 - DNA, 25 bp, Mus musculus
tgcaaccaaggcctttgtagatttc

SEQ ID NO: 976894 - DNA, 25 bp, Mus musculus
tgcaaccaagttgagtccttccacc

SEQ ID NO: 976895 - DNA, 25 bp, Mus musculus
tgcaaccacaggcactggaaatggc

SEQ ID NO: 976896 - DNA, 25 bp, Mus musculus
tgcaaccacagggactggaaatggc

SEQ ID NO: 976897 - DNA, 25 bp, Mus musculus
tgcaaccctgcccacctgaggcaaa

SEQ ID NO: 976898 - DNA, 25 bp, Mus musculus
tgcaaccctgcccagctgaggcaaa

SEQ ID NO: 976899 - DNA, 25 bp, Mus musculus
tgcaacgatgtactctctcttttgg

SEQ ID NO: 976900 - DNA, 25 bp, Mus musculus
tgcaacgatgtactgtctcttttgg

SEQ ID NO: 976901 - DNA, 25 bp, Mus musculus
tgcaacgatgtgctcctgttggaca

SEQ ID NO: 976902 - DNA, 25 bp, Mus musculus
tgcaacgatgtgctcgagctgttgg

SEQ ID NO: 976903 - DNA, 25 bp, Mus musculus
tgcaacgatgtgctgctgttggaca

SEQ ID NO: 976904 - DNA, 25 bp, Mus musculus
tgcaacgatgtgctggagctgttgg

SEQ ID NO: 976905 - DNA, 25 bp, Mus musculus
tgcaacggcgcctccgctggacatt

SEQ ID NO: 976906 - DNA, 25 bp, Mus musculus
tgcaacggcgcctcggctggacatt

SEQ ID NO: 976907 - DNA, 25 bp, Mus musculus
tgcaactctatgctgctttttgacc

SEQ ID NO: 976908 - DNA, 25 bp, Mus musculus
tgcaactctatggtgctttttgacc

SEQ ID NO: 976909 - DNA, 25 bp, Mus musculus
tgcaacttgagagcattggatatac

SEQ ID NO: 976910 - DNA, 25 bp, Mus musculus
tgcaacttgagagctttggatatac

SEQ ID NO: 976911 - DNA, 25 bp, Mus musculus
tgcaactttaagatggagccagatc

SEQ ID NO: 976912 - DNA, 25 bp, Mus musculus
tgcaactttaagttggagccagatc

SEQ ID NO: 976913 - DNA, 25 bp, Mus musculus
tgcaagaacacctaggctggcctga

SEQ ID NO: 976914 - DNA, 25 bp, Mus musculus
tgcaagaacagctaggctggcctga

SEQ ID NO: 976915 - DNA, 25 bp, Mus musculus
tgcaagaacgcctggtgcaagcaca

SEQ ID NO: 976916 - DNA, 25 bp, Mus musculus
tgcaagaacggctggtgcaagcaca

SEQ ID NO: 976917 - DNA, 25 bp, Mus musculus
tgcaagaccaaactcagcggggatg

SEQ ID NO: 976918 - DNA, 25 bp, Mus musculus
tgcaagaccaaagtcagcggggatg

SEQ ID NO: 976919 - DNA, 25 bp, Mus musculus
tgcaagagcaaaatgtttcaaatgt

SEQ ID NO: 976920 - DNA, 25 bp, Mus musculus
tgcaagagcaaattgtttcaaatgt

SEQ ID NO: 976921 - DNA, 25 bp, Mus musculus
tgcaagaggcaacacctggggatct

SEQ ID NO: 976922 - DNA, 25 bp, Mus musculus
tgcaagaggcaagacctggggatct

SEQ ID NO: 976923 - DNA, 25 bp, Mus musculus
tgcaagagtgctgcgtgggctgtga

SEQ ID NO: 976924 - DNA, 25 bp, Mus musculus
tgcaagagtggtgcgtgggctgtga

SEQ ID NO: 976925 - DNA, 25 bp, Mus musculus
tgcaagagttcaacaagtttgatct

SEQ ID NO: 976926 - DNA, 25 bp, Mus musculus
tgcaagagttcaatttgatctctac

SEQ ID NO: 976927 - DNA, 25 bp, Mus musculus
tgcaagagttcatcaagtttgatct

SEQ ID NO: 976928 - DNA, 25 bp, Mus musculus
tgcaagagttcattttgatctctac

SEQ ID NO: 976929 - DNA, 25 bp, Mus musculus
tgcaagatcctgatccaagactacc

SEQ ID NO: 976930 - DNA, 25 bp, Mus musculus
tgcaagatcctgttccaagactacc

SEQ ID NO: 976931 - DNA, 25 bp, Mus musculus
tgcaagcaagactgaaatacagttg

SEQ ID NO: 976932 - DNA, 25 bp, Mus musculus
tgcaagcaagtctgaaatacagttg

SEQ ID NO: 976933 - DNA, 25 bp, Mus musculus
tgcaagccagaggaatacccactgc

SEQ ID NO: 976934 - DNA, 25 bp, Mus musculus
tgcaagccagcttttcacacatctt

SEQ ID NO: 976935 - DNA, 25 bp, Mus musculus
tgcaagccaggttttcacacatctt

SEQ ID NO: 976936 - DNA, 25 bp, Mus musculus
tgcaagccagtggaatacccactgc

SEQ ID NO: 976937 - DNA, 25 bp, Mus musculus
tgcaagccccaacaggatgattatt

SEQ ID NO: 976938 - DNA, 25 bp, Mus musculus
tgcaagccccaagaggatgattatt

SEQ ID NO: 976939 - DNA, 25 bp, Mus musculus
tgcaagcctcaacacgaaagtaggt

SEQ ID NO: 976940 - DNA, 25 bp, Mus musculus
tgcaagcctcaagacgaaagtaggt

SEQ ID NO: 976941 - DNA, 25 bp, Mus musculus
tgcaagctgatgaaaaagctgctgg

SEQ ID NO: 976942 - DNA, 25 bp, Mus musculus
tgcaagctgatgaataagctgctgg

SEQ ID NO: 976943 - DNA, 25 bp, Mus musculus
tgcaagctggatgataaggacctcc

SEQ ID NO: 976944 - DNA, 25 bp, Mus musculus
tgcaagctggttgataaggacctcc

SEQ ID NO: 976945 - DNA, 25 bp, Mus musculus
tgcaaggcagcttggcgtgggtgga

SEQ ID NO: 976946 - DNA, 25 bp, Mus musculus
tgcaaggcaggttggcgtgggtgga

SEQ ID NO: 976947 - DNA, 25 bp, Mus musculus
tgcaaggcagtacgcaaagagccga

SEQ ID NO: 976948 - DNA, 25 bp, Mus musculus
tgcaaggcagtaggcaaagagccga

SEQ ID NO: 976949 - DNA, 25 bp, Mus musculus
tgcaaggccagtcgatgcgcctatg

SEQ ID NO: 976950 - DNA, 25 bp, Mus musculus
tgcaaggccagtggatgcgcctatg

SEQ ID NO: 976951 - DNA, 25 bp, Mus musculus
tgcaaggctgtgcgctccataggct

SEQ ID NO: 976952 - DNA, 25 bp, Mus musculus
tgcaaggctgtgggctccataggct

SEQ ID NO: 976953 - DNA, 25 bp, Mus musculus
tgcaaggtgtaggggaataataatg

SEQ ID NO: 976954 - DNA, 25 bp, Mus musculus
tgcaaggtgttggggaataataatg

SEQ ID NO: 976955 - DNA, 25 bp, Mus musculus
tgcaaggttcctcccgctaacgtcc

SEQ ID NO: 976956 - DNA, 25 bp, Mus musculus
tgcaaggttcctgccgctaacgtcc

SEQ ID NO: 976957 - DNA, 25 bp, Mus musculus
tgcaaggttctcaacgacagtgacc

SEQ ID NO: 976958 - DNA, 25 bp, Mus musculus
tgcaaggttctcaaggacagtgacc

SEQ ID NO: 976959 - DNA, 25 bp, Mus musculus
tgcaagtcagcccgtctactgtgtg

SEQ ID NO: 976960 - DNA, 25 bp, Mus musculus
tgcaagtcaggccgtctactgtgtg

SEQ ID NO: 976961 - DNA, 25 bp, Mus musculus
tgcaagtcatgtcattgtgcttctt

SEQ ID NO: 976962 - DNA, 25 bp, Mus musculus
tgcaagtcatgtgattgtgcttctt

SEQ ID NO: 976963 - DNA, 25 bp, Mus musculus
tgcaagtgggtgcaatccatgtggt

SEQ ID NO: 976964 - DNA, 25 bp, Mus musculus
tgcaagtgggtggaatccatgtggt

SEQ ID NO: 976965 - DNA, 25 bp, Mus musculus
tgcaagttaaaacgaacttctgcag

SEQ ID NO: 976966 - DNA, 25 bp, Mus musculus
tgcaagttaaaaggaacttctgcag

SEQ ID NO: 976967 - DNA, 25 bp, Mus musculus
tgcaataatgactgaaccaatcaga

SEQ ID NO: 976968 - DNA, 25 bp, Mus musculus
tgcaataatgtctgaaccaatcaga

SEQ ID NO: 976969 - DNA, 25 bp, Mus musculus
tgcaatatgacactgctgtccatgc

SEQ ID NO: 976970 - DNA, 25 bp, Mus musculus
tgcaatatgacagtgctgtccatgc

SEQ ID NO: 976971 - DNA, 25 bp, Mus musculus
tgcaatatgactcaaacggcatgga

SEQ ID NO: 976972 - DNA, 25 bp, Mus musculus
tgcaatatgactccccgaagccttt

SEQ ID NO: 976973 - DNA, 25 bp, Mus musculus
tgcaatatgactgaaacggcatgga

SEQ ID NO: 976974 - DNA, 25 bp, Mus musculus
tgcaatatgactgcccgaagccttt

SEQ ID NO: 976975 - DNA, 25 bp, Mus musculus
tgcaatcaagcacgaacctgggcag

SEQ ID NO: 976976 - DNA, 25 bp, Mus musculus
tgcaatcaagcaggaacctgggcag

SEQ ID NO: 976977 - DNA, 25 bp, Mus musculus
tgcaatccttcacacctccagagtg

SEQ ID NO: 976978 - DNA, 25 bp, Mus musculus
tgcaatccttcagacctccagagtg

SEQ ID NO: 976979 - DNA, 25 bp, Mus musculus
tgcaatgcaaatggcaacaactgta

SEQ ID NO: 976980 - DNA, 25 bp, Mus musculus
tgcaatgcaaatgggaacaactgta

SEQ ID NO: 976981 - DNA, 25 bp, Mus musculus
tgcaatgcagaccgtggtggatgac

SEQ ID NO: 976982 - DNA, 25 bp, Mus musculus
tgcaatgcagcacagtggtgactac

SEQ ID NO: 976983 - DNA, 25 bp, Mus musculus
tgcaatgcaggacagtggtgactac

SEQ ID NO: 976984 - DNA, 25 bp, Mus musculus
tgcaatgcagtccgtggtggatgac

SEQ ID NO: 976985 - DNA, 25 bp, Mus musculus
tgcaatggagagttgtgatcgcatc

SEQ ID NO: 976986 - DNA, 25 bp, Mus musculus
tgcaatggagtgttgtgatcgcatc

SEQ ID NO: 976987 - DNA, 25 bp, Mus musculus
tgcaatggctctcatgggaggaatt

SEQ ID NO: 976988 - DNA, 25 bp, Mus musculus
tgcaatggctgtcatgggaggaatt

SEQ ID NO: 976989 - DNA, 25 bp, Mus musculus
tgcaatggtgagctgcaggcagaga

SEQ ID NO: 976990 - DNA, 25 bp, Mus musculus
tgcaatggtgaggtgcaggcagaga

SEQ ID NO: 976991 - DNA, 25 bp, Mus musculus
tgcaatgtagagccagtcagagcgc

SEQ ID NO: 976992 - DNA, 25 bp, Mus musculus
tgcaatgtagaggcagtcagagcgc

SEQ ID NO: 976993 - DNA, 25 bp, Mus musculus
tgcaattctacacataaatggaatt

SEQ ID NO: 976994 - DNA, 25 bp, Mus musculus
tgcaattctacagataaatggaatt

SEQ ID NO: 976995 - DNA, 25 bp, Mus musculus
tgcaattgcaagatcaagtcctgct

SEQ ID NO: 976996 - DNA, 25 bp, Mus musculus
tgcaattgcaagttcaagtcctgct

SEQ ID NO: 976997 - DNA, 25 bp, Mus musculus
tgcaattggaaacacagtgatgtga

SEQ ID NO: 976998 - DNA, 25 bp, Mus musculus
tgcaattggaaacgtatctggccag

SEQ ID NO: 976999 - DNA, 25 bp, Mus musculus
tgcaattggaaagacagtgatgtga

SEQ ID NO: 977000 - DNA, 25 bp, Mus musculus
tgcaattggaaaggtatctggccag

SEQ ID NO: 977001 - DNA, 25 bp, Mus musculus
tgcacaaacgagctccttatgtctc

SEQ ID NO: 977002 - DNA, 25 bp, Mus musculus
tgcacaaacgaggtccttatgtctc

SEQ ID NO: 977003 - DNA, 25 bp, Mus musculus
tgcacaaattcacactctccatgaa

SEQ ID NO: 977004 - DNA, 25 bp, Mus musculus
tgcacaaattgacactctccatgaa

SEQ ID NO: 977005 - DNA, 25 bp, Mus musculus
tgcacacacacacggattgagtcct

SEQ ID NO: 977006 - DNA, 25 bp, Mus musculus
tgcacacacacagggattgagtcct

SEQ ID NO: 977007 - DNA, 25 bp, Mus musculus
tgcacacagcagccaacataatgga

SEQ ID NO: 977008 - DNA, 25 bp, Mus musculus
tgcacacagcaggcaacataatgga

SEQ ID NO: 977009 - DNA, 25 bp, Mus musculus
tgcacacagccaagcgtcgattccg

SEQ ID NO: 977010 - DNA, 25 bp, Mus musculus
tgcacacagccaagggtcgattccg

SEQ ID NO: 977011 - DNA, 25 bp, Mus musculus
tgcacacaggatcgtcctctttatg

SEQ ID NO: 977012 - DNA, 25 bp, Mus musculus
tgcacacaggatggtcctctttatg

SEQ ID NO: 977013 - DNA, 25 bp, Mus musculus
tgcacacagggtcggcccctgtatg

SEQ ID NO: 977014 - DNA, 25 bp, Mus musculus
tgcacacagggtgggcccctgtatg

SEQ ID NO: 977015 - DNA, 25 bp, Mus musculus
tgcacaccagcattttgctaacatc

SEQ ID NO: 977016 - DNA, 25 bp, Mus musculus
tgcacaccaggattttgctaacatc

SEQ ID NO: 977017 - DNA, 25 bp, Mus musculus
tgcacacctcagcttccctcagctc

SEQ ID NO: 977018 - DNA, 25 bp, Mus musculus
tgcacacctcaggttccctcagctc

SEQ ID NO: 977019 - DNA, 25 bp, Mus musculus
tgcacactggctttaacagcattgc

SEQ ID NO: 977020 - DNA, 25 bp, Mus musculus
tgcacactgggtttaacagcattgc

SEQ ID NO: 977021 - DNA, 25 bp, Mus musculus
tgcacagaatcccactctcctcact

SEQ ID NO: 977022 - DNA, 25 bp, Mus musculus
tgcacagaatcccactggggaaacg

SEQ ID NO: 977023 - DNA, 25 bp, Mus musculus
tgcacagaatcccagtctcctcact

SEQ ID NO: 977024 - DNA, 25 bp, Mus musculus
tgcacagaatcccagtggggaaacg

SEQ ID NO: 977025 - DNA, 25 bp, Mus musculus
tgcacagatgagagacaaattccca

SEQ ID NO: 977026 - DNA, 25 bp, Mus musculus
tgcacagatgtgagacaaattccca

SEQ ID NO: 977027 - DNA, 25 bp, Mus musculus
tgcacagcagcgtgtctcctctgac

SEQ ID NO: 977028 - DNA, 25 bp, Mus musculus
tgcacagcagctactaccgcattgc

SEQ ID NO: 977029 - DNA, 25 bp, Mus musculus
tgcacagcagggtgtctcctctgac

SEQ ID NO: 977030 - DNA, 25 bp, Mus musculus
tgcacagcaggtactaccgcattgc

SEQ ID NO: 977031 - DNA, 25 bp, Mus musculus
tgcacagctgctatgcatggaccat

SEQ ID NO: 977032 - DNA, 25 bp, Mus musculus
tgcacagctggtatgcatggaccat

SEQ ID NO: 977033 - DNA, 25 bp, Mus musculus
tgcacaggacagatcaagactggtg

SEQ ID NO: 977034 - DNA, 25 bp, Mus musculus
tgcacaggacagttcaagactggtg

SEQ ID NO: 977035 - DNA, 25 bp, Mus musculus
tgcacaggtttctgcttatggttca

SEQ ID NO: 977036 - DNA, 25 bp, Mus musculus
tgcacaggtttctggttatggttca

SEQ ID NO: 977037 - DNA, 25 bp, Mus musculus
tgcacagttatgctgtgggagatcc

SEQ ID NO: 977038 - DNA, 25 bp, Mus musculus
tgcacagttatggtgtgggagatcc

SEQ ID NO: 977039 - DNA, 25 bp, Mus musculus
tgcacagttccacacatctcttaac

SEQ ID NO: 977040 - DNA, 25 bp, Mus musculus
tgcacagttccagacatctcttaac

SEQ ID NO: 977041 - DNA, 25 bp, Mus musculus
tgcacatcctcccgactctaatgag

SEQ ID NO: 977042 - DNA, 25 bp, Mus musculus
tgcacatcctccggactctaatgag

SEQ ID NO: 977043 - DNA, 25 bp, Mus musculus
tgcacatctctgatgtggaagggga

SEQ ID NO: 977044 - DNA, 25 bp, Mus musculus
tgcacatctctgttgtggaagggga

SEQ ID NO: 977045 - DNA, 25 bp, Mus musculus
tgcacatgcttgaacgggaccatcc

SEQ ID NO: 977046 - DNA, 25 bp, Mus musculus
tgcacatgcttgtacgggaccatcc

SEQ ID NO: 977047 - DNA, 25 bp, Mus musculus
tgcacatggaccagttggaggtggg

SEQ ID NO: 977048 - DNA, 25 bp, Mus musculus
tgcacatggacctgttggaggtggg

SEQ ID NO: 977049 - DNA, 25 bp, Mus musculus
tgcaccaaaacatgagattgattct

SEQ ID NO: 977050 - DNA, 25 bp, Mus musculus
tgcaccaaaagatgagattgattct

SEQ ID NO: 977051 - DNA, 25 bp, Mus musculus
tgcaccaaaggacggcccatctaca

SEQ ID NO: 977052 - DNA, 25 bp, Mus musculus
tgcaccaaaggagggcccatctaca

SEQ ID NO: 977053 - DNA, 25 bp, Mus musculus
tgcaccacagcctttttccagggct

SEQ ID NO: 977054 - DNA, 25 bp, Mus musculus
tgcaccacaggctttttccagggct

SEQ ID NO: 977055 - DNA, 25 bp, Mus musculus
tgcaccacctgttccagaagttggc

SEQ ID NO: 977056 - DNA, 25 bp, Mus musculus
tgcaccacctgttcgagaagttggc

SEQ ID NO: 977057 - DNA, 25 bp, Mus musculus
tgcaccacgtcactatgattcctgc

SEQ ID NO: 977058 - DNA, 25 bp, Mus musculus
tgcaccacgtcagtatgattcctgc

SEQ ID NO: 977059 - DNA, 25 bp, Mus musculus
tgcaccagcaacacccatgacaaat

SEQ ID NO: 977060 - DNA, 25 bp, Mus musculus
tgcaccagcaactcccatgacaaat

SEQ ID NO: 977061 - DNA, 25 bp, Mus musculus
tgcaccaggcaccacgtcctgttta

SEQ ID NO: 977062 - DNA, 25 bp, Mus musculus
tgcaccaggcaccaggtcctgttta

SEQ ID NO: 977063 - DNA, 25 bp, Mus musculus
tgcaccagtacacgtcacagcctct

SEQ ID NO: 977064 - DNA, 25 bp, Mus musculus
tgcaccagtacaggtcacagcctct

SEQ ID NO: 977065 - DNA, 25 bp, Mus musculus
tgcaccatagctttcatagcttttt

SEQ ID NO: 977066 - DNA, 25 bp, Mus musculus
tgcaccataggtttcatagcttttt

SEQ ID NO: 977067 - DNA, 25 bp, Mus musculus
tgcacccataatctcggctgaatca

SEQ ID NO: 977068 - DNA, 25 bp, Mus musculus
tgcacccataatctgggctgaatca

SEQ ID NO: 977069 - DNA, 25 bp, Mus musculus
tgcacccctactctttctgacctgt

SEQ ID NO: 977070 - DNA, 25 bp, Mus musculus
tgcacccctactgtttctgacctgt

SEQ ID NO: 977071 - DNA, 25 bp, Mus musculus
tgcaccctggcgtaaaacattcact

SEQ ID NO: 977072 - DNA, 25 bp, Mus musculus
tgcaccctggggtaaaacattcact

SEQ ID NO: 977073 - DNA, 25 bp, Mus musculus
tgcaccggagtcatcggggtctgct

SEQ ID NO: 977074 - DNA, 25 bp, Mus musculus
tgcaccggagtcatgggggtctgct

SEQ ID NO: 977075 - DNA, 25 bp, Mus musculus
tgcacctcaaagtctaagaaatcgc

SEQ ID NO: 977076 - DNA, 25 bp, Mus musculus
tgcacctcaagacggagagaaaatg

SEQ ID NO: 977077 - DNA, 25 bp, Mus musculus
tgcacctcaagacgtacctaagagt

SEQ ID NO: 977078 - DNA, 25 bp, Mus musculus
tgcacctcaagagggagagaaaatg

SEQ ID NO: 977079 - DNA, 25 bp, Mus musculus
tgcacctcaagaggtacctaagagt

SEQ ID NO: 977080 - DNA, 25 bp, Mus musculus
tgcacctcaatgtctaagaaatcgc

SEQ ID NO: 977081 - DNA, 25 bp, Mus musculus
tgcacctcatcctgcactacgtgag

SEQ ID NO: 977082 - DNA, 25 bp, Mus musculus
tgcacctcatcctggactacgtgag

SEQ ID NO: 977083 - DNA, 25 bp, Mus musculus
tgcacctgacagctcctgagcagaa

SEQ ID NO: 977084 - DNA, 25 bp, Mus musculus
tgcacctgacaggtcctgagcagaa

SEQ ID NO: 977085 - DNA, 25 bp, Mus musculus
tgcacctgagacaatcctaaaggac

SEQ ID NO: 977086 - DNA, 25 bp, Mus musculus
tgcacctgagactatcctaaaggac

SEQ ID NO: 977087 - DNA, 25 bp, Mus musculus
tgcaccttgggccacattgtgtcac

SEQ ID NO: 977088 - DNA, 25 bp, Mus musculus
tgcaccttgggccagattgtgtcac

SEQ ID NO: 977089 - DNA, 25 bp, Mus musculus
tgcacgacacagaactgtatatggt

SEQ ID NO: 977090 - DNA, 25 bp, Mus musculus
tgcacgacacagaagtgtatatggt

SEQ ID NO: 977091 - DNA, 25 bp, Mus musculus
tgcacgcaggatcgacctctctacg

SEQ ID NO: 977092 - DNA, 25 bp, Mus musculus
tgcacgcaggatctgtatccatcga

SEQ ID NO: 977093 - DNA, 25 bp, Mus musculus
tgcacgcaggatggacctctctacg

SEQ ID NO: 977094 - DNA, 25 bp, Mus musculus
tgcacgcaggatgtgtatccatcga

SEQ ID NO: 977095 - DNA, 25 bp, Mus musculus
tgcacgcctacaccttcctggtggc

SEQ ID NO: 977096 - DNA, 25 bp, Mus musculus
tgcacgcctacagcttcctggtggc

SEQ ID NO: 977097 - DNA, 25 bp, Mus musculus
tgcacgcggtcacaactgtgccgga

SEQ ID NO: 977098 - DNA, 25 bp, Mus musculus
tgcacgcggtcacagaaagccaagt

SEQ ID NO: 977099 - DNA, 25 bp, Mus musculus
tgcacgcggtcagaactgtgccgga

SEQ ID NO: 977100 - DNA, 25 bp, Mus musculus
tgcacgcggtcagagaaagccaagt

SEQ ID NO: 977101 - DNA, 25 bp, Mus musculus
tgcacgctgcagatatgatcataca

SEQ ID NO: 977102 - DNA, 25 bp, Mus musculus
tgcacgctgcagttatgatcataca

SEQ ID NO: 977103 - DNA, 25 bp, Mus musculus
tgcacggcagattacaaaagaagac

SEQ ID NO: 977104 - DNA, 25 bp, Mus musculus
tgcacggcagtttacaaaagaagac

SEQ ID NO: 977105 - DNA, 25 bp, Mus musculus
tgcacggtgaagatctggaacaacg

SEQ ID NO: 977106 - DNA, 25 bp, Mus musculus
tgcacggtgaagttctggaacaacg

SEQ ID NO: 977107 - DNA, 25 bp, Mus musculus
tgcacgtgacagagggctccctgct

SEQ ID NO: 977108 - DNA, 25 bp, Mus musculus
tgcacgtgacagtgggctccctgct

SEQ ID NO: 977109 - DNA, 25 bp, Mus musculus
tgcactataaagtcctaaaatatga

SEQ ID NO: 977110 - DNA, 25 bp, Mus musculus
tgcactataaagtcgtaaaatatga

SEQ ID NO: 977111 - DNA, 25 bp, Mus musculus
tgcactcaggaacggcccctgtacg

SEQ ID NO: 977112 - DNA, 25 bp, Mus musculus
tgcactcaggaagggcccctgtacg

SEQ ID NO: 977113 - DNA, 25 bp, Mus musculus
tgcactcccacaagagcctggcaga

SEQ ID NO: 977114 - DNA, 25 bp, Mus musculus
tgcactcccacaagtgcctggcaga

SEQ ID NO: 977115 - DNA, 25 bp, Mus musculus
tgcactcgagacggcccattgctcc

SEQ ID NO: 977116 - DNA, 25 bp, Mus musculus
tgcactcgagacgggccattgctcc

SEQ ID NO: 977117 - DNA, 25 bp, Mus musculus
tgcactctacagctgagctccacct

SEQ ID NO: 977118 - DNA, 25 bp, Mus musculus
tgcactctacaggtgagctccacct

SEQ ID NO: 977119 - DNA, 25 bp, Mus musculus
tgcactctgatgctactggaaatct

SEQ ID NO: 977120 - DNA, 25 bp, Mus musculus
tgcactctgatggtactggaaatct

SEQ ID NO: 977121 - DNA, 25 bp, Mus musculus
tgcactctttttcgtatgatcactg

SEQ ID NO: 977122 - DNA, 25 bp, Mus musculus
tgcactctttttggtatgatcactg

SEQ ID NO: 977123 - DNA, 25 bp, Mus musculus
tgcactgaagaacataaagcgctca

SEQ ID NO: 977124 - DNA, 25 bp, Mus musculus
tgcactgaagaagataaagcgctca

SEQ ID NO: 977125 - DNA, 25 bp, Mus musculus
tgcactgaggcgcgaagcctgtggg

SEQ ID NO: 977126 - DNA, 25 bp, Mus musculus
tgcactgaggcgggaagcctgtggg

SEQ ID NO: 977127 - DNA, 25 bp, Mus musculus
tgcactgcaaacaatattatgcctt

SEQ ID NO: 977128 - DNA, 25 bp, Mus musculus
tgcactgcaaactatattatgcctt

SEQ ID NO: 977129 - DNA, 25 bp, Mus musculus
tgcactgcagacctgtgctgtgagg

SEQ ID NO: 977130 - DNA, 25 bp, Mus musculus
tgcactgcagagacctgtgctgtga

SEQ ID NO: 977131 - DNA, 25 bp, Mus musculus
tgcactgcagcagacctgtgctgtg

SEQ ID NO: 977132 - DNA, 25 bp, Mus musculus
tgcactgcaggagacctgtgctgtg

SEQ ID NO: 977133 - DNA, 25 bp, Mus musculus
tgcactgcagtcctgtgctgtgagg

SEQ ID NO: 977134 - DNA, 25 bp, Mus musculus
tgcactgcagtgacctgtgctgtga

SEQ ID NO: 977135 - DNA, 25 bp, Mus musculus
tgcactggacttcctgaaacctggt

SEQ ID NO: 977136 - DNA, 25 bp, Mus musculus
tgcactggacttgctgaaacctggt

SEQ ID NO: 977137 - DNA, 25 bp, Mus musculus
tgcactggtgcacgtgtatccagat

SEQ ID NO: 977138 - DNA, 25 bp, Mus musculus
tgcactggtgcaggtgtatccagat

SEQ ID NO: 977139 - DNA, 25 bp, Mus musculus
tgcactgtcatgctatggcagattc

SEQ ID NO: 977140 - DNA, 25 bp, Mus musculus
tgcactgtcatggtatggcagattc

SEQ ID NO: 977141 - DNA, 25 bp, Mus musculus
tgcacttatacacacgtgcaaactc

SEQ ID NO: 977142 - DNA, 25 bp, Mus musculus
tgcacttatacacaggtgcaaactc

SEQ ID NO: 977143 - DNA, 25 bp, Mus musculus
tgcacttcagaaatgctaccacttt

SEQ ID NO: 977144 - DNA, 25 bp, Mus musculus
tgcacttcagaaggcccgagacatg

SEQ ID NO: 977145 - DNA, 25 bp, Mus musculus
tgcacttcagctgtatggacgcctc

SEQ ID NO: 977146 - DNA, 25 bp, Mus musculus
tgcacttcaggtgtatggacgcctc

SEQ ID NO: 977147 - DNA, 25 bp, Mus musculus
tgcacttcagtaatgctaccacttt

SEQ ID NO: 977148 - DNA, 25 bp, Mus musculus
tgcacttcagtaggcccgagacatg

SEQ ID NO: 977149 - DNA, 25 bp, Mus musculus
tgcacttgagcaagcatcaagagga

SEQ ID NO: 977150 - DNA, 25 bp, Mus musculus
tgcacttgaggaagcatcaagagga

SEQ ID NO: 977151 - DNA, 25 bp, Mus musculus
tgcactttacagctggctttgcagc

SEQ ID NO: 977152 - DNA, 25 bp, Mus musculus
tgcactttacaggtggctttgcagc

SEQ ID NO: 977153 - DNA, 25 bp, Mus musculus
tgcactttctactacccttttgggc

SEQ ID NO: 977154 - DNA, 25 bp, Mus musculus
tgcactttctactagccttttgggc

SEQ ID NO: 977155 - DNA, 25 bp, Mus musculus
tgcagaaagaaaagcccttatgtta

SEQ ID NO: 977156 - DNA, 25 bp, Mus musculus
tgcagaaagaaatgcccttatgtta

SEQ ID NO: 977157 - DNA, 25 bp, Mus musculus
tgcagaaagcagcccgtctactgtg

SEQ ID NO: 977158 - DNA, 25 bp, Mus musculus
tgcagaaagcagcgctgactgtgaa

SEQ ID NO: 977159 - DNA, 25 bp, Mus musculus
tgcagaaagcaggccgtctactgtg

SEQ ID NO: 977160 - DNA, 25 bp, Mus musculus
tgcagaaagcagggctgactgtgaa

SEQ ID NO: 977161 - DNA, 25 bp, Mus musculus
tgcagaaatacgcagatttgtagtt

SEQ ID NO: 977162 - DNA, 25 bp, Mus musculus
tgcagaaataggcagatttgtagtt

SEQ ID NO: 977163 - DNA, 25 bp, Mus musculus
tgcagaaattgaagagagagaagcg

SEQ ID NO: 977164 - DNA, 25 bp, Mus musculus
tgcagaaattgatgagagagaagcg

SEQ ID NO: 977165 - DNA, 25 bp, Mus musculus
tgcagaacaccacgtacgctctatg

SEQ ID NO: 977166 - DNA, 25 bp, Mus musculus
tgcagaacaccaggtacgctctatg

SEQ ID NO: 977167 - DNA, 25 bp, Mus musculus
tgcagaacagcgctgttttgcggct

SEQ ID NO: 977168 - DNA, 25 bp, Mus musculus
tgcagaacagggctgttttgcggct

SEQ ID NO: 977169 - DNA, 25 bp, Mus musculus
tgcagaagaaacacatggtgatgtg

SEQ ID NO: 977170 - DNA, 25 bp, Mus musculus
tgcagaagaaactcatggtgatgtg

SEQ ID NO: 977171 - DNA, 25 bp, Mus musculus
tgcagaagagaagaaaaattcaacg

SEQ ID NO: 977172 - DNA, 25 bp, Mus musculus
tgcagaagagatagcaaaacgtgga

SEQ ID NO: 977173 - DNA, 25 bp, Mus musculus
tgcagaagagtagaaaaattcaacg

SEQ ID NO: 977174 - DNA, 25 bp, Mus musculus
tgcagaagagttagcaaaacgtgga

SEQ ID NO: 977175 - DNA, 25 bp, Mus musculus
tgcagaagcgggccactccagtgaa

SEQ ID NO: 977176 - DNA, 25 bp, Mus musculus
tgcagaagcggggcactccagtgaa

SEQ ID NO: 977177 - DNA, 25 bp, Mus musculus
tgcagaatcacagaaggaacaatgt

SEQ ID NO: 977178 - DNA, 25 bp, Mus musculus
tgcagaatcacagatggaacaatgt

SEQ ID NO: 977179 - DNA, 25 bp, Mus musculus
tgcagaatcgcccagcgcccgagga

SEQ ID NO: 977180 - DNA, 25 bp, Mus musculus
tgcagaatcggccagcgcccgagga

SEQ ID NO: 977181 - DNA, 25 bp, Mus musculus
tgcagaccacccaggctttaaagat

SEQ ID NO: 977182 - DNA, 25 bp, Mus musculus
tgcagaccaccctggctttaaagat

SEQ ID NO: 977183 - DNA, 25 bp, Mus musculus
tgcagaccatcactcccctgttctc

SEQ ID NO: 977184 - DNA, 25 bp, Mus musculus
tgcagaccatcagtcccctgttctc

SEQ ID NO: 977185 - DNA, 25 bp, Mus musculus
tgcagaccatggcgccgaggaggac

SEQ ID NO: 977186 - DNA, 25 bp, Mus musculus
tgcagaccatggggccgaggaggac

SEQ ID NO: 977187 - DNA, 25 bp, Mus musculus
tgcagacctcaccgacacactggat

SEQ ID NO: 977188 - DNA, 25 bp, Mus musculus
tgcagacctcaccttcctcacaggt

SEQ ID NO: 977189 - DNA, 25 bp, Mus musculus
tgcagacctcacggacacactggat

SEQ ID NO: 977190 - DNA, 25 bp, Mus musculus
tgcagacctcacgttcctcacaggt

SEQ ID NO: 977191 - DNA, 25 bp, Mus musculus
tgcagacctctgacaaggatgagag

SEQ ID NO: 977192 - DNA, 25 bp, Mus musculus
tgcagacctctgagcgaacatccca

SEQ ID NO: 977193 - DNA, 25 bp, Mus musculus
tgcagacctctgtcaaggatgagag

SEQ ID NO: 977194 - DNA, 25 bp, Mus musculus
tgcagacctctgtgcgaacatccca

SEQ ID NO: 977195 - DNA, 25 bp, Mus musculus
tgcagacggggacggcagaagatgc

SEQ ID NO: 977196 - DNA, 25 bp, Mus musculus
tgcagacggggagggcagaagatgc

SEQ ID NO: 977197 - DNA, 25 bp, Mus musculus
tgcagacttaggcgatggtggttgt

SEQ ID NO: 977198 - DNA, 25 bp, Mus musculus
tgcagacttaggggatggtggttgt

SEQ ID NO: 977199 - DNA, 25 bp, Mus musculus
tgcagagaagaatcttcctgcactt

SEQ ID NO: 977200 - DNA, 25 bp, Mus musculus
tgcagagaagtatcttcctgcactt

SEQ ID NO: 977201 - DNA, 25 bp, Mus musculus
tgcagagatgagacaaggaatgagt

SEQ ID NO: 977202 - DNA, 25 bp, Mus musculus
tgcagagatgagtcaaggaatgagt

SEQ ID NO: 977203 - DNA, 25 bp, Mus musculus
tgcagagatgcagcggctgcagggc

SEQ ID NO: 977204 - DNA, 25 bp, Mus musculus
tgcagagatggagcggctgcagggc

SEQ ID NO: 977205 - DNA, 25 bp, Mus musculus
tgcagagattttatctccgaatgac

SEQ ID NO: 977206 - DNA, 25 bp, Mus musculus
tgcagagattttttctccgaatgac

SEQ ID NO: 977207 - DNA, 25 bp, Mus musculus
tgcagagcagatctggtggccctcc

SEQ ID NO: 977208 - DNA, 25 bp, Mus musculus
tgcagagcagcacgaacctgtgtct

SEQ ID NO: 977209 - DNA, 25 bp, Mus musculus
tgcagagcagcaggaacctgtgtct

SEQ ID NO: 977210 - DNA, 25 bp, Mus musculus
tgcagagcagttctggtggccctcc

SEQ ID NO: 977211 - DNA, 25 bp, Mus musculus
tgcagagccacgctcaagatgctga

SEQ ID NO: 977212 - DNA, 25 bp, Mus musculus
tgcagagccacggtcaagatgctga

SEQ ID NO: 977213 - DNA, 25 bp, Mus musculus
tgcagagccagtcagccctgcctag

SEQ ID NO: 977214 - DNA, 25 bp, Mus musculus
tgcagagccagtgagccctgcctag

SEQ ID NO: 977215 - DNA, 25 bp, Mus musculus
tgcagagcctcgcagggtgccattt

SEQ ID NO: 977216 - DNA, 25 bp, Mus musculus
tgcagagcctggcagggtgccattt

SEQ ID NO: 977217 - DNA, 25 bp, Mus musculus
tgcagaggaaaaagaagccctcctg

SEQ ID NO: 977218 - DNA, 25 bp, Mus musculus
tgcagaggaaaatgaagccctcctg

SEQ ID NO: 977219 - DNA, 25 bp, Mus musculus
tgcagaggaggagactgagttcacc

SEQ ID NO: 977220 - DNA, 25 bp, Mus musculus
tgcagaggaggagagtgagttcacc

SEQ ID NO: 977221 - DNA, 25 bp, Mus musculus
tgcagaggataactactctcagaag

SEQ ID NO: 977222 - DNA, 25 bp, Mus musculus
tgcagaggataagtactctcagaag

SEQ ID NO: 977223 - DNA, 25 bp, Mus musculus
tgcagaggatgcgacgcatttccaa

SEQ ID NO: 977224 - DNA, 25 bp, Mus musculus
tgcagaggatgcgaggcatttccaa

SEQ ID NO: 977225 - DNA, 25 bp, Mus musculus
tgcagaggcacatataatggaacta

SEQ ID NO: 977226 - DNA, 25 bp, Mus musculus
tgcagaggcagatataatggaacta

SEQ ID NO: 977227 - DNA, 25 bp, Mus musculus
tgcagaggccagagctattaagaat

SEQ ID NO: 977228 - DNA, 25 bp, Mus musculus
tgcagaggccagtgctattaagaat

SEQ ID NO: 977229 - DNA, 25 bp, Mus musculus
tgcagaggttccatcttcagaattt

SEQ ID NO: 977230 - DNA, 25 bp, Mus musculus
tgcagaggttccatgttcagaattt

SEQ ID NO: 977231 - DNA, 25 bp, Mus musculus
tgcagagtcaagcagaagccaatgc

SEQ ID NO: 977232 - DNA, 25 bp, Mus musculus
tgcagagtcaaggagaagccaatgc

SEQ ID NO: 977233 - DNA, 25 bp, Mus musculus
tgcagagtgctgatcagggcactga

SEQ ID NO: 977234 - DNA, 25 bp, Mus musculus
tgcagagtgctgttcagggcactga

SEQ ID NO: 977235 - DNA, 25 bp, Mus musculus
tgcagataagactgtagctttatgg

SEQ ID NO: 977236 - DNA, 25 bp, Mus musculus
tgcagataagtctgtagctttatgg

SEQ ID NO: 977237 - DNA, 25 bp, Mus musculus
tgcagatatgcccacgcaatagaga

SEQ ID NO: 977238 - DNA, 25 bp, Mus musculus
tgcagatatgcccaggcaatagaga

SEQ ID NO: 977239 - DNA, 25 bp, Mus musculus
tgcagatcaccgaacccaacctcac

SEQ ID NO: 977240 - DNA, 25 bp, Mus musculus
tgcagatcaccgaagccaacctcac

SEQ ID NO: 977241 - DNA, 25 bp, Mus musculus
tgcagatcagaatcaagctcatggc

SEQ ID NO: 977242 - DNA, 25 bp, Mus musculus
tgcagatcagtatcaagctcatggc

SEQ ID NO: 977243 - DNA, 25 bp, Mus musculus
tgcagatggaaacatgacatcgttc

SEQ ID NO: 977244 - DNA, 25 bp, Mus musculus
tgcagatggaaagatgacatcgttc

SEQ ID NO: 977245 - DNA, 25 bp, Mus musculus
tgcagattcaaaagaccagcagtta

SEQ ID NO: 977246 - DNA, 25 bp, Mus musculus
tgcagattcaaacttcacagtcaga

SEQ ID NO: 977247 - DNA, 25 bp, Mus musculus
tgcagattcaaagttcacagtcaga

SEQ ID NO: 977248 - DNA, 25 bp, Mus musculus
tgcagattcaaatgaccagcagtta

SEQ ID NO: 977249 - DNA, 25 bp, Mus musculus
tgcagattcaggaacgcgcagtggc

SEQ ID NO: 977250 - DNA, 25 bp, Mus musculus
tgcagattcaggaaggcgcagtggc

SEQ ID NO: 977251 - DNA, 25 bp, Mus musculus
tgcagcaaagccaccatgccaatca

SEQ ID NO: 977252 - DNA, 25 bp, Mus musculus
tgcagcaaaggcaccatgccaatca

SEQ ID NO: 977253 - DNA, 25 bp, Mus musculus
tgcagcaaccaacctgtgattggac

SEQ ID NO: 977254 - DNA, 25 bp, Mus musculus
tgcagcaaccaacgagacagtgatg

SEQ ID NO: 977255 - DNA, 25 bp, Mus musculus
tgcagcaaccaagctgtgattggac

SEQ ID NO: 977256 - DNA, 25 bp, Mus musculus
tgcagcaaccaaggagacagtgatg

SEQ ID NO: 977257 - DNA, 25 bp, Mus musculus
tgcagcacagcccatccatccaggc

SEQ ID NO: 977258 - DNA, 25 bp, Mus musculus
tgcagcacaggccatccatccaggc

SEQ ID NO: 977259 - DNA, 25 bp, Mus musculus
tgcagcacttcactgctgtcttcct

SEQ ID NO: 977260 - DNA, 25 bp, Mus musculus
tgcagcacttcagtgctgtcttcct

SEQ ID NO: 977261 - DNA, 25 bp, Mus musculus
tgcagcagaaaacaaatatggaagg

SEQ ID NO: 977262 - DNA, 25 bp, Mus musculus
tgcagcagaaaagaaatatggaagg

SEQ ID NO: 977263 - DNA, 25 bp, Mus musculus
tgcagcagtgtgaacggctcaggat

SEQ ID NO: 977264 - DNA, 25 bp, Mus musculus
tgcagcagtgtgaagggctcaggat

SEQ ID NO: 977265 - DNA, 25 bp, Mus musculus
tgcagcatccagctcacctacttcc

SEQ ID NO: 977266 - DNA, 25 bp, Mus musculus
tgcagcatccaggtcacctacttcc

SEQ ID NO: 977267 - DNA, 25 bp, Mus musculus
tgcagcatctgacgaacaagcaatg

SEQ ID NO: 977268 - DNA, 25 bp, Mus musculus
tgcagcatctgacgaagactcttca

SEQ ID NO: 977269 - DNA, 25 bp, Mus musculus
tgcagcatctgaggaacaagcaatg

SEQ ID NO: 977270 - DNA, 25 bp, Mus musculus
tgcagcatctgaggaagactcttca

SEQ ID NO: 977271 - DNA, 25 bp, Mus musculus
tgcagccaagcaccacaacatgccc

SEQ ID NO: 977272 - DNA, 25 bp, Mus musculus
tgcagccaagcagcacaacatgccc

SEQ ID NO: 977273 - DNA, 25 bp, Mus musculus
tgcagccaagcagcctgtacgggag

SEQ ID NO: 977274 - DNA, 25 bp, Mus musculus
tgcagccaagcccacagaggatcaa

SEQ ID NO: 977275 - DNA, 25 bp, Mus musculus
tgcagccaaggagcctgtacgggag

SEQ ID NO: 977276 - DNA, 25 bp, Mus musculus
tgcagccaaggccacagaggatcaa

SEQ ID NO: 977277 - DNA, 25 bp, Mus musculus
tgcagccagaagaatatccagttat

SEQ ID NO: 977278 - DNA, 25 bp, Mus musculus
tgcagccagaagcagcgtttgacgt

SEQ ID NO: 977279 - DNA, 25 bp, Mus musculus
tgcagccagaagcgtttgacgtcat

SEQ ID NO: 977280 - DNA, 25 bp, Mus musculus
tgcagccagaaggagcgtttgacgt

SEQ ID NO: 977281 - DNA, 25 bp, Mus musculus
tgcagccagaagggtttgacgtcat

SEQ ID NO: 977282 - DNA, 25 bp, Mus musculus
tgcagccagaagtatatccagttat

SEQ ID NO: 977283 - DNA, 25 bp, Mus musculus
tgcagccagcagagtgccaggtgat

SEQ ID NO: 977284 - DNA, 25 bp, Mus musculus
tgcagccagcagtgtgccaggtgat

SEQ ID NO: 977285 - DNA, 25 bp, Mus musculus
tgcagccaggccctgtgtcaaatca

SEQ ID NO: 977286 - DNA, 25 bp, Mus musculus
tgcagccaggcgatgacgtggtctc

SEQ ID NO: 977287 - DNA, 25 bp, Mus musculus
tgcagccaggcgttgacgtggtctc

SEQ ID NO: 977288 - DNA, 25 bp, Mus musculus
tgcagccagggcctgtgtcaaatca

SEQ ID NO: 977289 - DNA, 25 bp, Mus musculus
tgcagcccagaacggtgtgcagatt

SEQ ID NO: 977290 - DNA, 25 bp, Mus musculus
tgcagcccagaagggtgtgcagatt

SEQ ID NO: 977291 - DNA, 25 bp, Mus musculus
tgcagccccccacgacacaaaggct

SEQ ID NO: 977292 - DNA, 25 bp, Mus musculus
tgcagccccccaggacacaaaggct

SEQ ID NO: 977293 - DNA, 25 bp, Mus musculus
tgcagccgagcgaatgggcttggaa

SEQ ID NO: 977294 - DNA, 25 bp, Mus musculus
tgcagccgagggaatgggcttggaa

SEQ ID NO: 977295 - DNA, 25 bp, Mus musculus
tgcagccgcaatcgatccaagttcg

SEQ ID NO: 977296 - DNA, 25 bp, Mus musculus
tgcagccgcaatggatccaagttcg

SEQ ID NO: 977297 - DNA, 25 bp, Mus musculus
tgcagccgcccgcccatctgcttca

SEQ ID NO: 977298 - DNA, 25 bp, Mus musculus
tgcagccgcccgcgacaggccatct

SEQ ID NO: 977299 - DNA, 25 bp, Mus musculus
tgcagccgcccggccatctgcttca

SEQ ID NO: 977300 - DNA, 25 bp, Mus musculus
tgcagccgcccgggacaggccatct

SEQ ID NO: 977301 - DNA, 25 bp, Mus musculus
tgcagccgtctgattgtgaagaccg

SEQ ID NO: 977302 - DNA, 25 bp, Mus musculus
tgcagccgtctgtttgtgaagaccg

SEQ ID NO: 977303 - DNA, 25 bp, Mus musculus
tgcagcctccaaaacgtgttcttct

SEQ ID NO: 977304 - DNA, 25 bp, Mus musculus
tgcagcctccaaaaggtgttcttct

SEQ ID NO: 977305 - DNA, 25 bp, Mus musculus
tgcagcctctctccggatagcttct

SEQ ID NO: 977306 - DNA, 25 bp, Mus musculus
tgcagcctctgtccggatagcttct

SEQ ID NO: 977307 - DNA, 25 bp, Mus musculus
tgcagcctgtaaccccagcactatg

SEQ ID NO: 977308 - DNA, 25 bp, Mus musculus
tgcagcctgtaacttcttgcagata

SEQ ID NO: 977309 - DNA, 25 bp, Mus musculus
tgcagcctgtaagcccagcactatg

SEQ ID NO: 977310 - DNA, 25 bp, Mus musculus
tgcagcctgtaagttcttgcagata

SEQ ID NO: 977311 - DNA, 25 bp, Mus musculus
tgcagcgacgcatcgaagcctgttc

SEQ ID NO: 977312 - DNA, 25 bp, Mus musculus
tgcagcgacggatcgaagcctgttc

SEQ ID NO: 977313 - DNA, 25 bp, Mus musculus
tgcagcgatcagctaatagtgcagc

SEQ ID NO: 977314 - DNA, 25 bp, Mus musculus
tgcagcgatcaggtaatagtgcagc

SEQ ID NO: 977315 - DNA, 25 bp, Mus musculus
tgcagcgatgggagagggagccgag

SEQ ID NO: 977316 - DNA, 25 bp, Mus musculus
tgcagcgatgggagtgggagccgag

SEQ ID NO: 977317 - DNA, 25 bp, Mus musculus
tgcagcgcaggaccttcagccagat

SEQ ID NO: 977318 - DNA, 25 bp, Mus musculus
tgcagcgcaggagcttcagccagat

SEQ ID NO: 977319 - DNA, 25 bp, Mus musculus
tgcagctaagccagaaaagatagca

SEQ ID NO: 977320 - DNA, 25 bp, Mus musculus
tgcagctaaggcagaaaagatagca

SEQ ID NO: 977321 - DNA, 25 bp, Mus musculus
tgcagctacgcacactactgctaga

SEQ ID NO: 977322 - DNA, 25 bp, Mus musculus
tgcagctacggacactactgctaga

SEQ ID NO: 977323 - DNA, 25 bp, Mus musculus
tgcagctatgcctgggttgcggccc

SEQ ID NO: 977324 - DNA, 25 bp, Mus musculus
tgcagctatggctgggttgcggccc

SEQ ID NO: 977325 - DNA, 25 bp, Mus musculus
tgcagctattcacctgctgggcatg

SEQ ID NO: 977326 - DNA, 25 bp, Mus musculus
tgcagctattcagctgctgggcatg

SEQ ID NO: 977327 - DNA, 25 bp, Mus musculus
tgcagctcaaaacggaaattatcgc

SEQ ID NO: 977328 - DNA, 25 bp, Mus musculus
tgcagctcaaaagggaaattatcgc

SEQ ID NO: 977329 - DNA, 25 bp, Mus musculus
tgcagctcagaagcagatccagagc

SEQ ID NO: 977330 - DNA, 25 bp, Mus musculus
tgcagctcagcgggtgatagctgga

SEQ ID NO: 977331 - DNA, 25 bp, Mus musculus
tgcagctcagggggtgatagctgga

SEQ ID NO: 977332 - DNA, 25 bp, Mus musculus
tgcagctcagtagcagatccagagc

SEQ ID NO: 977333 - DNA, 25 bp, Mus musculus
tgcagctcttcttatttacgtcgaa

SEQ ID NO: 977334 - DNA, 25 bp, Mus musculus
tgcagctcttggattacccatcgcc

SEQ ID NO: 977335 - DNA, 25 bp, Mus musculus
tgcagctcttggtttacccatcgcc

SEQ ID NO: 977336 - DNA, 25 bp, Mus musculus
tgcagctcttgttatttacgtcgaa

SEQ ID NO: 977337 - DNA, 25 bp, Mus musculus
tgcagctgagaccacgtgaagtcac

SEQ ID NO: 977338 - DNA, 25 bp, Mus musculus
tgcagctgagccgtaagttggattt

SEQ ID NO: 977339 - DNA, 25 bp, Mus musculus
tgcagctgaggcgtaagttggattt

SEQ ID NO: 977340 - DNA, 25 bp, Mus musculus
tgcagctgagtccacgtgaagtcac

SEQ ID NO: 977341 - DNA, 25 bp, Mus musculus
tgcagctgcaaacgagggctgctgg

SEQ ID NO: 977342 - DNA, 25 bp, Mus musculus
tgcagctgcaaaggagggctgctgg

SEQ ID NO: 977343 - DNA, 25 bp, Mus musculus
tgcagctgcgagcctctacacagag

SEQ ID NO: 977344 - DNA, 25 bp, Mus musculus
tgcagctgcgaggctctacacagag

SEQ ID NO: 977345 - DNA, 25 bp, Mus musculus
tgcagctgctcatcgaggagcagga

SEQ ID NO: 977346 - DNA, 25 bp, Mus musculus
tgcagctgctgatcgaggagcagga

SEQ ID NO: 977347 - DNA, 25 bp, Mus musculus
tgcagctggagtctgtcgcaagcag

SEQ ID NO: 977348 - DNA, 25 bp, Mus musculus
tgcagctggagtgtgtcgcaagcag

SEQ ID NO: 977349 - DNA, 25 bp, Mus musculus
tgcaggaaaacaatgctgatagccc

SEQ ID NO: 977350 - DNA, 25 bp, Mus musculus
tgcaggaaaacattgctgatagccc

SEQ ID NO: 977351 - DNA, 25 bp, Mus musculus
tgcaggaaactgcagtgtgggttcg

SEQ ID NO: 977352 - DNA, 25 bp, Mus musculus
tgcaggaaactggagtgtgggttcg

SEQ ID NO: 977353 - DNA, 25 bp, Mus musculus
tgcaggaacaagcatatcaataaag

SEQ ID NO: 977354 - DNA, 25 bp, Mus musculus
tgcaggaacaaggatatcaataaag

SEQ ID NO: 977355 - DNA, 25 bp, Mus musculus
tgcaggaacacaaactgaaagtcgc

SEQ ID NO: 977356 - DNA, 25 bp, Mus musculus
tgcaggaacacatactgaaagtcgc

SEQ ID NO: 977357 - DNA, 25 bp, Mus musculus
tgcaggacagcaggattacaaccag

SEQ ID NO: 977358 - DNA, 25 bp, Mus musculus
tgcaggacagctggcctctgatgat

SEQ ID NO: 977359 - DNA, 25 bp, Mus musculus
tgcaggacaggaggattacaaccag

SEQ ID NO: 977360 - DNA, 25 bp, Mus musculus
tgcaggacaggtggcctctgatgat

SEQ ID NO: 977361 - DNA, 25 bp, Mus musculus
tgcaggacatctcctggcagcttgt

SEQ ID NO: 977362 - DNA, 25 bp, Mus musculus
tgcaggacatgtcctggcagcttgt

SEQ ID NO: 977363 - DNA, 25 bp, Mus musculus
tgcaggaccacacaactacagctga

SEQ ID NO: 977364 - DNA, 25 bp, Mus musculus
tgcaggaccacacttatatatcttc

SEQ ID NO: 977365 - DNA, 25 bp, Mus musculus
tgcaggaccacagaactacagctga

SEQ ID NO: 977366 - DNA, 25 bp, Mus musculus
tgcaggaccacagttatatatcttc

SEQ ID NO: 977367 - DNA, 25 bp, Mus musculus
tgcaggactgcgctacacagagaaa

SEQ ID NO: 977368 - DNA, 25 bp, Mus musculus
tgcaggactgcgctacgcagatcaa

SEQ ID NO: 977369 - DNA, 25 bp, Mus musculus
tgcaggactgggctacacagagaaa

SEQ ID NO: 977370 - DNA, 25 bp, Mus musculus
tgcaggactgggctacgcagatcaa

SEQ ID NO: 977371 - DNA, 25 bp, Mus musculus
tgcaggagaagaacacaagagggaa

SEQ ID NO: 977372 - DNA, 25 bp, Mus musculus
tgcaggagaagaaggtggatcgcac

SEQ ID NO: 977373 - DNA, 25 bp, Mus musculus
tgcaggagaagatcacaagagggaa

SEQ ID NO: 977374 - DNA, 25 bp, Mus musculus
tgcaggagaagatggtggatcgcac

SEQ ID NO: 977375 - DNA, 25 bp, Mus musculus
tgcaggagagctgcagtatgatgtc

SEQ ID NO: 977376 - DNA, 25 bp, Mus musculus
tgcaggagaggtgcagtatgatgtc

SEQ ID NO: 977377 - DNA, 25 bp, Mus musculus
tgcaggagcagcagacaggtctgat

SEQ ID NO: 977378 - DNA, 25 bp, Mus musculus
tgcaggagcagctgacaggtctgat

SEQ ID NO: 977379 - DNA, 25 bp, Mus musculus
tgcaggatcgacagagacctactgc

SEQ ID NO: 977380 - DNA, 25 bp, Mus musculus
tgcaggatcgactgagacctactgc

SEQ ID NO: 977381 - DNA, 25 bp, Mus musculus
tgcaggccaagaaacagactgcagc

SEQ ID NO: 977382 - DNA, 25 bp, Mus musculus
tgcaggccaagatacagactgcagc

SEQ ID NO: 977383 - DNA, 25 bp, Mus musculus
tgcaggccatctcacctgatgaaga

SEQ ID NO: 977384 - DNA, 25 bp, Mus musculus
tgcaggccatctcagctgatgaaga

SEQ ID NO: 977385 - DNA, 25 bp, Mus musculus
tgcaggcccaagcctccattgaggg

SEQ ID NO: 977386 - DNA, 25 bp, Mus musculus
tgcaggcccaagctctccatggtgg

SEQ ID NO: 977387 - DNA, 25 bp, Mus musculus
tgcaggcccaaggctccattgaggg

SEQ ID NO: 977388 - DNA, 25 bp, Mus musculus
tgcaggcccaaggtctccatggtgg

SEQ ID NO: 977389 - DNA, 25 bp, Mus musculus
tgcaggcccgctcccgagatgaaat

SEQ ID NO: 977390 - DNA, 25 bp, Mus musculus
tgcaggcccggtcccgagatgaaat

SEQ ID NO: 977391 - DNA, 25 bp, Mus musculus
tgcaggcgcgagcttctgcagaccc

SEQ ID NO: 977392 - DNA, 25 bp, Mus musculus
tgcaggcgcgaggttctgcagaccc

SEQ ID NO: 977393 - DNA, 25 bp, Mus musculus
tgcaggcggcatgaagatgagcagc

SEQ ID NO: 977394 - DNA, 25 bp, Mus musculus
tgcaggcggcccaagatgtccatct

SEQ ID NO: 977395 - DNA, 25 bp, Mus musculus
tgcaggcggcgcaagatgtccatct

SEQ ID NO: 977396 - DNA, 25 bp, Mus musculus
tgcaggcggcttgaagatgagcagc

SEQ ID NO: 977397 - DNA, 25 bp, Mus musculus
tgcaggcgtgagcaaactgctgtca

SEQ ID NO: 977398 - DNA, 25 bp, Mus musculus
tgcaggcgtgaggaaactgctgtca

SEQ ID NO: 977399 - DNA, 25 bp, Mus musculus
tgcagggaggctgtttgtgttctgt

SEQ ID NO: 977400 - DNA, 25 bp, Mus musculus
tgcagggagggtgtttgtgttctgt

SEQ ID NO: 977401 - DNA, 25 bp, Mus musculus
tgcagggcccagcaattgcattggg

SEQ ID NO: 977402 - DNA, 25 bp, Mus musculus
tgcagggcccaggaattgcattggg

SEQ ID NO: 977403 - DNA, 25 bp, Mus musculus
tgcaggggacaacatcacctttgca

SEQ ID NO: 977404 - DNA, 25 bp, Mus musculus
tgcaggggacaagatcacctttgca

SEQ ID NO: 977405 - DNA, 25 bp, Mus musculus
tgcagggtgcagggacctgatcaca

SEQ ID NO: 977406 - DNA, 25 bp, Mus musculus
tgcagggtgcagggtcctgatcaca

SEQ ID NO: 977407 - DNA, 25 bp, Mus musculus
tgcaggtcaatgaccccgtccgtgt

SEQ ID NO: 977408 - DNA, 25 bp, Mus musculus
tgcaggtcaatgtccccgtccgtgt

SEQ ID NO: 977409 - DNA, 25 bp, Mus musculus
tgcaggtccagacattccctactcc

SEQ ID NO: 977410 - DNA, 25 bp, Mus musculus
tgcaggtccagagattccctactcc

SEQ ID NO: 977411 - DNA, 25 bp, Mus musculus
tgcaggtctggtaacgggcccatcc

SEQ ID NO: 977412 - DNA, 25 bp, Mus musculus
tgcaggtctggtaaggggcccatcc

SEQ ID NO: 977413 - DNA, 25 bp, Mus musculus
tgcaggtgtatgatgaagaccctcg

SEQ ID NO: 977414 - DNA, 25 bp, Mus musculus
tgcaggtgtatgttgaagaccctcg

SEQ ID NO: 977415 - DNA, 25 bp, Mus musculus
tgcagtaaagattgtgcaagatgca

SEQ ID NO: 977416 - DNA, 25 bp, Mus musculus
tgcagtaaagtttgtgcaagatgca

SEQ ID NO: 977417 - DNA, 25 bp, Mus musculus
tgcagtaattcccaaatcaacatgc

SEQ ID NO: 977418 - DNA, 25 bp, Mus musculus
tgcagtaattcccagtcctgaagaa

SEQ ID NO: 977419 - DNA, 25 bp, Mus musculus
tgcagtaattccgaaatcaacatgc

SEQ ID NO: 977420 - DNA, 25 bp, Mus musculus
tgcagtaattccgagtcctgaagaa

SEQ ID NO: 977421 - DNA, 25 bp, Mus musculus
tgcagtacctaaatttctctacaat

SEQ ID NO: 977422 - DNA, 25 bp, Mus musculus
tgcagtacctaattttctctacaat

SEQ ID NO: 977423 - DNA, 25 bp, Mus musculus
tgcagtagggcctgctgaataatga

SEQ ID NO: 977424 - DNA, 25 bp, Mus musculus
tgcagtaggggctgctgaataatga

SEQ ID NO: 977425 - DNA, 25 bp, Mus musculus
tgcagtcaaaagacaaggaacagta

SEQ ID NO: 977426 - DNA, 25 bp, Mus musculus
tgcagtcaaatgacaaggaacagta

SEQ ID NO: 977427 - DNA, 25 bp, Mus musculus
tgcagtcatgcctcttgagaataac

SEQ ID NO: 977428 - DNA, 25 bp, Mus musculus
tgcagtcatggctcttgagaataac

SEQ ID NO: 977429 - DNA, 25 bp, Mus musculus
tgcagtcctgctgtgagaagctggc

SEQ ID NO: 977430 - DNA, 25 bp, Mus musculus
tgcagtcctggtgtgagaagctggc

SEQ ID NO: 977431 - DNA, 25 bp, Mus musculus
tgcagtcgtgagctaccgaaagaag

SEQ ID NO: 977432 - DNA, 25 bp, Mus musculus
tgcagtcgtgaggtaccgaaagaag

SEQ ID NO: 977433 - DNA, 25 bp, Mus musculus
tgcagtgaaacgtgtgtttgaccat

SEQ ID NO: 977434 - DNA, 25 bp, Mus musculus
tgcagtgaaaggtgtgtttgaccat

SEQ ID NO: 977435 - DNA, 25 bp, Mus musculus
tgcagtgaccagaacatcaaactga

SEQ ID NO: 977436 - DNA, 25 bp, Mus musculus
tgcagtgaccagtacatcaaactga

SEQ ID NO: 977437 - DNA, 25 bp, Mus musculus
tgcagtgcagccaatacagagtgct

SEQ ID NO: 977438 - DNA, 25 bp, Mus musculus
tgcagtgcaggcaatacagagtgct

SEQ ID NO: 977439 - DNA, 25 bp, Mus musculus
tgcagtgggtttctcgatcttgggt

SEQ ID NO: 977440 - DNA, 25 bp, Mus musculus
tgcagtgggtttctggatcttgggt

SEQ ID NO: 977441 - DNA, 25 bp, Mus musculus
tgcagtggttagcgtgtcgtagtca

SEQ ID NO: 977442 - DNA, 25 bp, Mus musculus
tgcagtggttagggtgtcgtagtca

SEQ ID NO: 977443 - DNA, 25 bp, Mus musculus
tgcagtgtaaagattgcaaattcaa

SEQ ID NO: 977444 - DNA, 25 bp, Mus musculus
tgcagtgtaaagtttgcaaattcaa

SEQ ID NO: 977445 - DNA, 25 bp, Mus musculus
tgcagtgttgctaacgacaaggcct

SEQ ID NO: 977446 - DNA, 25 bp, Mus musculus
tgcagtgttgctaaggacaaggcct

SEQ ID NO: 977447 - DNA, 25 bp, Mus musculus
tgcagttaagagaacagcacattag

SEQ ID NO: 977448 - DNA, 25 bp, Mus musculus
tgcagttaagagcatcgctgcagag

SEQ ID NO: 977449 - DNA, 25 bp, Mus musculus
tgcagttaagaggatcgctgcagag

SEQ ID NO: 977450 - DNA, 25 bp, Mus musculus
tgcagttaagagtacagcacattag

SEQ ID NO: 977451 - DNA, 25 bp, Mus musculus
tgcagttaattgcccgggaagagtc

SEQ ID NO: 977452 - DNA, 25 bp, Mus musculus
tgcagttaattggccgggaagagtc

SEQ ID NO: 977453 - DNA, 25 bp, Mus musculus
tgcagttacgtacgtctggtcagct

SEQ ID NO: 977454 - DNA, 25 bp, Mus musculus
tgcagttacgtaggtctggtcagct

SEQ ID NO: 977455 - DNA, 25 bp, Mus musculus
tgcagttatgcacaacttgtcacaa

SEQ ID NO: 977456 - DNA, 25 bp, Mus musculus
tgcagttatgcagaacttgtcacaa

SEQ ID NO: 977457 - DNA, 25 bp, Mus musculus
tgcagttccaacaatccccaaagcc

SEQ ID NO: 977458 - DNA, 25 bp, Mus musculus
tgcagttccaactatccccaaagcc

SEQ ID NO: 977459 - DNA, 25 bp, Mus musculus
tgcagttccgcacgctcagggaaga

SEQ ID NO: 977460 - DNA, 25 bp, Mus musculus
tgcagttccgcaggctcagggaaga

SEQ ID NO: 977461 - DNA, 25 bp, Mus musculus
tgcagttgtgtgactatgcaagctg

SEQ ID NO: 977462 - DNA, 25 bp, Mus musculus
tgcagttgtgtgtctatgcaagctg

SEQ ID NO: 977463 - DNA, 25 bp, Mus musculus
tgcagttttcagaaagaagcaactt

SEQ ID NO: 977464 - DNA, 25 bp, Mus musculus
tgcagttttcagtaagaagcaactt

SEQ ID NO: 977465 - DNA, 25 bp, Mus musculus
tgcagttttgacggcatttgctaat

SEQ ID NO: 977466 - DNA, 25 bp, Mus musculus
tgcagttttgacgggatttgctaat

SEQ ID NO: 977467 - DNA, 25 bp, Mus musculus
tgcagttttgagccaagaaatctca

SEQ ID NO: 977468 - DNA, 25 bp, Mus musculus
tgcagttttgaggcaagaaatctca

SEQ ID NO: 977469 - DNA, 25 bp, Mus musculus
tgcataaaatcacctgctcgactga

SEQ ID NO: 977470 - DNA, 25 bp, Mus musculus
tgcataaaatcagctgctcgactga

SEQ ID NO: 977471 - DNA, 25 bp, Mus musculus
tgcataaaatcccaatgccaccgtg

SEQ ID NO: 977472 - DNA, 25 bp, Mus musculus
tgcataaaatcccattgccaccgtg

SEQ ID NO: 977473 - DNA, 25 bp, Mus musculus
tgcataacaaagccatcgcccacag

SEQ ID NO: 977474 - DNA, 25 bp, Mus musculus
tgcataacaaaggcatcgcccacag

SEQ ID NO: 977475 - DNA, 25 bp, Mus musculus
tgcataactaaaccttatgaaatgt

SEQ ID NO: 977476 - DNA, 25 bp, Mus musculus
tgcataactaaagcttatgaaatgt

SEQ ID NO: 977477 - DNA, 25 bp, Mus musculus
tgcatacaagcaacatgctgcctgg

SEQ ID NO: 977478 - DNA, 25 bp, Mus musculus
tgcatacaagcttagcagaggcctg

SEQ ID NO: 977479 - DNA, 25 bp, Mus musculus
tgcatacaaggaacatgctgcctgg

SEQ ID NO: 977480 - DNA, 25 bp, Mus musculus
tgcatacaaggttagcagaggcctg

SEQ ID NO: 977481 - DNA, 25 bp, Mus musculus
tgcatacgctggaacgccatgcgat

SEQ ID NO: 977482 - DNA, 25 bp, Mus musculus
tgcatacgctggaaggccatgcgat

SEQ ID NO: 977483 - DNA, 25 bp, Mus musculus
tgcatacggatgaggagattgccaa

SEQ ID NO: 977484 - DNA, 25 bp, Mus musculus
tgcatacggatgtggagattgccaa

SEQ ID NO: 977485 - DNA, 25 bp, Mus musculus
tgcatatgtacacgcagaccgaagg

SEQ ID NO: 977486 - DNA, 25 bp, Mus musculus
tgcatatgtacactcccagaagtat

SEQ ID NO: 977487 - DNA, 25 bp, Mus musculus
tgcatatgtacaggcagaccgaagg

SEQ ID NO: 977488 - DNA, 25 bp, Mus musculus
tgcatatgtacagtcccagaagtat

SEQ ID NO: 977489 - DNA, 25 bp, Mus musculus
tgcatattcagacctctatcgtcca

SEQ ID NO: 977490 - DNA, 25 bp, Mus musculus
tgcatattcagagctctatcgtcca

SEQ ID NO: 977491 - DNA, 25 bp, Mus musculus
tgcatcaaaacaggctgttcgagaa

SEQ ID NO: 977492 - DNA, 25 bp, Mus musculus
tgcatcaaaagaggctgttcgagaa

SEQ ID NO: 977493 - DNA, 25 bp, Mus musculus
tgcatcaaccctgacacagctcttc

SEQ ID NO: 977494 - DNA, 25 bp, Mus musculus
tgcatcaaccctgactgccaggacc

SEQ ID NO: 977495 - DNA, 25 bp, Mus musculus
tgcatcaaccctgagacagctcttc

SEQ ID NO: 977496 - DNA, 25 bp, Mus musculus
tgcatcaaccctgagtgccaggacc

SEQ ID NO: 977497 - DNA, 25 bp, Mus musculus
tgcatcaaggtacttgtgtcagatg

SEQ ID NO: 977498 - DNA, 25 bp, Mus musculus
tgcatcaaggtagttgtgtcagatg

SEQ ID NO: 977499 - DNA, 25 bp, Mus musculus
tgcatcagacagcgcaacgtttcat

SEQ ID NO: 977500 - DNA, 25 bp, Mus musculus
tgcatcagacagggcaacgtttcat

SEQ ID NO: 977501 - DNA, 25 bp, Mus musculus
tgcatcagcgcatctctcaatctgt

SEQ ID NO: 977502 - DNA, 25 bp, Mus musculus
tgcatcagcggatctctcaatctgt

SEQ ID NO: 977503 - DNA, 25 bp, Mus musculus
tgcatcagtgaccgtaaaccagtca

SEQ ID NO: 977504 - DNA, 25 bp, Mus musculus
tgcatcagtgacggtaaaccagtca

SEQ ID NO: 977505 - DNA, 25 bp, Mus musculus
tgcatcatggcatgtgagccagtgc

SEQ ID NO: 977506 - DNA, 25 bp, Mus musculus
tgcatcatgggatgtgagccagtgc

SEQ ID NO: 977507 - DNA, 25 bp, Mus musculus
tgcatcattcagctttttcctgatg

SEQ ID NO: 977508 - DNA, 25 bp, Mus musculus
tgcatcattcaggtttttcctgatg

SEQ ID NO: 977509 - DNA, 25 bp, Mus musculus
tgcatccagacaaggcacaagtgag

SEQ ID NO: 977510 - DNA, 25 bp, Mus musculus
tgcatccagacatggcacaagtgag

SEQ ID NO: 977511 - DNA, 25 bp, Mus musculus
tgcatccatgcactattcaagagac

SEQ ID NO: 977512 - DNA, 25 bp, Mus musculus
tgcatccatgcagtattcaagagac

SEQ ID NO: 977513 - DNA, 25 bp, Mus musculus
tgcatccctctgccctggttccccg

SEQ ID NO: 977514 - DNA, 25 bp, Mus musculus
tgcatccctctggcctggttccccg

SEQ ID NO: 977515 - DNA, 25 bp, Mus musculus
tgcatccgtatcaactcaacaagga

SEQ ID NO: 977516 - DNA, 25 bp, Mus musculus
tgcatccgtatcaagacatgttcag

SEQ ID NO: 977517 - DNA, 25 bp, Mus musculus
tgcatccgtatctactcaacaagga

SEQ ID NO: 977518 - DNA, 25 bp, Mus musculus
tgcatccgtatctagacatgttcag

SEQ ID NO: 977519 - DNA, 25 bp, Mus musculus
tgcatcctaaatcacctgctgaaat

SEQ ID NO: 977520 - DNA, 25 bp, Mus musculus
tgcatcctaaatcagctgctgaaat

SEQ ID NO: 977521 - DNA, 25 bp, Mus musculus
tgcatcggagctcaccttcgtctcc

SEQ ID NO: 977522 - DNA, 25 bp, Mus musculus
tgcatcggaggtcaccttcgtctcc

SEQ ID NO: 977523 - DNA, 25 bp, Mus musculus
tgcatcgtcttgcacaggttgacag

SEQ ID NO: 977524 - DNA, 25 bp, Mus musculus
tgcatcgtcttgcacgttgacagac

SEQ ID NO: 977525 - DNA, 25 bp, Mus musculus
tgcatcgtcttgcagaggttgacag

SEQ ID NO: 977526 - DNA, 25 bp, Mus musculus
tgcatcgtcttgcaggttgacagac

SEQ ID NO: 977527 - DNA, 25 bp, Mus musculus
tgcatcgtgctccactgtggcgctg

SEQ ID NO: 977528 - DNA, 25 bp, Mus musculus
tgcatcgtgctccagtgtggcgctg

SEQ ID NO: 977529 - DNA, 25 bp, Mus musculus
tgcatctaatcgctcgttgttgaag

SEQ ID NO: 977530 - DNA, 25 bp, Mus musculus
tgcatctaatggctcgttgttgaag

SEQ ID NO: 977531 - DNA, 25 bp, Mus musculus
tgcatctcggaaatactgctgaccc

SEQ ID NO: 977532 - DNA, 25 bp, Mus musculus
tgcatctcggtaatactgctgaccc

SEQ ID NO: 977533 - DNA, 25 bp, Mus musculus
tgcatctctgacctccggatcccac

SEQ ID NO: 977534 - DNA, 25 bp, Mus musculus
tgcatctctgtcctccggatcccac

SEQ ID NO: 977535 - DNA, 25 bp, Mus musculus
tgcatctgacaacgtgcagcaaggg

SEQ ID NO: 977536 - DNA, 25 bp, Mus musculus
tgcatctgacaaggtgcagcaaggg

SEQ ID NO: 977537 - DNA, 25 bp, Mus musculus
tgcatctgagagatcggtcggctgg

SEQ ID NO: 977538 - DNA, 25 bp, Mus musculus
tgcatctgagcaagagatcggtcgg

SEQ ID NO: 977539 - DNA, 25 bp, Mus musculus
tgcatctgaggaagagatcggtcgg

SEQ ID NO: 977540 - DNA, 25 bp, Mus musculus
tgcatctgagtgatcggtcggctgg

SEQ ID NO: 977541 - DNA, 25 bp, Mus musculus
tgcatctgccagacgctgggtccgg

SEQ ID NO: 977542 - DNA, 25 bp, Mus musculus
tgcatctgccagtcgctgggtccgg

SEQ ID NO: 977543 - DNA, 25 bp, Mus musculus
tgcatgaaagcccgcaccatgtatg

SEQ ID NO: 977544 - DNA, 25 bp, Mus musculus
tgcatgaaaggccgcaccatgtatg

SEQ ID NO: 977545 - DNA, 25 bp, Mus musculus
tgcatgaagaagcatgcgggcgcag

SEQ ID NO: 977546 - DNA, 25 bp, Mus musculus
tgcatgaagaaggatgcgggcgcag

SEQ ID NO: 977547 - DNA, 25 bp, Mus musculus
tgcatgaagtcccactggccagtga

SEQ ID NO: 977548 - DNA, 25 bp, Mus musculus
tgcatgaagtcccagtggccagtga

SEQ ID NO: 977549 - DNA, 25 bp, Mus musculus
tgcatgacaaccagcgtggtgcccc

SEQ ID NO: 977550 - DNA, 25 bp, Mus musculus
tgcatgacaaccagggtggtgcccc

SEQ ID NO: 977551 - DNA, 25 bp, Mus musculus
tgcatgacactaaacatggagtgga

SEQ ID NO: 977552 - DNA, 25 bp, Mus musculus
tgcatgacactatacatggagtgga

SEQ ID NO: 977553 - DNA, 25 bp, Mus musculus
tgcatgagtgctgtgacggctgtga

SEQ ID NO: 977554 - DNA, 25 bp, Mus musculus
tgcatgagtggtgtgacggctgtga

SEQ ID NO: 977555 - DNA, 25 bp, Mus musculus
tgcatgcaagccttgttccccctgt

SEQ ID NO: 977556 - DNA, 25 bp, Mus musculus
tgcatgcaagctacagaagaaagat

SEQ ID NO: 977557 - DNA, 25 bp, Mus musculus
tgcatgcaaggcttgttccccctgt

SEQ ID NO: 977558 - DNA, 25 bp, Mus musculus
tgcatgcaaggtacagaagaaagat

SEQ ID NO: 977559 - DNA, 25 bp, Mus musculus
tgcatgcctcctctgaaaacgaggg

SEQ ID NO: 977560 - DNA, 25 bp, Mus musculus
tgcatgcctcctgtgaaaacgaggg

SEQ ID NO: 977561 - DNA, 25 bp, Mus musculus
tgcatgctagcagatgtacgactaa

SEQ ID NO: 977562 - DNA, 25 bp, Mus musculus
tgcatgctaggagatgtacgactaa

SEQ ID NO: 977563 - DNA, 25 bp, Mus musculus
tgcatgctcatgctgggcagcaatg

SEQ ID NO: 977564 - DNA, 25 bp, Mus musculus
tgcatgctcatggtgggcagcaatg

SEQ ID NO: 977565 - DNA, 25 bp, Mus musculus
tgcatgctggagaaacttctctgtc

SEQ ID NO: 977566 - DNA, 25 bp, Mus musculus
tgcatgctggagaatcttctctgtc

SEQ ID NO: 977567 - DNA, 25 bp, Mus musculus
tgcatgggcagacacagccctggac

SEQ ID NO: 977568 - DNA, 25 bp, Mus musculus
tgcatgggcagagacagccctggac

SEQ ID NO: 977569 - DNA, 25 bp, Mus musculus
tgcatgtgctccctctctatagcct

SEQ ID NO: 977570 - DNA, 25 bp, Mus musculus
tgcatgtgctgcctctctatagcct

SEQ ID NO: 977571 - DNA, 25 bp, Mus musculus
tgcatgttcttgcaaacctgatatc

SEQ ID NO: 977572 - DNA, 25 bp, Mus musculus
tgcatgttcttggaaacctgatatc

SEQ ID NO: 977573 - DNA, 25 bp, Mus musculus
tgcatgttgattcaagaagctacta

SEQ ID NO: 977574 - DNA, 25 bp, Mus musculus
tgcatgttgattgaagaagctacta

SEQ ID NO: 977575 - DNA, 25 bp, Mus musculus
tgcatgtttcagctggtttgttgaa

SEQ ID NO: 977576 - DNA, 25 bp, Mus musculus
tgcatgtttcaggtggtttgttgaa

SEQ ID NO: 977577 - DNA, 25 bp, Mus musculus
tgcatgtttgctcaaaacaatggcc

SEQ ID NO: 977578 - DNA, 25 bp, Mus musculus
tgcatgtttgctgaaaacaatggcc

SEQ ID NO: 977579 - DNA, 25 bp, Mus musculus
tgcattacacagcactcccctctca

SEQ ID NO: 977580 - DNA, 25 bp, Mus musculus
tgcattacacaggactcccctctca

SEQ ID NO: 977581 - DNA, 25 bp, Mus musculus
tgcattacagcttggctgttgtcca

SEQ ID NO: 977582 - DNA, 25 bp, Mus musculus
tgcattacaggttggctgttgtcca

SEQ ID NO: 977583 - DNA, 25 bp, Mus musculus
tgcattactgcatacaggaagaaaa

SEQ ID NO: 977584 - DNA, 25 bp, Mus musculus
tgcattactgcatagaggaagaaaa

SEQ ID NO: 977585 - DNA, 25 bp, Mus musculus
tgcattatcaacgactactgtattg

SEQ ID NO: 977586 - DNA, 25 bp, Mus musculus
tgcattatcaacgagtactgtattg

SEQ ID NO: 977587 - DNA, 25 bp, Mus musculus
tgcattcatcccgacgtgactccac

SEQ ID NO: 977588 - DNA, 25 bp, Mus musculus
tgcattcatcccgaggtgactccac

SEQ ID NO: 977589 - DNA, 25 bp, Mus musculus
tgcattctctcaatcgtgtatgccc

SEQ ID NO: 977590 - DNA, 25 bp, Mus musculus
tgcattctctcaatggtgtatgccc

SEQ ID NO: 977591 - DNA, 25 bp, Mus musculus
tgcattctttagctattcctttgga

SEQ ID NO: 977592 - DNA, 25 bp, Mus musculus
tgcattctttaggtattcctttgga

SEQ ID NO: 977593 - DNA, 25 bp, Mus musculus
tgcattgaagcatgtggatacgtgg

SEQ ID NO: 977594 - DNA, 25 bp, Mus musculus
tgcattgaaggatgtggatacgtgg

SEQ ID NO: 977595 - DNA, 25 bp, Mus musculus
tgcattggacagattgtccttctga

SEQ ID NO: 977596 - DNA, 25 bp, Mus musculus
tgcattggacagtttgtccttctga

SEQ ID NO: 977597 - DNA, 25 bp, Mus musculus
tgcattggcggacgtgtggacctcg

SEQ ID NO: 977598 - DNA, 25 bp, Mus musculus
tgcattggcggaggtgtggacctcg

SEQ ID NO: 977599 - DNA, 25 bp, Mus musculus
tgcattgggatgcaactgtccaaga

SEQ ID NO: 977600 - DNA, 25 bp, Mus musculus
tgcattgggatggaactgtccaaga

SEQ ID NO: 977601 - DNA, 25 bp, Mus musculus
tgcatttggacttgcggatcctgta

SEQ ID NO: 977602 - DNA, 25 bp, Mus musculus
tgcatttggacttggggatcctgta

SEQ ID NO: 977603 - DNA, 25 bp, Mus musculus
tgcattttactccacatggcagact

SEQ ID NO: 977604 - DNA, 25 bp, Mus musculus
tgcattttactccacccctggctgt

SEQ ID NO: 977605 - DNA, 25 bp, Mus musculus
tgcattttactccagatggcagact

SEQ ID NO: 977606 - DNA, 25 bp, Mus musculus
tgcattttactccagccctggctgt

SEQ ID NO: 977607 - DNA, 25 bp, Mus musculus
tgccaaaaaagccaaagatgtgacc

SEQ ID NO: 977608 - DNA, 25 bp, Mus musculus
tgccaaaaaagcgaaagatgtgacc

SEQ ID NO: 977609 - DNA, 25 bp, Mus musculus
tgccaaaaacaaacgtgacttggac

SEQ ID NO: 977610 - DNA, 25 bp, Mus musculus
tgccaaaaacaatcgtgacttggac

SEQ ID NO: 977611 - DNA, 25 bp, Mus musculus
tgccaaaaagattctgaagcggaac

SEQ ID NO: 977612 - DNA, 25 bp, Mus musculus
tgccaaaaagcgcttcatccggctc

SEQ ID NO: 977613 - DNA, 25 bp, Mus musculus
tgccaaaaagggcttcatccggctc

SEQ ID NO: 977614 - DNA, 25 bp, Mus musculus
tgccaaaaagtttctgaagcggaac

SEQ ID NO: 977615 - DNA, 25 bp, Mus musculus
tgccaaaactgacgctgagaatacg

SEQ ID NO: 977616 - DNA, 25 bp, Mus musculus
tgccaaaactgaggctgagaatacg

SEQ ID NO: 977617 - DNA, 25 bp, Mus musculus
tgccaaacagatcgaaaaggacctg

SEQ ID NO: 977618 - DNA, 25 bp, Mus musculus
tgccaaacagcttggccgccttgag

SEQ ID NO: 977619 - DNA, 25 bp, Mus musculus
tgccaaacaggttggccgccttgag

SEQ ID NO: 977620 - DNA, 25 bp, Mus musculus
tgccaaacagttcgaaaaggacctg

SEQ ID NO: 977621 - DNA, 25 bp, Mus musculus
tgccaaacttcacataataacagac

SEQ ID NO: 977622 - DNA, 25 bp, Mus musculus
tgccaaacttcagataataacagac

SEQ ID NO: 977623 - DNA, 25 bp, Mus musculus
tgccaaagactgcacagaacttcag

SEQ ID NO: 977624 - DNA, 25 bp, Mus musculus
tgccaaagactgcagagaacttcag

SEQ ID NO: 977625 - DNA, 25 bp, Mus musculus
tgccaaagagatgaaggagtcagcg

SEQ ID NO: 977626 - DNA, 25 bp, Mus musculus
tgccaaagaggacattttcggacca

SEQ ID NO: 977627 - DNA, 25 bp, Mus musculus
tgccaaagaggagattttcggacca

SEQ ID NO: 977628 - DNA, 25 bp, Mus musculus
tgccaaagagttgaaggagtcagcg

SEQ ID NO: 977629 - DNA, 25 bp, Mus musculus
tgccaaagatcttgcaaagcagctg

SEQ ID NO: 977630 - DNA, 25 bp, Mus musculus
tgccaaagatgttgcaaagcagctg

SEQ ID NO: 977631 - DNA, 25 bp, Mus musculus
tgccaaagcaaagaagttctacctc

SEQ ID NO: 977632 - DNA, 25 bp, Mus musculus
tgccaaagcaaagatgttctacctc

SEQ ID NO: 977633 - DNA, 25 bp, Mus musculus
tgccaaagtcaactgtatcccatat

SEQ ID NO: 977634 - DNA, 25 bp, Mus musculus
tgccaaagtcaagtgtatcccatat

SEQ ID NO: 977635 - DNA, 25 bp, Mus musculus
tgccaaagtccatgctgaatggagg

SEQ ID NO: 977636 - DNA, 25 bp, Mus musculus
tgccaaagtccatggtgaatggagg

SEQ ID NO: 977637 - DNA, 25 bp, Mus musculus
tgccaaatatagcaggcactgagga

SEQ ID NO: 977638 - DNA, 25 bp, Mus musculus
tgccaaatataggaggcactgagga

SEQ ID NO: 977639 - DNA, 25 bp, Mus musculus
tgccaaatggcccagcaaggaccca

SEQ ID NO: 977640 - DNA, 25 bp, Mus musculus
tgccaaatgggccagcaaggaccca

SEQ ID NO: 977641 - DNA, 25 bp, Mus musculus
tgccaaattgcctccacttacctgt

SEQ ID NO: 977642 - DNA, 25 bp, Mus musculus
tgccaaattggctccacttacctgt

SEQ ID NO: 977643 - DNA, 25 bp, Mus musculus
tgccaacaagcacgacctccccaat

SEQ ID NO: 977644 - DNA, 25 bp, Mus musculus
tgccaacaagcaggacctccccaat

SEQ ID NO: 977645 - DNA, 25 bp, Mus musculus
tgccaacaagcctacgctgtgttct

SEQ ID NO: 977646 - DNA, 25 bp, Mus musculus
tgccaacaaggctacgctgtgttct

SEQ ID NO: 977647 - DNA, 25 bp, Mus musculus
tgccaaccagaccgagaaagatatc

SEQ ID NO: 977648 - DNA, 25 bp, Mus musculus
tgccaaccagacgtaccaccagact

SEQ ID NO: 977649 - DNA, 25 bp, Mus musculus
tgccaaccagtccgagaaagatatc

SEQ ID NO: 977650 - DNA, 25 bp, Mus musculus
tgccaaccagtcgtaccaccagact

SEQ ID NO: 977651 - DNA, 25 bp, Mus musculus
tgccaacccactgaactccaccatc

SEQ ID NO: 977652 - DNA, 25 bp, Mus musculus
tgccaacccagtgaactccaccatc

SEQ ID NO: 977653 - DNA, 25 bp, Mus musculus
tgccaacgtgagagtcattcagaat

SEQ ID NO: 977654 - DNA, 25 bp, Mus musculus
tgccaacgtgagcgagcctgtatat

SEQ ID NO: 977655 - DNA, 25 bp, Mus musculus
tgccaacgtgagggagcctgtatat

SEQ ID NO: 977656 - DNA, 25 bp, Mus musculus
tgccaacgtgagtgtcattcagaat

SEQ ID NO: 977657 - DNA, 25 bp, Mus musculus
tgccaagaagaaccatgaggctctg

SEQ ID NO: 977658 - DNA, 25 bp, Mus musculus
tgccaagaagcttcaacgggcagat

SEQ ID NO: 977659 - DNA, 25 bp, Mus musculus
tgccaagaaggttcaacgggcagat

SEQ ID NO: 977660 - DNA, 25 bp, Mus musculus
tgccaagaagtaccatgaggctctg

SEQ ID NO: 977661 - DNA, 25 bp, Mus musculus
tgccaagaccagagaggtctggtat

SEQ ID NO: 977662 - DNA, 25 bp, Mus musculus
tgccaagaccagtgaggtctggtat

SEQ ID NO: 977663 - DNA, 25 bp, Mus musculus
tgccaagactgaatcgctggatggc

SEQ ID NO: 977664 - DNA, 25 bp, Mus musculus
tgccaagactgaatggctggatggc

SEQ ID NO: 977665 - DNA, 25 bp, Mus musculus
tgccaaggagaatggtaccaagttg

SEQ ID NO: 977666 - DNA, 25 bp, Mus musculus
tgccaaggaggacatctttggacca

SEQ ID NO: 977667 - DNA, 25 bp, Mus musculus
tgccaaggaggagatctttggacca

SEQ ID NO: 977668 - DNA, 25 bp, Mus musculus
tgccaaggagtatggtaccaagttg

SEQ ID NO: 977669 - DNA, 25 bp, Mus musculus
tgccaaggcacacaagccctcactg

SEQ ID NO: 977670 - DNA, 25 bp, Mus musculus
tgccaaggcacacatgccctcactg

SEQ ID NO: 977671 - DNA, 25 bp, Mus musculus
tgccaaggcgcccacagaaccatct

SEQ ID NO: 977672 - DNA, 25 bp, Mus musculus
tgccaaggcggccacagaaccatct

SEQ ID NO: 977673 - DNA, 25 bp, Mus musculus
tgccaaggtgcctcatgtgcctgat

SEQ ID NO: 977674 - DNA, 25 bp, Mus musculus
tgccaaggtggctcatgtgcctgat

SEQ ID NO: 977675 - DNA, 25 bp, Mus musculus
tgccaataagcctgtggaagaaatg

SEQ ID NO: 977676 - DNA, 25 bp, Mus musculus
tgccaataagctacaggagcttcaa

SEQ ID NO: 977677 - DNA, 25 bp, Mus musculus
tgccaataagctactggagcttcaa

SEQ ID NO: 977678 - DNA, 25 bp, Mus musculus
tgccaataaggctgtggaagaaatg

SEQ ID NO: 977679 - DNA, 25 bp, Mus musculus
tgccaatctgctaatggcctttgtg

SEQ ID NO: 977680 - DNA, 25 bp, Mus musculus
tgccaatctgcttatggcctttgtg

SEQ ID NO: 977681 - DNA, 25 bp, Mus musculus
tgccaatgtgagcaaaggcacaaca

SEQ ID NO: 977682 - DNA, 25 bp, Mus musculus
tgccaatgtgtgcaaaggcacaaca

SEQ ID NO: 977683 - DNA, 25 bp, Mus musculus
tgccacaaagcaacctacttggtga

SEQ ID NO: 977684 - DNA, 25 bp, Mus musculus
tgccacaaaggaacctacttggtga

SEQ ID NO: 977685 - DNA, 25 bp, Mus musculus
tgccacacggagagctgcccagacg

SEQ ID NO: 977686 - DNA, 25 bp, Mus musculus
tgccacacggagtgctgcccagacg

SEQ ID NO: 977687 - DNA, 25 bp, Mus musculus
tgccacacttcacaaggatggaata

SEQ ID NO: 977688 - DNA, 25 bp, Mus musculus
tgccacacttcacatggatggaata

SEQ ID NO: 977689 - DNA, 25 bp, Mus musculus
tgccacagacagcgccactgccggt

SEQ ID NO: 977690 - DNA, 25 bp, Mus musculus
tgccacagacagggccactgccggt

SEQ ID NO: 977691 - DNA, 25 bp, Mus musculus
tgccacagcagccgtgtcctccatg

SEQ ID NO: 977692 - DNA, 25 bp, Mus musculus
tgccacagcagcggtgtcctccatg

SEQ ID NO: 977693 - DNA, 25 bp, Mus musculus
tgccacatagaacgctctcagcacc

SEQ ID NO: 977694 - DNA, 25 bp, Mus musculus
tgccacatagaaggctctcagcacc

SEQ ID NO: 977695 - DNA, 25 bp, Mus musculus
tgccacatcctgagccaataacttc

SEQ ID NO: 977696 - DNA, 25 bp, Mus musculus
tgccacatcctgtgccaataacttc

SEQ ID NO: 977697 - DNA, 25 bp, Mus musculus
tgccacatcgctgatgccttcagcg

SEQ ID NO: 977698 - DNA, 25 bp, Mus musculus
tgccacatcggtgatgccttcagcg

SEQ ID NO: 977699 - DNA, 25 bp, Mus musculus
tgccaccaagaagcagatcttctct

SEQ ID NO: 977700 - DNA, 25 bp, Mus musculus
tgccaccaagaagctgatcttctct

SEQ ID NO: 977701 - DNA, 25 bp, Mus musculus
tgccaccaagacctgtacatggaaa

SEQ ID NO: 977702 - DNA, 25 bp, Mus musculus
tgccaccaagcacaaacagcacctc

SEQ ID NO: 977703 - DNA, 25 bp, Mus musculus
tgccaccaagcacgagattacctgg

SEQ ID NO: 977704 - DNA, 25 bp, Mus musculus
tgccaccaagcagaaacagcacctc

SEQ ID NO: 977705 - DNA, 25 bp, Mus musculus
tgccaccaagcaggagattacctgg

SEQ ID NO: 977706 - DNA, 25 bp, Mus musculus
tgccaccaagtcctgtacatggaaa

SEQ ID NO: 977707 - DNA, 25 bp, Mus musculus
tgccaccagaattgccagcggctcc

SEQ ID NO: 977708 - DNA, 25 bp, Mus musculus
tgccaccagatttgccagcggctcc

SEQ ID NO: 977709 - DNA, 25 bp, Mus musculus
tgccaccgcagccgtgtcagctatg

SEQ ID NO: 977710 - DNA, 25 bp, Mus musculus
tgccaccgcagcggtgtcagctatg

SEQ ID NO: 977711 - DNA, 25 bp, Mus musculus
tgccacctccaactcagcctccaag

SEQ ID NO: 977712 - DNA, 25 bp, Mus musculus
tgccacctccaagtcagcctccaag

SEQ ID NO: 977713 - DNA, 25 bp, Mus musculus
tgccacctccgccacttctagactg

SEQ ID NO: 977714 - DNA, 25 bp, Mus musculus
tgccacctccgccagttctagactg

SEQ ID NO: 977715 - DNA, 25 bp, Mus musculus
tgccacgacctacgtcatgggccat

SEQ ID NO: 977716 - DNA, 25 bp, Mus musculus
tgccacgacctaggtcatgggccat

SEQ ID NO: 977717 - DNA, 25 bp, Mus musculus
tgccacgagacacactggtcttagg

SEQ ID NO: 977718 - DNA, 25 bp, Mus musculus
tgccacgagacagactggtcttagg

SEQ ID NO: 977719 - DNA, 25 bp, Mus musculus
tgccacgagcaacaaagcaaaggga

SEQ ID NO: 977720 - DNA, 25 bp, Mus musculus
tgccacgagcaagaaagcaaaggga

SEQ ID NO: 977721 - DNA, 25 bp, Mus musculus
tgccacggccatggcgtctgtgaca

SEQ ID NO: 977722 - DNA, 25 bp, Mus musculus
tgccacggccatggggtctgtgaca

SEQ ID NO: 977723 - DNA, 25 bp, Mus musculus
tgccactaggtgcactgcatatgta

SEQ ID NO: 977724 - DNA, 25 bp, Mus musculus
tgccactaggtggactgcatatgta

SEQ ID NO: 977725 - DNA, 25 bp, Mus musculus
tgccactgacgtgacgaccccccag

SEQ ID NO: 977726 - DNA, 25 bp, Mus musculus
tgccactgacgtgaggaccccccag

SEQ ID NO: 977727 - DNA, 25 bp, Mus musculus
tgccactgctttccctgtaccccag

SEQ ID NO: 977728 - DNA, 25 bp, Mus musculus
tgccactgctttgcctgtaccccag

SEQ ID NO: 977729 - DNA, 25 bp, Mus musculus
tgccactggggactggggccattgc

SEQ ID NO: 977730 - DNA, 25 bp, Mus musculus
tgccactggggagtggggccattgc

SEQ ID NO: 977731 - DNA, 25 bp, Mus musculus
tgccacttccaacgtagcgttggta

SEQ ID NO: 977732 - DNA, 25 bp, Mus musculus
tgccacttccaaggtagcgttggta

SEQ ID NO: 977733 - DNA, 25 bp, Mus musculus
tgccactttcatcgcgttcaaccga

SEQ ID NO: 977734 - DNA, 25 bp, Mus musculus
tgccactttcatggcgttcaaccga

SEQ ID NO: 977735 - DNA, 25 bp, Mus musculus
tgccagaaagagaaatgctttgagc

SEQ ID NO: 977736 - DNA, 25 bp, Mus musculus
tgccagaaagtgaaatgctttgagc

SEQ ID NO: 977737 - DNA, 25 bp, Mus musculus
tgccagaaggagccggcgctctcgc

SEQ ID NO: 977738 - DNA, 25 bp, Mus musculus
tgccagaaggaggcggcgctctcgc

SEQ ID NO: 977739 - DNA, 25 bp, Mus musculus
tgccagactgcaaaccacaggctgt

SEQ ID NO: 977740 - DNA, 25 bp, Mus musculus
tgccagactgcaaacgctgtgcgcc

SEQ ID NO: 977741 - DNA, 25 bp, Mus musculus
tgccagactgcaaacgtgaccagag

SEQ ID NO: 977742 - DNA, 25 bp, Mus musculus
tgccagactgcaaagcacaggctgt

SEQ ID NO: 977743 - DNA, 25 bp, Mus musculus
tgccagactgcaaaggctgtgcgcc

SEQ ID NO: 977744 - DNA, 25 bp, Mus musculus
tgccagactgcaaaggtgaccagag

SEQ ID NO: 977745 - DNA, 25 bp, Mus musculus
tgccagaggtgccacgtctgcaaag

SEQ ID NO: 977746 - DNA, 25 bp, Mus musculus
tgccagaggtgccaggtctgcaaag

SEQ ID NO: 977747 - DNA, 25 bp, Mus musculus
tgccagagtcaacatagagtcagca

SEQ ID NO: 977748 - DNA, 25 bp, Mus musculus
tgccagagtcaagatagagtcagca

SEQ ID NO: 977749 - DNA, 25 bp, Mus musculus
tgccagagtgcagcattattgattg

SEQ ID NO: 977750 - DNA, 25 bp, Mus musculus
tgccagagtgcagctttattgattg

SEQ ID NO: 977751 - DNA, 25 bp, Mus musculus
tgccagagttcccacatgaagaaac

SEQ ID NO: 977752 - DNA, 25 bp, Mus musculus
tgccagagttcccagatgaagaaac

SEQ ID NO: 977753 - DNA, 25 bp, Mus musculus
tgccagataccacgttgctggtgac

SEQ ID NO: 977754 - DNA, 25 bp, Mus musculus
tgccagataccaggttgctggtgac

SEQ ID NO: 977755 - DNA, 25 bp, Mus musculus
tgccagatttaacctgggcatgttc

SEQ ID NO: 977756 - DNA, 25 bp, Mus musculus
tgccagatttaagctgggcatgttc

SEQ ID NO: 977757 - DNA, 25 bp, Mus musculus
tgccagcaagctgtagctacttcac

SEQ ID NO: 977758 - DNA, 25 bp, Mus musculus
tgccagcaaggtgtagctacttcac

SEQ ID NO: 977759 - DNA, 25 bp, Mus musculus
tgccagcacccgccgccgctcctct

SEQ ID NO: 977760 - DNA, 25 bp, Mus musculus
tgccagcacccggcgccgctcctct

SEQ ID NO: 977761 - DNA, 25 bp, Mus musculus
tgccagcatcagcgagcctgtatat

SEQ ID NO: 977762 - DNA, 25 bp, Mus musculus
tgccagcatcagggagcctgtatat

SEQ ID NO: 977763 - DNA, 25 bp, Mus musculus
tgccagccagaaaatgacctgaagt

SEQ ID NO: 977764 - DNA, 25 bp, Mus musculus
tgccagccagaacacgcagcccttc

SEQ ID NO: 977765 - DNA, 25 bp, Mus musculus
tgccagccagaacaggcagcccttc

SEQ ID NO: 977766 - DNA, 25 bp, Mus musculus
tgccagccagctgggcatgacagct

SEQ ID NO: 977767 - DNA, 25 bp, Mus musculus
tgccagccaggtgggcatgacagct

SEQ ID NO: 977768 - DNA, 25 bp, Mus musculus
tgccagccagtaaatgacctgaagt

SEQ ID NO: 977769 - DNA, 25 bp, Mus musculus
tgccagccgccacacgaactggtgt

SEQ ID NO: 977770 - DNA, 25 bp, Mus musculus
tgccagccgccacacgtcctgttga

SEQ ID NO: 977771 - DNA, 25 bp, Mus musculus
tgccagccgccacaggaactggtgt

SEQ ID NO: 977772 - DNA, 25 bp, Mus musculus
tgccagccgccacaggtcctgttga

SEQ ID NO: 977773 - DNA, 25 bp, Mus musculus
tgccagctcaaacctgtgtgtcaac

SEQ ID NO: 977774 - DNA, 25 bp, Mus musculus
tgccagctcaaagctgtgtgtcaac

SEQ ID NO: 977775 - DNA, 25 bp, Mus musculus
tgccagctgccgcactgccctccag

SEQ ID NO: 977776 - DNA, 25 bp, Mus musculus
tgccagctgccggactgccctccag

SEQ ID NO: 977777 - DNA, 25 bp, Mus musculus
tgccagctggtggacgaggaagtga

SEQ ID NO: 977778 - DNA, 25 bp, Mus musculus
tgccagctggtggaggaggaagtga

SEQ ID NO: 977779 - DNA, 25 bp, Mus musculus
tgccaggaaatgcacgttttcctta

SEQ ID NO: 977780 - DNA, 25 bp, Mus musculus
tgccaggaaatgcaggttttcctta

SEQ ID NO: 977781 - DNA, 25 bp, Mus musculus
tgccaggacacacgcgctacttgtc

SEQ ID NO: 977782 - DNA, 25 bp, Mus musculus
tgccaggacacacgggctacttgtc

SEQ ID NO: 977783 - DNA, 25 bp, Mus musculus
tgccaggacggggacacccatataa

SEQ ID NO: 977784 - DNA, 25 bp, Mus musculus
tgccaggacggggagacccatataa

SEQ ID NO: 977785 - DNA, 25 bp, Mus musculus
tgccagggagctgtgaatgaggcag

SEQ ID NO: 977786 - DNA, 25 bp, Mus musculus
tgccagggaggtgtgaatgaggcag

SEQ ID NO: 977787 - DNA, 25 bp, Mus musculus
tgccagggctctcccaacctagcta

SEQ ID NO: 977788 - DNA, 25 bp, Mus musculus
tgccagggctctcccagaccgaagc

SEQ ID NO: 977789 - DNA, 25 bp, Mus musculus
tgccagggctctcccgcgcatctcc

SEQ ID NO: 977790 - DNA, 25 bp, Mus musculus
tgccagggctctccgaacctagcta

SEQ ID NO: 977791 - DNA, 25 bp, Mus musculus
tgccagggctctccgagaccgaagc

SEQ ID NO: 977792 - DNA, 25 bp, Mus musculus
tgccagggctctccggcgcatctcc

SEQ ID NO: 977793 - DNA, 25 bp, Mus musculus
tgccaggtggtgatctgcgaccagt

SEQ ID NO: 977794 - DNA, 25 bp, Mus musculus
tgccaggtggtgatgtgcgaccagt

SEQ ID NO: 977795 - DNA, 25 bp, Mus musculus
tgccagtctggacgcgtccctacag

SEQ ID NO: 977796 - DNA, 25 bp, Mus musculus
tgccagtctggaggcgtccctacag

SEQ ID NO: 977797 - DNA, 25 bp, Mus musculus
tgccagtgcaagaatggccatttgt

SEQ ID NO: 977798 - DNA, 25 bp, Mus musculus
tgccagtgcaagtatggccatttgt

SEQ ID NO: 977799 - DNA, 25 bp, Mus musculus
tgccatacagctgtctaggagcatg

SEQ ID NO: 977800 - DNA, 25 bp, Mus musculus
tgccatacaggtgtctaggagcatg

SEQ ID NO: 977801 - DNA, 25 bp, Mus musculus
tgccatacccagccatgaacaaccg

SEQ ID NO: 977802 - DNA, 25 bp, Mus musculus
tgccatacccaggcatgaacaaccg

SEQ ID NO: 977803 - DNA, 25 bp, Mus musculus
tgccatatacagcagccacgtgtga

SEQ ID NO: 977804 - DNA, 25 bp, Mus musculus
tgccatatacaggagccacgtgtga

SEQ ID NO: 977805 - DNA, 25 bp, Mus musculus
tgccatatctcgcctgatatactgg

SEQ ID NO: 977806 - DNA, 25 bp, Mus musculus
tgccatatctcggctgatatactgg

SEQ ID NO: 977807 - DNA, 25 bp, Mus musculus
tgccatatgtatctttcccaatggc

SEQ ID NO: 977808 - DNA, 25 bp, Mus musculus
tgccatatgtttctttcccaatggc

SEQ ID NO: 977809 - DNA, 25 bp, Mus musculus
tgccatattgattccatcctttatc

SEQ ID NO: 977810 - DNA, 25 bp, Mus musculus
tgccatattgtttccatcctttatc

SEQ ID NO: 977811 - DNA, 25 bp, Mus musculus
tgccatatttagcattcccgtcaat

SEQ ID NO: 977812 - DNA, 25 bp, Mus musculus
tgccatatttaggattcccgtcaat

SEQ ID NO: 977813 - DNA, 25 bp, Mus musculus
tgccatcaacagcggaattttcact

SEQ ID NO: 977814 - DNA, 25 bp, Mus musculus
tgccatcaacaggggaattttcact

SEQ ID NO: 977815 - DNA, 25 bp, Mus musculus
tgccatccagccagcagcagcagca

SEQ ID NO: 977816 - DNA, 25 bp, Mus musculus
tgccatccaggcagcagcagcagca

SEQ ID NO: 977817 - DNA, 25 bp, Mus musculus
tgccatccaggctgcccgcccggat

SEQ ID NO: 977818 - DNA, 25 bp, Mus musculus
tgccatccaggctggccgcccggat

SEQ ID NO: 977819 - DNA, 25 bp, Mus musculus
tgccatcggcttcgtatttgcatag

SEQ ID NO: 977820 - DNA, 25 bp, Mus musculus
tgccatcggcttggtatttgcatag

SEQ ID NO: 977821 - DNA, 25 bp, Mus musculus
tgccatctagcactaagagcggcgc

SEQ ID NO: 977822 - DNA, 25 bp, Mus musculus
tgccatctagcagtaagagcggcgc

SEQ ID NO: 977823 - DNA, 25 bp, Mus musculus
tgccatctagtgctcttcctcctgg

SEQ ID NO: 977824 - DNA, 25 bp, Mus musculus
tgccatctagtggtcttcctcctgg

SEQ ID NO: 977825 - DNA, 25 bp, Mus musculus
tgccatcttccccacgttctccaag

SEQ ID NO: 977826 - DNA, 25 bp, Mus musculus
tgccatcttccccaggttctccaag

SEQ ID NO: 977827 - DNA, 25 bp, Mus musculus
tgccatcttgagaaagattctgatg

SEQ ID NO: 977828 - DNA, 25 bp, Mus musculus
tgccatcttgagaatgattctgatg

SEQ ID NO: 977829 - DNA, 25 bp, Mus musculus
tgccatgactatctacggagaagtc

SEQ ID NO: 977830 - DNA, 25 bp, Mus musculus
tgccatgactcatctggagagatta

SEQ ID NO: 977831 - DNA, 25 bp, Mus musculus
tgccatgactgatctggagagatta

SEQ ID NO: 977832 - DNA, 25 bp, Mus musculus
tgccatgactttctacggagaagtc

SEQ ID NO: 977833 - DNA, 25 bp, Mus musculus
tgccatgagcaacatgccttggcag

SEQ ID NO: 977834 - DNA, 25 bp, Mus musculus
tgccatgagcaagatgccttggcag

SEQ ID NO: 977835 - DNA, 25 bp, Mus musculus
tgccatgatgcacgactcgcctttc

SEQ ID NO: 977836 - DNA, 25 bp, Mus musculus
tgccatgatgcaggactcgcctttc

SEQ ID NO: 977837 - DNA, 25 bp, Mus musculus
tgccatgcagagagctgctggtgat

SEQ ID NO: 977838 - DNA, 25 bp, Mus musculus
tgccatgcagtgagctgctggtgat

SEQ ID NO: 977839 - DNA, 25 bp, Mus musculus
tgccatggacgacattcagccagac

SEQ ID NO: 977840 - DNA, 25 bp, Mus musculus
tgccatggacgagattcagccagac

SEQ ID NO: 977841 - DNA, 25 bp, Mus musculus
tgccatggccaaaatccaagcaaaa

SEQ ID NO: 977842 - DNA, 25 bp, Mus musculus
tgccatggccaatatccaagcaaaa

SEQ ID NO: 977843 - DNA, 25 bp, Mus musculus
tgccatggtactgatggacagaatc

SEQ ID NO: 977844 - DNA, 25 bp, Mus musculus
tgccatggtagtgatggacagaatc

SEQ ID NO: 977845 - DNA, 25 bp, Mus musculus
tgccattaagcgagaaatcaaatgc

SEQ ID NO: 977846 - DNA, 25 bp, Mus musculus
tgccattaagggagaaatcaaatgc

SEQ ID NO: 977847 - DNA, 25 bp, Mus musculus
tgccattcagctcatccagtttgtc

SEQ ID NO: 977848 - DNA, 25 bp, Mus musculus
tgccattcagctgatccagtttgtc

SEQ ID NO: 977849 - DNA, 25 bp, Mus musculus
tgccattctcaatgcaaatatggaa

SEQ ID NO: 977850 - DNA, 25 bp, Mus musculus
tgccattctcaatgcgaaaaagagc

SEQ ID NO: 977851 - DNA, 25 bp, Mus musculus
tgccattctcaatggaaatatggaa

SEQ ID NO: 977852 - DNA, 25 bp, Mus musculus
tgccattctcaatgggaaaaagagc

SEQ ID NO: 977853 - DNA, 25 bp, Mus musculus
tgccattctcagcacgccgcagatc

SEQ ID NO: 977854 - DNA, 25 bp, Mus musculus
tgccattctcagcaggccgcagatc

SEQ ID NO: 977855 - DNA, 25 bp, Mus musculus
tgccattgagaaaatgaaacagctt

SEQ ID NO: 977856 - DNA, 25 bp, Mus musculus
tgccattgagacgtaccaccagact

SEQ ID NO: 977857 - DNA, 25 bp, Mus musculus
tgccattgagtaaatgaaacagctt

SEQ ID NO: 977858 - DNA, 25 bp, Mus musculus
tgccattgagtcgtaccaccagact

SEQ ID NO: 977859 - DNA, 25 bp, Mus musculus
tgccattgggcacacgggcccagtg

SEQ ID NO: 977860 - DNA, 25 bp, Mus musculus
tgccattgggcacaggggcccagtg

SEQ ID NO: 977861 - DNA, 25 bp, Mus musculus
tgccatttcgatcttccactatgcc

SEQ ID NO: 977862 - DNA, 25 bp, Mus musculus
tgccatttcgttcttccactatgcc

SEQ ID NO: 977863 - DNA, 25 bp, Mus musculus
tgccattttcggctcgacgtcgact

SEQ ID NO: 977864 - DNA, 25 bp, Mus musculus
tgccattttcggctggacgtcgact

SEQ ID NO: 977865 - DNA, 25 bp, Mus musculus
tgccatttttcaagcaagagaagtg

SEQ ID NO: 977866 - DNA, 25 bp, Mus musculus
tgccatttttcaaggaagagaagtg

SEQ ID NO: 977867 - DNA, 25 bp, Mus musculus
tgcccaaacagcaaccgcctgtgag

SEQ ID NO: 977868 - DNA, 25 bp, Mus musculus
tgcccaaacagcaagcgcctgtgag

SEQ ID NO: 977869 - DNA, 25 bp, Mus musculus
tgcccaagaccacctcacggatgat

SEQ ID NO: 977870 - DNA, 25 bp, Mus musculus
tgcccaagaccagctcacggatgat

SEQ ID NO: 977871 - DNA, 25 bp, Mus musculus
tgcccaattctgcgacactcactct

SEQ ID NO: 977872 - DNA, 25 bp, Mus musculus
tgcccaattctgggacactcactct

SEQ ID NO: 977873 - DNA, 25 bp, Mus musculus
tgcccaattgatggatgcctgtcca

SEQ ID NO: 977874 - DNA, 25 bp, Mus musculus
tgcccaattgttggatgcctgtcca

SEQ ID NO: 977875 - DNA, 25 bp, Mus musculus
tgcccacactgcgcagagtgcacca

SEQ ID NO: 977876 - DNA, 25 bp, Mus musculus
tgcccacactgcgctgagtgcacca

SEQ ID NO: 977877 - DNA, 25 bp, Mus musculus
tgcccacatccccacaggtataata

SEQ ID NO: 977878 - DNA, 25 bp, Mus musculus
tgcccacatccccagaggtataata

SEQ ID NO: 977879 - DNA, 25 bp, Mus musculus
tgcccaccagccttggaagggaggc

SEQ ID NO: 977880 - DNA, 25 bp, Mus musculus
tgcccaccaggcttggaagggaggc

SEQ ID NO: 977881 - DNA, 25 bp, Mus musculus
tgcccaccggagcgtcagtactgta

SEQ ID NO: 977882 - DNA, 25 bp, Mus musculus
tgcccaccggagggtcagtactgta

SEQ ID NO: 977883 - DNA, 25 bp, Mus musculus
tgcccactgccgcatcctaataact

SEQ ID NO: 977884 - DNA, 25 bp, Mus musculus
tgcccactgccggatcctaataact

SEQ ID NO: 977885 - DNA, 25 bp, Mus musculus
tgcccagaagcagtcgaaagccaaa

SEQ ID NO: 977886 - DNA, 25 bp, Mus musculus
tgcccagaaggagtcgaaagccaaa

SEQ ID NO: 977887 - DNA, 25 bp, Mus musculus
tgcccagaccttcacctcttagctg

SEQ ID NO: 977888 - DNA, 25 bp, Mus musculus
tgcccagaccttcacgaagctctta

SEQ ID NO: 977889 - DNA, 25 bp, Mus musculus
tgcccagaccttcacgggctcagct

SEQ ID NO: 977890 - DNA, 25 bp, Mus musculus
tgcccagaccttcagctcttagctg

SEQ ID NO: 977891 - DNA, 25 bp, Mus musculus
tgcccagaccttcaggaagctctta

SEQ ID NO: 977892 - DNA, 25 bp, Mus musculus
tgcccagaccttcaggggctcagct

SEQ ID NO: 977893 - DNA, 25 bp, Mus musculus
tgcccagagctccgcgctcaagtcc

SEQ ID NO: 977894 - DNA, 25 bp, Mus musculus
tgcccagagctccgggctcaagtcc

SEQ ID NO: 977895 - DNA, 25 bp, Mus musculus
tgcccagatcaaatcgtgtccagcc

SEQ ID NO: 977896 - DNA, 25 bp, Mus musculus
tgcccagatcaactattagacatgt

SEQ ID NO: 977897 - DNA, 25 bp, Mus musculus
tgcccagatcaagtattagacatgt

SEQ ID NO: 977898 - DNA, 25 bp, Mus musculus
tgcccagatcaattcgtgtccagcc

SEQ ID NO: 977899 - DNA, 25 bp, Mus musculus
tgcccagcacctcacgtttctaagg

SEQ ID NO: 977900 - DNA, 25 bp, Mus musculus
tgcccagcacctcaggtttctaagg

SEQ ID NO: 977901 - DNA, 25 bp, Mus musculus
tgcccagcagagcgcagacaccaaa

SEQ ID NO: 977902 - DNA, 25 bp, Mus musculus
tgcccagcagagggcagacaccaaa

SEQ ID NO: 977903 - DNA, 25 bp, Mus musculus
tgcccagcagcgtgaagaggttctt

SEQ ID NO: 977904 - DNA, 25 bp, Mus musculus
tgcccagcagggtgaagaggttctt

SEQ ID NO: 977905 - DNA, 25 bp, Mus musculus
tgcccagcccacaactcctgcacag

SEQ ID NO: 977906 - DNA, 25 bp, Mus musculus
tgcccagcccacaagtcctgcacag

SEQ ID NO: 977907 - DNA, 25 bp, Mus musculus
tgcccagccctggacactccaccaa

SEQ ID NO: 977908 - DNA, 25 bp, Mus musculus
tgcccagccctggagactccaccaa

SEQ ID NO: 977909 - DNA, 25 bp, Mus musculus
tgcccaggaaaccacgaatgacacg

SEQ ID NO: 977910 - DNA, 25 bp, Mus musculus
tgcccaggaaaccaggaatgacacg

SEQ ID NO: 977911 - DNA, 25 bp, Mus musculus
tgcccaggagagattccttctgtca

SEQ ID NO: 977912 - DNA, 25 bp, Mus musculus
tgcccaggagagtttccttctgtca

SEQ ID NO: 977913 - DNA, 25 bp, Mus musculus
tgcccaggagccacagtccctcggg

SEQ ID NO: 977914 - DNA, 25 bp, Mus musculus
tgcccaggagctcctgacactgccc

SEQ ID NO: 977915 - DNA, 25 bp, Mus musculus
tgcccaggaggcacagtccctcggg

SEQ ID NO: 977916 - DNA, 25 bp, Mus musculus
tgcccaggaggtcctgacactgccc

SEQ ID NO: 977917 - DNA, 25 bp, Mus musculus
tgcccagtgagtcacatttcccccc

SEQ ID NO: 977918 - DNA, 25 bp, Mus musculus
tgcccagtgagtcagatttcccccc

SEQ ID NO: 977919 - DNA, 25 bp, Mus musculus
tgcccagtgatttcacttttcagaa

SEQ ID NO: 977920 - DNA, 25 bp, Mus musculus
tgcccagtgatttctcttttcagaa

SEQ ID NO: 977921 - DNA, 25 bp, Mus musculus
tgcccagttgcgcgcctaacctgcc

SEQ ID NO: 977922 - DNA, 25 bp, Mus musculus
tgcccagttgcgggcctaacctgcc

SEQ ID NO: 977923 - DNA, 25 bp, Mus musculus
tgcccatcagcaggcagagacaagg

SEQ ID NO: 977924 - DNA, 25 bp, Mus musculus
tgcccatcaggaggcagagacaagg

SEQ ID NO: 977925 - DNA, 25 bp, Mus musculus
tgcccatgccctctgatcagaccac

SEQ ID NO: 977926 - DNA, 25 bp, Mus musculus
tgcccatgccctgtgatcagaccac

SEQ ID NO: 977927 - DNA, 25 bp, Mus musculus
tgcccatgtgatcatgattctggaa

SEQ ID NO: 977928 - DNA, 25 bp, Mus musculus
tgcccatgtgttcatgattctggaa

SEQ ID NO: 977929 - DNA, 25 bp, Mus musculus
tgcccattccagctgtcgcagagat

SEQ ID NO: 977930 - DNA, 25 bp, Mus musculus
tgcccattccaggtgtcgcagagat

SEQ ID NO: 977931 - DNA, 25 bp, Mus musculus
tgcccattgcagcgatgcctgctgt

SEQ ID NO: 977932 - DNA, 25 bp, Mus musculus
tgcccattgcagggatgcctgctgt

SEQ ID NO: 977933 - DNA, 25 bp, Mus musculus
tgcccattgccacttttcagattgc

SEQ ID NO: 977934 - DNA, 25 bp, Mus musculus
tgcccattgccagttttcagattgc

SEQ ID NO: 977935 - DNA, 25 bp, Mus musculus
tgcccatttgcacagagtactgcct

SEQ ID NO: 977936 - DNA, 25 bp, Mus musculus
tgcccatttgcagagagtactgcct

SEQ ID NO: 977937 - DNA, 25 bp, Mus musculus
tgccccaaagccttcaacgggcacc

SEQ ID NO: 977938 - DNA, 25 bp, Mus musculus
tgccccaaaggcttcaacgggcacc

SEQ ID NO: 977939 - DNA, 25 bp, Mus musculus
tgccccaagcacaacgtgagactgt

SEQ ID NO: 977940 - DNA, 25 bp, Mus musculus
tgccccaagcacaaggtgagactgt

SEQ ID NO: 977941 - DNA, 25 bp, Mus musculus
tgccccaagtggctcaccacctgga

SEQ ID NO: 977942 - DNA, 25 bp, Mus musculus
tgccccaagtggctgaccacctgga

SEQ ID NO: 977943 - DNA, 25 bp, Mus musculus
tgccccacagaacgtgattgaacag

SEQ ID NO: 977944 - DNA, 25 bp, Mus musculus
tgccccacagaaggtgattgaacag

SEQ ID NO: 977945 - DNA, 25 bp, Mus musculus
tgcccccaaagacccaagctctcaa

SEQ ID NO: 977946 - DNA, 25 bp, Mus musculus
tgcccccaaagagccaagctctcaa

SEQ ID NO: 977947 - DNA, 25 bp, Mus musculus
tgcccccaagccacaccctaaggct

SEQ ID NO: 977948 - DNA, 25 bp, Mus musculus
tgcccccaagcctcaccctaaggct

SEQ ID NO: 977949 - DNA, 25 bp, Mus musculus
tgcccccagagacctctcatggtac

SEQ ID NO: 977950 - DNA, 25 bp, Mus musculus
tgcccccagagagctctcatggtac

SEQ ID NO: 977951 - DNA, 25 bp, Mus musculus
tgccccctttcacacagcatgatct

SEQ ID NO: 977952 - DNA, 25 bp, Mus musculus
tgccccctttcacacgctcctgagc

SEQ ID NO: 977953 - DNA, 25 bp, Mus musculus
tgccccctttcacagagcatgatct

SEQ ID NO: 977954 - DNA, 25 bp, Mus musculus
tgccccctttcacaggctcctgagc

SEQ ID NO: 977955 - DNA, 25 bp, Mus musculus
tgccccgccacccacatctggaaca

SEQ ID NO: 977956 - DNA, 25 bp, Mus musculus
tgccccgccacccaccggccacatc

SEQ ID NO: 977957 - DNA, 25 bp, Mus musculus
tgccccgccacccagatctggaaca

SEQ ID NO: 977958 - DNA, 25 bp, Mus musculus
tgccccgccacccagcggccacatc

SEQ ID NO: 977959 - DNA, 25 bp, Mus musculus
tgccccgctatgagcttgaggaggc

SEQ ID NO: 977960 - DNA, 25 bp, Mus musculus
tgccccgctatgtgcttgaggaggc

SEQ ID NO: 977961 - DNA, 25 bp, Mus musculus
tgccccggccagctgactgctgtcc

SEQ ID NO: 977962 - DNA, 25 bp, Mus musculus
tgccccggccaggtgactgctgtcc

SEQ ID NO: 977963 - DNA, 25 bp, Mus musculus
tgcccctaacagccacggtcagagc

SEQ ID NO: 977964 - DNA, 25 bp, Mus musculus
tgcccctaacaggcacggtcagagc

SEQ ID NO: 977965 - DNA, 25 bp, Mus musculus
tgcccctcagcagcagcaacagcag

SEQ ID NO: 977966 - DNA, 25 bp, Mus musculus
tgcccctcaggagcagcaacagcag

SEQ ID NO: 977967 - DNA, 25 bp, Mus musculus
tgcccctgcaaacgttttccatctc

SEQ ID NO: 977968 - DNA, 25 bp, Mus musculus
tgcccctgcaaaggttttccatctc

SEQ ID NO: 977969 - DNA, 25 bp, Mus musculus
tgcccctgtccacatactgcaggaa

SEQ ID NO: 977970 - DNA, 25 bp, Mus musculus
tgcccctgtccagatactgcaggaa

SEQ ID NO: 977971 - DNA, 25 bp, Mus musculus
tgcccgaaagcctgagaccgctgcc

SEQ ID NO: 977972 - DNA, 25 bp, Mus musculus
tgcccgaaaggctgagaccgctgcc

SEQ ID NO: 977973 - DNA, 25 bp, Mus musculus
tgcccgccttggagctggctcagct

SEQ ID NO: 977974 - DNA, 25 bp, Mus musculus
tgcccgccttggaggtggctcagct

SEQ ID NO: 977975 - DNA, 25 bp, Mus musculus
tgcccggcgcggcgcgagccgctcc

SEQ ID NO: 977976 - DNA, 25 bp, Mus musculus
tgcccggcgcggcgggagccgctcc

SEQ ID NO: 977977 - DNA, 25 bp, Mus musculus
tgcccggcttagaactctccgctgg

SEQ ID NO: 977978 - DNA, 25 bp, Mus musculus
tgcccggcttagtactctccgctgg

SEQ ID NO: 977979 - DNA, 25 bp, Mus musculus
tgcccggggtcacccatgggagccg

SEQ ID NO: 977980 - DNA, 25 bp, Mus musculus
tgcccggggtcagccatgggagccg

SEQ ID NO: 977981 - DNA, 25 bp, Mus musculus
tgcccggtgttgcacatatgaaaca

SEQ ID NO: 977982 - DNA, 25 bp, Mus musculus
tgcccggtgttggacatatgaaaca

SEQ ID NO: 977983 - DNA, 25 bp, Mus musculus
tgcccgttctagctactttgaggcc

SEQ ID NO: 977984 - DNA, 25 bp, Mus musculus
tgcccgttctaggtactttgaggcc

SEQ ID NO: 977985 - DNA, 25 bp, Mus musculus
tgccctacagaatactgtggcactt

SEQ ID NO: 977986 - DNA, 25 bp, Mus musculus
tgccctacagtatactgtggcactt

SEQ ID NO: 977987 - DNA, 25 bp, Mus musculus
tgccctacccagctggaatggaaca

SEQ ID NO: 977988 - DNA, 25 bp, Mus musculus
tgccctacccaggtggaatggaaca

SEQ ID NO: 977989 - DNA, 25 bp, Mus musculus
tgccctacccgactggacgcgaccg

SEQ ID NO: 977990 - DNA, 25 bp, Mus musculus
tgccctacccgagtggacgcgaccg

SEQ ID NO: 977991 - DNA, 25 bp, Mus musculus
tgccctactacgcaccccctaataa

SEQ ID NO: 977992 - DNA, 25 bp, Mus musculus
tgccctactacgcagcccctaataa

SEQ ID NO: 977993 - DNA, 25 bp, Mus musculus
tgccctagtgagagactctacacgg

SEQ ID NO: 977994 - DNA, 25 bp, Mus musculus
tgccctagtgagtgactctacacgg

SEQ ID NO: 977995 - DNA, 25 bp, Mus musculus
tgccctcaacagcttgtctgaaaac

SEQ ID NO: 977996 - DNA, 25 bp, Mus musculus
tgccctcaacaggttgtctgaaaac

SEQ ID NO: 977997 - DNA, 25 bp, Mus musculus
tgccctcacacacaaaggcctaaag

SEQ ID NO: 977998 - DNA, 25 bp, Mus musculus
tgccctcacacacagaggtctgaag

SEQ ID NO: 977999 - DNA, 25 bp, Mus musculus
tgccctcacacacgcctaaagaatg

SEQ ID NO: 978000 - DNA, 25 bp, Mus musculus
tgccctcacacacgtttccctctgt

SEQ ID NO: 978001 - DNA, 25 bp, Mus musculus
tgccctcacacagaaaggcctaaag

SEQ ID NO: 978002 - DNA, 25 bp, Mus musculus
tgccctcacacagagaggtctgaag

SEQ ID NO: 978003 - DNA, 25 bp, Mus musculus
tgccctcacacaggcctaaagaatg

SEQ ID NO: 978004 - DNA, 25 bp, Mus musculus
tgccctcacacaggtttccctctgt

SEQ ID NO: 978005 - DNA, 25 bp, Mus musculus
tgccctcaccagacaatccctgttg

SEQ ID NO: 978006 - DNA, 25 bp, Mus musculus
tgccctcaccagtcaatccctgttg

SEQ ID NO: 978007 - DNA, 25 bp, Mus musculus
tgccctcacgatcaacaaggcagga

SEQ ID NO: 978008 - DNA, 25 bp, Mus musculus
tgccctcacgcataaaaataagatc

SEQ ID NO: 978009 - DNA, 25 bp, Mus musculus
tgccctcacggataaaaataagatc

SEQ ID NO: 978010 - DNA, 25 bp, Mus musculus
tgccctcacgttcaacaaggcagga

SEQ ID NO: 978011 - DNA, 25 bp, Mus musculus
tgccctccagcccagctccaccacc

SEQ ID NO: 978012 - DNA, 25 bp, Mus musculus
tgccctccagctccaccaccccctg

SEQ ID NO: 978013 - DNA, 25 bp, Mus musculus
tgccctccaggccagctccaccacc

SEQ ID NO: 978014 - DNA, 25 bp, Mus musculus
tgccctccaggtccaccaccccctg

SEQ ID NO: 978015 - DNA, 25 bp, Mus musculus
tgccctcccgcaaattgtggctgta

SEQ ID NO: 978016 - DNA, 25 bp, Mus musculus
tgccctcccggaaattgtggctgta

SEQ ID NO: 978017 - DNA, 25 bp, Mus musculus
tgccctctgccacgaacagattggc

SEQ ID NO: 978018 - DNA, 25 bp, Mus musculus
tgccctctgccaggaacagattggc

SEQ ID NO: 978019 - DNA, 25 bp, Mus musculus
tgccctctgtaaagagatggctgca

SEQ ID NO: 978020 - DNA, 25 bp, Mus musculus
tgccctctgtaaagtgatggctgca

SEQ ID NO: 978021 - DNA, 25 bp, Mus musculus
tgccctcttctgcacatcgagtcac

SEQ ID NO: 978022 - DNA, 25 bp, Mus musculus
tgccctcttctggacatcgagtcac

SEQ ID NO: 978023 - DNA, 25 bp, Mus musculus
tgccctgaaacaatcgttgaaattt

SEQ ID NO: 978024 - DNA, 25 bp, Mus musculus
tgccctgaaacaatggttgaaattt

SEQ ID NO: 978025 - DNA, 25 bp, Mus musculus
tgccctgaagcttctcctcagcaac

SEQ ID NO: 978026 - DNA, 25 bp, Mus musculus
tgccctgaaggttctcctcagcaac

SEQ ID NO: 978027 - DNA, 25 bp, Mus musculus
tgccctgcagcacaagaaagactcc

SEQ ID NO: 978028 - DNA, 25 bp, Mus musculus
tgccctgcagcacgtgttcaggatg

SEQ ID NO: 978029 - DNA, 25 bp, Mus musculus
tgccctgcagcaggtgttcaggatg

SEQ ID NO: 978030 - DNA, 25 bp, Mus musculus
tgccctgcagccattgattgattcc

SEQ ID NO: 978031 - DNA, 25 bp, Mus musculus
tgccctgcaggacaagaaagactcc

SEQ ID NO: 978032 - DNA, 25 bp, Mus musculus
tgccctgcaggcattgattgattcc

SEQ ID NO: 978033 - DNA, 25 bp, Mus musculus
tgccctgctaaccaagacccagcat

SEQ ID NO: 978034 - DNA, 25 bp, Mus musculus
tgccctgctaaccacccagcatgga

SEQ ID NO: 978035 - DNA, 25 bp, Mus musculus
tgccctgctaacgaagacccagcat

SEQ ID NO: 978036 - DNA, 25 bp, Mus musculus
tgccctgctaacgacccagcatgga

SEQ ID NO: 978037 - DNA, 25 bp, Mus musculus
tgccctggccaacgtcctggacaat

SEQ ID NO: 978038 - DNA, 25 bp, Mus musculus
tgccctggccaaggtcctggacaat

SEQ ID NO: 978039 - DNA, 25 bp, Mus musculus
tgccctggccgacgaagccgagata

SEQ ID NO: 978040 - DNA, 25 bp, Mus musculus
tgccctggccgaggaagccgagata

SEQ ID NO: 978041 - DNA, 25 bp, Mus musculus
tgcccttaccagccaaatccaaaag

SEQ ID NO: 978042 - DNA, 25 bp, Mus musculus
tgcccttaccaggcaaatccaaaag

SEQ ID NO: 978043 - DNA, 25 bp, Mus musculus
tgcccttcagaatgcgttctacgca

SEQ ID NO: 978044 - DNA, 25 bp, Mus musculus
tgcccttcagaatgggttctacgca

SEQ ID NO: 978045 - DNA, 25 bp, Mus musculus
tgcccttcagattgatgcacggctg

SEQ ID NO: 978046 - DNA, 25 bp, Mus musculus
tgcccttcagattgttgcacggctg

SEQ ID NO: 978047 - DNA, 25 bp, Mus musculus
tgcccttcaggaaaccctgtgggcc

SEQ ID NO: 978048 - DNA, 25 bp, Mus musculus
tgcccttcaggaaagcctgtgggcc

SEQ ID NO: 978049 - DNA, 25 bp, Mus musculus
tgcccttccacgggccgcccaatgt

SEQ ID NO: 978050 - DNA, 25 bp, Mus musculus
tgcccttccacggggcgcccaatgt

SEQ ID NO: 978051 - DNA, 25 bp, Mus musculus
tgcccttccttacacataccattta

SEQ ID NO: 978052 - DNA, 25 bp, Mus musculus
tgcccttccttacagataccattta

SEQ ID NO: 978053 - DNA, 25 bp, Mus musculus
tgcccttctacgcgtgtgccttctt

SEQ ID NO: 978054 - DNA, 25 bp, Mus musculus
tgcccttctacgggtgtgccttctt

SEQ ID NO: 978055 - DNA, 25 bp, Mus musculus
tgcccttctcaacacggaaacggat

SEQ ID NO: 978056 - DNA, 25 bp, Mus musculus
tgcccttctcaacagggaaacggat

SEQ ID NO: 978057 - DNA, 25 bp, Mus musculus
tgcccttcttcactgggagtctgga

SEQ ID NO: 978058 - DNA, 25 bp, Mus musculus
tgcccttcttcagtgggagtctgga

SEQ ID NO: 978059 - DNA, 25 bp, Mus musculus
tgcccttgagatccagaagacagga

SEQ ID NO: 978060 - DNA, 25 bp, Mus musculus
tgcccttgagttccagaagacagga

SEQ ID NO: 978061 - DNA, 25 bp, Mus musculus
tgccgaaagttcagactggactgcc

SEQ ID NO: 978062 - DNA, 25 bp, Mus musculus
tgccgaaagttcagtctggactgcc

SEQ ID NO: 978063 - DNA, 25 bp, Mus musculus
tgccgacatctgtaccatatatccg

SEQ ID NO: 978064 - DNA, 25 bp, Mus musculus
tgccgacatctgtagcatatatccg

SEQ ID NO: 978065 - DNA, 25 bp, Mus musculus
tgccgactacctggaggagcccaag

SEQ ID NO: 978066 - DNA, 25 bp, Mus musculus
tgccgactacgtggaggagcccaag

SEQ ID NO: 978067 - DNA, 25 bp, Mus musculus
tgccgactgtggggagtgccttctt

SEQ ID NO: 978068 - DNA, 25 bp, Mus musculus
tgccgactgtggggtgtgccttctt

SEQ ID NO: 978069 - DNA, 25 bp, Mus musculus
tgccgagaagaaggaactttgcttt

SEQ ID NO: 978070 - DNA, 25 bp, Mus musculus
tgccgagaagtaggaactttgcttt

SEQ ID NO: 978071 - DNA, 25 bp, Mus musculus
tgccgaggagggccgtgctggtcac

SEQ ID NO: 978072 - DNA, 25 bp, Mus musculus
tgccgaggaggggcgtgctggtcac

SEQ ID NO: 978073 - DNA, 25 bp, Mus musculus
tgccgataagaacgccctggagcgt

SEQ ID NO: 978074 - DNA, 25 bp, Mus musculus
tgccgataagtacgccctggagcgt

SEQ ID NO: 978075 - DNA, 25 bp, Mus musculus
tgccgattgaaaaacatccatttcc

SEQ ID NO: 978076 - DNA, 25 bp, Mus musculus
tgccgattgaaatacatccatttcc

SEQ ID NO: 978077 - DNA, 25 bp, Mus musculus
tgccgcagcaaaagccacaggaaag

SEQ ID NO: 978078 - DNA, 25 bp, Mus musculus
tgccgcagcaccacaggaaagggag

SEQ ID NO: 978079 - DNA, 25 bp, Mus musculus
tgccgcagcagcacaggaaagggag

SEQ ID NO: 978080 - DNA, 25 bp, Mus musculus
tgccgcagcataagccacaggaaag

SEQ ID NO: 978081 - DNA, 25 bp, Mus musculus
tgccgcaggacaccaccacgcccca

SEQ ID NO: 978082 - DNA, 25 bp, Mus musculus
tgccgcaggacagcaccacgcccca

SEQ ID NO: 978083 - DNA, 25 bp, Mus musculus
tgccgccaagccttccaggagctaa

SEQ ID NO: 978084 - DNA, 25 bp, Mus musculus
tgccgccaaggcttccaggagctaa

SEQ ID NO: 978085 - DNA, 25 bp, Mus musculus
tgccgccaccacctcgaactggtga

SEQ ID NO: 978086 - DNA, 25 bp, Mus musculus
tgccgccaccacctggaactggtga

SEQ ID NO: 978087 - DNA, 25 bp, Mus musculus
tgccgccacccaaacgcagaagagt

SEQ ID NO: 978088 - DNA, 25 bp, Mus musculus
tgccgccacccaaaggcagaagagt

SEQ ID NO: 978089 - DNA, 25 bp, Mus musculus
tgccgcccagatagaggtgccccac

SEQ ID NO: 978090 - DNA, 25 bp, Mus musculus
tgccgcccagcaggtgcccacccag

SEQ ID NO: 978091 - DNA, 25 bp, Mus musculus
tgccgcccaggaggtgcccacccag

SEQ ID NO: 978092 - DNA, 25 bp, Mus musculus
tgccgcccagttagaggtgccccac

SEQ ID NO: 978093 - DNA, 25 bp, Mus musculus
tgccgccccaacccgtgtcacaatg

SEQ ID NO: 978094 - DNA, 25 bp, Mus musculus
tgccgccccatcccgtgtcacaatg

SEQ ID NO: 978095 - DNA, 25 bp, Mus musculus
tgccgccgtgcgcggagcagcaatg

SEQ ID NO: 978096 - DNA, 25 bp, Mus musculus
tgccgccgtgcgcggatagctgccc

SEQ ID NO: 978097 - DNA, 25 bp, Mus musculus
tgccgccgtgcggggagcagcaatg

SEQ ID NO: 978098 - DNA, 25 bp, Mus musculus
tgccgccgtgcggggatagctgccc

SEQ ID NO: 978099 - DNA, 25 bp, Mus musculus
tgccgccgttggcctggctgccgtg

SEQ ID NO: 978100 - DNA, 25 bp, Mus musculus
tgccgccgttgggctggctgccgtg

SEQ ID NO: 978101 - DNA, 25 bp, Mus musculus
tgccgcctcctccgagcctgaagct

SEQ ID NO: 978102 - DNA, 25 bp, Mus musculus
tgccgcctcctcggagcctgaagct

SEQ ID NO: 978103 - DNA, 25 bp, Mus musculus
tgccgcctctggcctggagccttcc

SEQ ID NO: 978104 - DNA, 25 bp, Mus musculus
tgccgcctctgggctggagccttcc

SEQ ID NO: 978105 - DNA, 25 bp, Mus musculus
tgccgcctggtcttctgggccgagt

SEQ ID NO: 978106 - DNA, 25 bp, Mus musculus
tgccgcctggtcttgtgggccgagt

SEQ ID NO: 978107 - DNA, 25 bp, Mus musculus
tgccgcgaggagtatggcgtttgtg

SEQ ID NO: 978108 - DNA, 25 bp, Mus musculus
tgccgcgaggtgtatggcgtttgtg

SEQ ID NO: 978109 - DNA, 25 bp, Mus musculus
tgccgctatccacgttgtcatttca

SEQ ID NO: 978110 - DNA, 25 bp, Mus musculus
tgccgctatccaggttgtcatttca

SEQ ID NO: 978111 - DNA, 25 bp, Mus musculus
tgccgctcagattttggcagtgcag

SEQ ID NO: 978112 - DNA, 25 bp, Mus musculus
tgccgctcagtttttggcagtgcag

SEQ ID NO: 978113 - DNA, 25 bp, Mus musculus
tgccgctcttcccgtccctaaccat

SEQ ID NO: 978114 - DNA, 25 bp, Mus musculus
tgccgctcttccggtccctaaccat

SEQ ID NO: 978115 - DNA, 25 bp, Mus musculus
tgccgctgaagaccgtattgaaggg

SEQ ID NO: 978116 - DNA, 25 bp, Mus musculus
tgccgctgaagagcgtattgaaggg

SEQ ID NO: 978117 - DNA, 25 bp, Mus musculus
tgccgctgagtgcatacattccacc

SEQ ID NO: 978118 - DNA, 25 bp, Mus musculus
tgccgctgagtggatacattccacc

SEQ ID NO: 978119 - DNA, 25 bp, Mus musculus
tgccgctgctggctggctgcgttga

SEQ ID NO: 978120 - DNA, 25 bp, Mus musculus
tgccgctgctgggtggctgcgttga

SEQ ID NO: 978121 - DNA, 25 bp, Mus musculus
tgccgctgcttgcaaggagaagttg

SEQ ID NO: 978122 - DNA, 25 bp, Mus musculus
tgccgctgcttggaaggagaagttg

SEQ ID NO: 978123 - DNA, 25 bp, Mus musculus
tgccgctgtccgcgcaggtgcctag

SEQ ID NO: 978124 - DNA, 25 bp, Mus musculus
tgccgctgtccgcggaggtgcctag

SEQ ID NO: 978125 - DNA, 25 bp, Mus musculus
tgccgcttctatgacgaatttgaca

SEQ ID NO: 978126 - DNA, 25 bp, Mus musculus
tgccgcttctatgaggaatttgaca

SEQ ID NO: 978127 - DNA, 25 bp, Mus musculus
tgccgcttctgcctcacagtgaaga

SEQ ID NO: 978128 - DNA, 25 bp, Mus musculus
tgccgcttctgcctccagacagtga

SEQ ID NO: 978129 - DNA, 25 bp, Mus musculus
tgccgcttctgcctgacagtgaaga

SEQ ID NO: 978130 - DNA, 25 bp, Mus musculus
tgccgcttctgcctgcagacagtga

SEQ ID NO: 978131 - DNA, 25 bp, Mus musculus
tgccggatcaggagggccaggagga

SEQ ID NO: 978132 - DNA, 25 bp, Mus musculus
tgccggatcaggtgggccaggagga

SEQ ID NO: 978133 - DNA, 25 bp, Mus musculus
tgccggcaccaacaccgccaggcag

SEQ ID NO: 978134 - DNA, 25 bp, Mus musculus
tgccggcaccaacagcgccaggcag

SEQ ID NO: 978135 - DNA, 25 bp, Mus musculus
tgccgggatacgcgaggctaaggcc

SEQ ID NO: 978136 - DNA, 25 bp, Mus musculus
tgccgggatacgggaggctaaggcc

SEQ ID NO: 978137 - DNA, 25 bp, Mus musculus
tgccgggatcaacgcagagatgctt

SEQ ID NO: 978138 - DNA, 25 bp, Mus musculus
tgccgggatcaaggcagagatgctt

SEQ ID NO: 978139 - DNA, 25 bp, Mus musculus
tgccgggcccagcaactgcatagga

SEQ ID NO: 978140 - DNA, 25 bp, Mus musculus
tgccgggcccaggaactgcatagga

SEQ ID NO: 978141 - DNA, 25 bp, Mus musculus
tgccggttagggactgcatgagaag

SEQ ID NO: 978142 - DNA, 25 bp, Mus musculus
tgccggttagggtctgcatgagaag

SEQ ID NO: 978143 - DNA, 25 bp, Mus musculus
tgccgtaagaatatcatcctatcta

SEQ ID NO: 978144 - DNA, 25 bp, Mus musculus
tgccgtaagaatttcatcctatcta

SEQ ID NO: 978145 - DNA, 25 bp, Mus musculus
tgccgtacgagatcaagaaggtgtt

SEQ ID NO: 978146 - DNA, 25 bp, Mus musculus
tgccgtacgagatctagaaggtgtt

SEQ ID NO: 978147 - DNA, 25 bp, Mus musculus
tgccgtccagcgatgcagcctctgt

SEQ ID NO: 978148 - DNA, 25 bp, Mus musculus
tgccgtccagggatgcagcctctgt

SEQ ID NO: 978149 - DNA, 25 bp, Mus musculus
tgccgtgaggccgttgactggatga

SEQ ID NO: 978150 - DNA, 25 bp, Mus musculus
tgccgtgagggcgttgactggatga

SEQ ID NO: 978151 - DNA, 25 bp, Mus musculus
tgccgtgatcagcctgatggtaaat

SEQ ID NO: 978152 - DNA, 25 bp, Mus musculus
tgccgtgatcaggctgatggtaaat

SEQ ID NO: 978153 - DNA, 25 bp, Mus musculus
tgccgtggagagaaacaaggagtgg

SEQ ID NO: 978154 - DNA, 25 bp, Mus musculus
tgccgtggaggacatggaggcggaa

SEQ ID NO: 978155 - DNA, 25 bp, Mus musculus
tgccgtggaggagatggaggcggaa

SEQ ID NO: 978156 - DNA, 25 bp, Mus musculus
tgccgtggagtgaaacaaggagtgg

SEQ ID NO: 978157 - DNA, 25 bp, Mus musculus
tgccgtggcccacactatcatgaac

SEQ ID NO: 978158 - DNA, 25 bp, Mus musculus
tgccgtggcccagactatcatgaac

SEQ ID NO: 978159 - DNA, 25 bp, Mus musculus
tgcctacaggaagtcgtgcgctaca

SEQ ID NO: 978160 - DNA, 25 bp, Mus musculus
tgcctacaggaagtggtgcgctaca

SEQ ID NO: 978161 - DNA, 25 bp, Mus musculus
tgcctacattgacatggagaactgt

SEQ ID NO: 978162 - DNA, 25 bp, Mus musculus
tgcctacattgagatggagaactgt

SEQ ID NO: 978163 - DNA, 25 bp, Mus musculus
tgcctaccagctgcagagcccctct

SEQ ID NO: 978164 - DNA, 25 bp, Mus musculus
tgcctaccagctggcaaaggaaacc

SEQ ID NO: 978165 - DNA, 25 bp, Mus musculus
tgcctaccaggtgcagagcccctct

SEQ ID NO: 978166 - DNA, 25 bp, Mus musculus
tgcctaccaggtggcaaaggaaacc

SEQ ID NO: 978167 - DNA, 25 bp, Mus musculus
tgcctactgccgagcgaggtgtgga

SEQ ID NO: 978168 - DNA, 25 bp, Mus musculus
tgcctactgccgagggaggtgtgga

SEQ ID NO: 978169 - DNA, 25 bp, Mus musculus
tgcctactgctcacattctttgtgc

SEQ ID NO: 978170 - DNA, 25 bp, Mus musculus
tgcctactgctcactttctttgtgc

SEQ ID NO: 978171 - DNA, 25 bp, Mus musculus
tgcctagaagagtggttcttcgagt

SEQ ID NO: 978172 - DNA, 25 bp, Mus musculus
tgcctagaagcggcaatgtcatcat

SEQ ID NO: 978173 - DNA, 25 bp, Mus musculus
tgcctagaaggggcaatgtcatcat

SEQ ID NO: 978174 - DNA, 25 bp, Mus musculus
tgcctagaagtgtggttcttcgagt

SEQ ID NO: 978175 - DNA, 25 bp, Mus musculus
tgcctagtcgaaccccagagaagaa

SEQ ID NO: 978176 - DNA, 25 bp, Mus musculus
tgcctagtcgaactgcccccctcct

SEQ ID NO: 978177 - DNA, 25 bp, Mus musculus
tgcctagtcgaagcccagagaagaa

SEQ ID NO: 978178 - DNA, 25 bp, Mus musculus
tgcctagtcgaagtgcccccctcct

SEQ ID NO: 978179 - DNA, 25 bp, Mus musculus
tgcctatatgaacgcattatatgag

SEQ ID NO: 978180 - DNA, 25 bp, Mus musculus
tgcctatatgaaggcattatatgag

SEQ ID NO: 978181 - DNA, 25 bp, Mus musculus
tgcctatatggcacccgagcgcatc

SEQ ID NO: 978182 - DNA, 25 bp, Mus musculus
tgcctatatggctcccgagcgcatc

SEQ ID NO: 978183 - DNA, 25 bp, Mus musculus
tgcctatcagatgcgagctgtttga

SEQ ID NO: 978184 - DNA, 25 bp, Mus musculus
tgcctatcagttgcgagctgtttga

SEQ ID NO: 978185 - DNA, 25 bp, Mus musculus
tgcctattgtgacgaactaatgacc

SEQ ID NO: 978186 - DNA, 25 bp, Mus musculus
tgcctattgtgaggaactaatgacc

SEQ ID NO: 978187 - DNA, 25 bp, Mus musculus
tgcctcaaacatcgtgctcatggga

SEQ ID NO: 978188 - DNA, 25 bp, Mus musculus
tgcctcaaacatggtgctcatggga

SEQ ID NO: 978189 - DNA, 25 bp, Mus musculus
tgcctcaaagctcattggctaagca

SEQ ID NO: 978190 - DNA, 25 bp, Mus musculus
tgcctcaaaggtcattggctaagca

SEQ ID NO: 978191 - DNA, 25 bp, Mus musculus
tgcctcaaatgacacgggcatcgat

SEQ ID NO: 978192 - DNA, 25 bp, Mus musculus
tgcctcaaatgacaggggcatcgat

SEQ ID NO: 978193 - DNA, 25 bp, Mus musculus
tgcctcacagaagtcgacactgtac

SEQ ID NO: 978194 - DNA, 25 bp, Mus musculus
tgcctcacagtagtcgacactgtac

SEQ ID NO: 978195 - DNA, 25 bp, Mus musculus
tgcctcagtgaagaaactgacgctc

SEQ ID NO: 978196 - DNA, 25 bp, Mus musculus
tgcctcagtgctggtgagctcttca

SEQ ID NO: 978197 - DNA, 25 bp, Mus musculus
tgcctcagtggtggtgagctcttca

SEQ ID NO: 978198 - DNA, 25 bp, Mus musculus
tgcctcagtgtagaaactgacgctc

SEQ ID NO: 978199 - DNA, 25 bp, Mus musculus
tgcctcagtttcagctcttggataa

SEQ ID NO: 978200 - DNA, 25 bp, Mus musculus
tgcctcagtttctgctcttggataa

SEQ ID NO: 978201 - DNA, 25 bp, Mus musculus
tgcctcataaagcaggtggacatct

SEQ ID NO: 978202 - DNA, 25 bp, Mus musculus
tgcctcataaaggaggtggacatct

SEQ ID NO: 978203 - DNA, 25 bp, Mus musculus
tgcctcatcattcggggaggaggtg

SEQ ID NO: 978204 - DNA, 25 bp, Mus musculus
tgcctcatcattgggggaggaggtg

SEQ ID NO: 978205 - DNA, 25 bp, Mus musculus
tgcctcccacctcccctgatccagg

SEQ ID NO: 978206 - DNA, 25 bp, Mus musculus
tgcctcccacctccgctgatccagg

SEQ ID NO: 978207 - DNA, 25 bp, Mus musculus
tgcctccgacgagaactatgagatc

SEQ ID NO: 978208 - DNA, 25 bp, Mus musculus
tgcctccgacgagatctatgagatc

SEQ ID NO: 978209 - DNA, 25 bp, Mus musculus
tgcctccttcagatgacggattcca

SEQ ID NO: 978210 - DNA, 25 bp, Mus musculus
tgcctccttcagttgacggattcca

SEQ ID NO: 978211 - DNA, 25 bp, Mus musculus
tgcctcgccatgcctgaccagctga

SEQ ID NO: 978212 - DNA, 25 bp, Mus musculus
tgcctcgccatggctgaccagctga

SEQ ID NO: 978213 - DNA, 25 bp, Mus musculus
tgcctcgcggagcaaaatcaactaa

SEQ ID NO: 978214 - DNA, 25 bp, Mus musculus
tgcctcgcggaggaaaatcaactaa

SEQ ID NO: 978215 - DNA, 25 bp, Mus musculus
tgcctcggagattcagcctcaactg

SEQ ID NO: 978216 - DNA, 25 bp, Mus musculus
tgcctcggagcacagcgatcagcag

SEQ ID NO: 978217 - DNA, 25 bp, Mus musculus
tgcctcggagcagagcgatcagcag

SEQ ID NO: 978218 - DNA, 25 bp, Mus musculus
tgcctcggagtttcagcctcaactg

SEQ ID NO: 978219 - DNA, 25 bp, Mus musculus
tgcctcggcccaccacagcccccca

SEQ ID NO: 978220 - DNA, 25 bp, Mus musculus
tgcctcggcccagcacagcccccca

SEQ ID NO: 978221 - DNA, 25 bp, Mus musculus
tgcctcggcgctgttcacctacaag

SEQ ID NO: 978222 - DNA, 25 bp, Mus musculus
tgcctcggcggtgttcacctacaag

SEQ ID NO: 978223 - DNA, 25 bp, Mus musculus
tgcctcgtggcctgcaaaatatgat

SEQ ID NO: 978224 - DNA, 25 bp, Mus musculus
tgcctcgtggcctggaaaatatgat

SEQ ID NO: 978225 - DNA, 25 bp, Mus musculus
tgcctctaagaactgtatacaccga

SEQ ID NO: 978226 - DNA, 25 bp, Mus musculus
tgcctctaagaagtgtatacaccga

SEQ ID NO: 978227 - DNA, 25 bp, Mus musculus
tgcctctcatggcggttggggtgat

SEQ ID NO: 978228 - DNA, 25 bp, Mus musculus
tgcctctcatgggggttggggtgat

SEQ ID NO: 978229 - DNA, 25 bp, Mus musculus
tgcctctgcccgatcatcattggcc

SEQ ID NO: 978230 - DNA, 25 bp, Mus musculus
tgcctctgcccgatgatcattggcc

SEQ ID NO: 978231 - DNA, 25 bp, Mus musculus
tgcctctggccccacctcgaagctg

SEQ ID NO: 978232 - DNA, 25 bp, Mus musculus
tgcctctggccccagctcgaagctg

SEQ ID NO: 978233 - DNA, 25 bp, Mus musculus
tgcctcttatccagctatatgattc

SEQ ID NO: 978234 - DNA, 25 bp, Mus musculus
tgcctcttatccaggtatatgattc

SEQ ID NO: 978235 - DNA, 25 bp, Mus musculus
tgcctcttcatgccggctctgccct

SEQ ID NO: 978236 - DNA, 25 bp, Mus musculus
tgcctcttcatggcggctctgccct

SEQ ID NO: 978237 - DNA, 25 bp, Mus musculus
tgcctcttcgcgtttgtctactatg

SEQ ID NO: 978238 - DNA, 25 bp, Mus musculus
tgcctcttcgggtttgtctactatg

SEQ ID NO: 978239 - DNA, 25 bp, Mus musculus
tgcctgaacaagatgcactcccatc

SEQ ID NO: 978240 - DNA, 25 bp, Mus musculus
tgcctgaacaagctcagccctgggg

SEQ ID NO: 978241 - DNA, 25 bp, Mus musculus
tgcctgaacaaggtcagccctgggg

SEQ ID NO: 978242 - DNA, 25 bp, Mus musculus
tgcctgaacaagttgcactcccatc

SEQ ID NO: 978243 - DNA, 25 bp, Mus musculus
tgcctgacaaatggcagcttcagtt

SEQ ID NO: 978244 - DNA, 25 bp, Mus musculus
tgcctgacaaattgacatcagcaaa

SEQ ID NO: 978245 - DNA, 25 bp, Mus musculus
tgcctgacaattggcagcttcagtt

SEQ ID NO: 978246 - DNA, 25 bp, Mus musculus
tgcctgacaatttgacatcagcaaa

SEQ ID NO: 978247 - DNA, 25 bp, Mus musculus
tgcctgacaccgatggcagactttc

SEQ ID NO: 978248 - DNA, 25 bp, Mus musculus
tgcctgacaccgttggcagactttc

SEQ ID NO: 978249 - DNA, 25 bp, Mus musculus
tgcctgacagagcggaatgtgtccc

SEQ ID NO: 978250 - DNA, 25 bp, Mus musculus
tgcctgacagaggggaatgtgtccc

SEQ ID NO: 978251 - DNA, 25 bp, Mus musculus
tgcctgacgtctatagccccacctc

SEQ ID NO: 978252 - DNA, 25 bp, Mus musculus
tgcctgacgtctttagccccacctc

SEQ ID NO: 978253 - DNA, 25 bp, Mus musculus
tgcctgactcagaacaggtgagaac

SEQ ID NO: 978254 - DNA, 25 bp, Mus musculus
tgcctgactcagtacaggtgagaac

SEQ ID NO: 978255 - DNA, 25 bp, Mus musculus
tgcctgactccctcggaagctgtcc

SEQ ID NO: 978256 - DNA, 25 bp, Mus musculus
tgcctgactcgctcggaagctgtcc

SEQ ID NO: 978257 - DNA, 25 bp, Mus musculus
tgcctgactgcaaagccaccatgca

SEQ ID NO: 978258 - DNA, 25 bp, Mus musculus
tgcctgactggaaagccaccatgca

SEQ ID NO: 978259 - DNA, 25 bp, Mus musculus
tgcctgagaatgcgaagagaaagat

SEQ ID NO: 978260 - DNA, 25 bp, Mus musculus
tgcctgagaatgggaagagaaagat

SEQ ID NO: 978261 - DNA, 25 bp, Mus musculus
tgcctgagcgcaggactggctaccc

SEQ ID NO: 978262 - DNA, 25 bp, Mus musculus
tgcctgagcgcgctagctgtggagg

SEQ ID NO: 978263 - DNA, 25 bp, Mus musculus
tgcctgagcggaggactggctaccc

SEQ ID NO: 978264 - DNA, 25 bp, Mus musculus
tgcctgagcgggctagctgtggagg

SEQ ID NO: 978265 - DNA, 25 bp, Mus musculus
tgcctgaggaaaaagctggtggcgt

SEQ ID NO: 978266 - DNA, 25 bp, Mus musculus
tgcctgaggaaatagctggtggcgt

SEQ ID NO: 978267 - DNA, 25 bp, Mus musculus
tgcctgatgtatgacgcttcctgcg

SEQ ID NO: 978268 - DNA, 25 bp, Mus musculus
tgcctgatgtatgaggcttcctgcg

SEQ ID NO: 978269 - DNA, 25 bp, Mus musculus
tgcctgattccaatgattcgcctcc

SEQ ID NO: 978270 - DNA, 25 bp, Mus musculus
tgcctgattccattgattcgcctcc

SEQ ID NO: 978271 - DNA, 25 bp, Mus musculus
tgcctgcagctgctggctgcactcc

SEQ ID NO: 978272 - DNA, 25 bp, Mus musculus
tgcctgcagctggtggctgcactcc

SEQ ID NO: 978273 - DNA, 25 bp, Mus musculus
tgcctgcataagagagcaactgttc

SEQ ID NO: 978274 - DNA, 25 bp, Mus musculus
tgcctgcataagcttataagtacat

SEQ ID NO: 978275 - DNA, 25 bp, Mus musculus
tgcctgcataaggttataagtacat

SEQ ID NO: 978276 - DNA, 25 bp, Mus musculus
tgcctgcataagtgagcaactgttc

SEQ ID NO: 978277 - DNA, 25 bp, Mus musculus
tgcctgccagaacatgctgtttgag

SEQ ID NO: 978278 - DNA, 25 bp, Mus musculus
tgcctgccagcgggactcaggtggg

SEQ ID NO: 978279 - DNA, 25 bp, Mus musculus
tgcctgccagcgtgactccgggggc

SEQ ID NO: 978280 - DNA, 25 bp, Mus musculus
tgcctgccagctgagaagccattct

SEQ ID NO: 978281 - DNA, 25 bp, Mus musculus
tgcctgccagggggactcaggtggg

SEQ ID NO: 978282 - DNA, 25 bp, Mus musculus
tgcctgccagggtgactccgggggc

SEQ ID NO: 978283 - DNA, 25 bp, Mus musculus
tgcctgccaggtgagaagccattct

SEQ ID NO: 978284 - DNA, 25 bp, Mus musculus
tgcctgccagtacatgctgtttgag

SEQ ID NO: 978285 - DNA, 25 bp, Mus musculus
tgcctgccatgacacgaaagtaggt

SEQ ID NO: 978286 - DNA, 25 bp, Mus musculus
tgcctgccatgacgaattcttctac

SEQ ID NO: 978287 - DNA, 25 bp, Mus musculus
tgcctgccatgagacgaaagtaggt

SEQ ID NO: 978288 - DNA, 25 bp, Mus musculus
tgcctgccatgaggaattcttctac

SEQ ID NO: 978289 - DNA, 25 bp, Mus musculus
tgcctgctaagcgacaaaggcaaac

SEQ ID NO: 978290 - DNA, 25 bp, Mus musculus
tgcctgctaagcgagaaaggcaaac

SEQ ID NO: 978291 - DNA, 25 bp, Mus musculus
tgcctgctagatcccagcacagata

SEQ ID NO: 978292 - DNA, 25 bp, Mus musculus
tgcctgctagttcccagcacagata

SEQ ID NO: 978293 - DNA, 25 bp, Mus musculus
tgcctgctgaaattcgtgaattatg

SEQ ID NO: 978294 - DNA, 25 bp, Mus musculus
tgcctgctgaaattggtgaattatg

SEQ ID NO: 978295 - DNA, 25 bp, Mus musculus
tgcctgctggaactctctaataaag

SEQ ID NO: 978296 - DNA, 25 bp, Mus musculus
tgcctgctggaagtctctaataaag

SEQ ID NO: 978297 - DNA, 25 bp, Mus musculus
tgcctgctgtatgacatggcagctc

SEQ ID NO: 978298 - DNA, 25 bp, Mus musculus
tgcctgctgtatgagatggcagctc

SEQ ID NO: 978299 - DNA, 25 bp, Mus musculus
tgcctgcttctccgttcagcatggg

SEQ ID NO: 978300 - DNA, 25 bp, Mus musculus
tgcctgcttctcggttcagcatggg

SEQ ID NO: 978301 - DNA, 25 bp, Mus musculus
tgcctggagaatagctcctgtatca

SEQ ID NO: 978302 - DNA, 25 bp, Mus musculus
tgcctggagaattgctcctgtatca

SEQ ID NO: 978303 - DNA, 25 bp, Mus musculus
tgcctggagcagcaacagctcccaa

SEQ ID NO: 978304 - DNA, 25 bp, Mus musculus
tgcctggagcaggaacagctcccaa

SEQ ID NO: 978305 - DNA, 25 bp, Mus musculus
tgcctggcacagaagccttcaggga

SEQ ID NO: 978306 - DNA, 25 bp, Mus musculus
tgcctggcacagtagccttcaggga

SEQ ID NO: 978307 - DNA, 25 bp, Mus musculus
tgcctggcgcaggacctagtatgtt

SEQ ID NO: 978308 - DNA, 25 bp, Mus musculus
tgcctggcgcaggagctagtatgtt

SEQ ID NO: 978309 - DNA, 25 bp, Mus musculus
tgcctggcgccccacagcttgagga

SEQ ID NO: 978310 - DNA, 25 bp, Mus musculus
tgcctggcgccccagagcttgagga

SEQ ID NO: 978311 - DNA, 25 bp, Mus musculus
tgcctggcggccgaaaagcatgctg

SEQ ID NO: 978312 - DNA, 25 bp, Mus musculus
tgcctggcgggcgaaaagcatgctg

SEQ ID NO: 978313 - DNA, 25 bp, Mus musculus
tgcctgggaagacgtccgtgagcgc

SEQ ID NO: 978314 - DNA, 25 bp, Mus musculus
tgcctgggaagaggtccgtgagcgc

SEQ ID NO: 978315 - DNA, 25 bp, Mus musculus
tgcctgggcacacacgccagcggtg

SEQ ID NO: 978316 - DNA, 25 bp, Mus musculus
tgcctgggcacacaggccagcggtg

SEQ ID NO: 978317 - DNA, 25 bp, Mus musculus
tgcctgggcttccacttcacacctg

SEQ ID NO: 978318 - DNA, 25 bp, Mus musculus
tgcctgggcttccagttcacacctg

SEQ ID NO: 978319 - DNA, 25 bp, Mus musculus
tgcctggggaaacgctactcaaaaa

SEQ ID NO: 978320 - DNA, 25 bp, Mus musculus
tgcctggggaaaggctactcaaaaa

SEQ ID NO: 978321 - DNA, 25 bp, Mus musculus
tgcctggggcttcgaacatgggtga

SEQ ID NO: 978322 - DNA, 25 bp, Mus musculus
tgcctggggcttggaacatgggtga

SEQ ID NO: 978323 - DNA, 25 bp, Mus musculus
tgcctgtatgagcgaggcaaccagc

SEQ ID NO: 978324 - DNA, 25 bp, Mus musculus
tgcctgtatgagggaggcaaccagc

SEQ ID NO: 978325 - DNA, 25 bp, Mus musculus
tgcctgtcagccttcctgcgggcac

SEQ ID NO: 978326 - DNA, 25 bp, Mus musculus
tgcctgtcaggcttcctgcgggcac

SEQ ID NO: 978327 - DNA, 25 bp, Mus musculus
tgcctgtcagtcccaggtcctgccc

SEQ ID NO: 978328 - DNA, 25 bp, Mus musculus
tgcctgtcagtcgcaggtcctgccc

SEQ ID NO: 978329 - DNA, 25 bp, Mus musculus
tgcctgtcatgacgaactcagccac

SEQ ID NO: 978330 - DNA, 25 bp, Mus musculus
tgcctgtcatgaggaactcagccac

SEQ ID NO: 978331 - DNA, 25 bp, Mus musculus
tgcctgtctgcaaacaacctgatca

SEQ ID NO: 978332 - DNA, 25 bp, Mus musculus
tgcctgtctggaaacaacctgatca

SEQ ID NO: 978333 - DNA, 25 bp, Mus musculus
tgcctgtgcccacgtggagattgac

SEQ ID NO: 978334 - DNA, 25 bp, Mus musculus
tgcctgtgcccaggtggagattgac

SEQ ID NO: 978335 - DNA, 25 bp, Mus musculus
tgcctgtgccgacagttcccagcat

SEQ ID NO: 978336 - DNA, 25 bp, Mus musculus
tgcctgtgccgagagttcccagcat

SEQ ID NO: 978337 - DNA, 25 bp, Mus musculus
tgcctgtgctagacagtgtgctcaa

SEQ ID NO: 978338 - DNA, 25 bp, Mus musculus
tgcctgtgctagtcagtgtgctcaa

SEQ ID NO: 978339 - DNA, 25 bp, Mus musculus
tgcctgtgtgtcgacgagatggtgt

SEQ ID NO: 978340 - DNA, 25 bp, Mus musculus
tgcctgtgtgtcgaggagatggtgt

SEQ ID NO: 978341 - DNA, 25 bp, Mus musculus
tgcctgttgctgctcttatttccga

SEQ ID NO: 978342 - DNA, 25 bp, Mus musculus
tgcctgttgctgctgttatttccga

SEQ ID NO: 978343 - DNA, 25 bp, Mus musculus
tgccttaaagctaatgctgccatgc

SEQ ID NO: 978344 - DNA, 25 bp, Mus musculus
tgccttaaaggtaatgctgccatgc

SEQ ID NO: 978345 - DNA, 25 bp, Mus musculus
tgccttacagcccccgggtgctcgt

SEQ ID NO: 978346 - DNA, 25 bp, Mus musculus
tgccttacaggccccgggtgctcgt

SEQ ID NO: 978347 - DNA, 25 bp, Mus musculus
tgccttagccaacagctgtcccgac

SEQ ID NO: 978348 - DNA, 25 bp, Mus musculus
tgccttagccaagagctgtcccgac

SEQ ID NO: 978349 - DNA, 25 bp, Mus musculus
tgccttcaacggagctactgtattg

SEQ ID NO: 978350 - DNA, 25 bp, Mus musculus
tgccttcaacggaggtactgtattg

SEQ ID NO: 978351 - DNA, 25 bp, Mus musculus
tgccttccagcatgtggagtcagag

SEQ ID NO: 978352 - DNA, 25 bp, Mus musculus
tgccttccaggatgtggagtcagag

SEQ ID NO: 978353 - DNA, 25 bp, Mus musculus
tgccttcccccttgcttgcctctct

SEQ ID NO: 978354 - DNA, 25 bp, Mus musculus
tgccttcccccttggttgcctctct

SEQ ID NO: 978355 - DNA, 25 bp, Mus musculus
tgccttcctgcattcaccggcgccc

SEQ ID NO: 978356 - DNA, 25 bp, Mus musculus
tgccttcctggattcaccggcgccc

SEQ ID NO: 978357 - DNA, 25 bp, Mus musculus
tgccttctaccccactgctgtgatc

SEQ ID NO: 978358 - DNA, 25 bp, Mus musculus
tgccttctaccccagtgctgtgatc

SEQ ID NO: 978359 - DNA, 25 bp, Mus musculus
tgccttctccccgacattctgaagt

SEQ ID NO: 978360 - DNA, 25 bp, Mus musculus
tgccttctccccgagattctgaagt

SEQ ID NO: 978361 - DNA, 25 bp, Mus musculus
tgccttcttactctgtcctactgaa

SEQ ID NO: 978362 - DNA, 25 bp, Mus musculus
tgccttcttactgtgtcctactgaa

SEQ ID NO: 978363 - DNA, 25 bp, Mus musculus
tgccttcttcatcgatgaggatgaa

SEQ ID NO: 978364 - DNA, 25 bp, Mus musculus
tgccttcttcatggatgaggatgaa

SEQ ID NO: 978365 - DNA, 25 bp, Mus musculus
tgccttcttgctttgatatcgttgg

SEQ ID NO: 978366 - DNA, 25 bp, Mus musculus
tgccttcttggtttgatatcgttgg

SEQ ID NO: 978367 - DNA, 25 bp, Mus musculus
tgccttgaagctcatggcacagtgg

SEQ ID NO: 978368 - DNA, 25 bp, Mus musculus
tgccttgaaggtcatggcacagtgg

SEQ ID NO: 978369 - DNA, 25 bp, Mus musculus
tgccttgagagtctatcaccactac

SEQ ID NO: 978370 - DNA, 25 bp, Mus musculus
tgccttgagagtctttcaccactac

SEQ ID NO: 978371 - DNA, 25 bp, Mus musculus
tgccttgatgacagggtcccttgca

SEQ ID NO: 978372 - DNA, 25 bp, Mus musculus
tgccttgatgtcagggtcccttgca

SEQ ID NO: 978373 - DNA, 25 bp, Mus musculus
tgccttgattcacgaccaggtagac

SEQ ID NO: 978374 - DNA, 25 bp, Mus musculus
tgccttgattcaggaccaggtagac

SEQ ID NO: 978375 - DNA, 25 bp, Mus musculus
tgccttggacagcctccactgccgc

SEQ ID NO: 978376 - DNA, 25 bp, Mus musculus
tgccttggacaggctccactgccgc

SEQ ID NO: 978377 - DNA, 25 bp, Mus musculus
tgccttgggtcacagctttatcttc

SEQ ID NO: 978378 - DNA, 25 bp, Mus musculus
tgccttgggtcagagctttatcttc

SEQ ID NO: 978379 - DNA, 25 bp, Mus musculus
tgccttgtgcctacttgagcatcga

SEQ ID NO: 978380 - DNA, 25 bp, Mus musculus
tgccttgtgccttcttgagcatcga

SEQ ID NO: 978381 - DNA, 25 bp, Mus musculus
tgcctttattcacgctgacgtgttt

SEQ ID NO: 978382 - DNA, 25 bp, Mus musculus
tgcctttattcaggctgacgtgttt

SEQ ID NO: 978383 - DNA, 25 bp, Mus musculus
tgcctttctctgattgacgggcatc

SEQ ID NO: 978384 - DNA, 25 bp, Mus musculus
tgcctttctctgtttgacgggcatc

SEQ ID NO: 978385 - DNA, 25 bp, Mus musculus
tgcctttgaaaacgtgttgaagagc

SEQ ID NO: 978386 - DNA, 25 bp, Mus musculus
tgcctttgaaaaggtgttgaagagc

SEQ ID NO: 978387 - DNA, 25 bp, Mus musculus
tgcctttgaaacagacataatgaga

SEQ ID NO: 978388 - DNA, 25 bp, Mus musculus
tgcctttgaacatgattctgttact

SEQ ID NO: 978389 - DNA, 25 bp, Mus musculus
tgcctttgaagatgattctgttact

SEQ ID NO: 978390 - DNA, 25 bp, Mus musculus
tgcctttgaagccacgtgtttggcc

SEQ ID NO: 978391 - DNA, 25 bp, Mus musculus
tgcctttgaagccaggtgtttggcc

SEQ ID NO: 978392 - DNA, 25 bp, Mus musculus
tgcctttgaatcagacataatgaga

SEQ ID NO: 978393 - DNA, 25 bp, Mus musculus
tgcctttgcacacaactggtgcatc

SEQ ID NO: 978394 - DNA, 25 bp, Mus musculus
tgcctttgcacagaactggtgcatc

SEQ ID NO: 978395 - DNA, 25 bp, Mus musculus
tgccttttacagcaagtatgagctg

SEQ ID NO: 978396 - DNA, 25 bp, Mus musculus
tgccttttacaggaagtatgagctg

SEQ ID NO: 978397 - DNA, 25 bp, Mus musculus
tgccttttgtcacggattcgataaa

SEQ ID NO: 978398 - DNA, 25 bp, Mus musculus
tgccttttgtcagggattcgataaa

SEQ ID NO: 978399 - DNA, 25 bp, Mus musculus
tgcctttttgagataggttgggcaa

SEQ ID NO: 978400 - DNA, 25 bp, Mus musculus
tgcctttttgtgataggttgggcaa

SEQ ID NO: 978401 - DNA, 25 bp, Mus musculus
tgcgaaatagacgttcgggcttgca

SEQ ID NO: 978402 - DNA, 25 bp, Mus musculus
tgcgaaatagtcgttcgggcttgca

SEQ ID NO: 978403 - DNA, 25 bp, Mus musculus
tgcgaacagctccacggtagcccca

SEQ ID NO: 978404 - DNA, 25 bp, Mus musculus
tgcgaacagctccagggtagcccca

SEQ ID NO: 978405 - DNA, 25 bp, Mus musculus
tgcgaagattagagttgtatttccg

SEQ ID NO: 978406 - DNA, 25 bp, Mus musculus
tgcgaagatttgagttgtatttccg

SEQ ID NO: 978407 - DNA, 25 bp, Mus musculus
tgcgaagcagatttatggtctgcat

SEQ ID NO: 978408 - DNA, 25 bp, Mus musculus
tgcgaagcagcgtgtgcagattata

SEQ ID NO: 978409 - DNA, 25 bp, Mus musculus
tgcgaagcagggtgtgcagattata

SEQ ID NO: 978410 - DNA, 25 bp, Mus musculus
tgcgaagcagttttatggtctgcat

SEQ ID NO: 978411 - DNA, 25 bp, Mus musculus
tgcgaagctccccccatgagaattt

SEQ ID NO: 978412 - DNA, 25 bp, Mus musculus
tgcgaagctcccgccatgagaattt

SEQ ID NO: 978413 - DNA, 25 bp, Mus musculus
tgcgaagtcttcgtcggacctcgca

SEQ ID NO: 978414 - DNA, 25 bp, Mus musculus
tgcgaagtcttcgtgggacctcgca

SEQ ID NO: 978415 - DNA, 25 bp, Mus musculus
tgcgacagattgcttctaggtctta

SEQ ID NO: 978416 - DNA, 25 bp, Mus musculus
tgcgacagattggttctaggtctta

SEQ ID NO: 978417 - DNA, 25 bp, Mus musculus
tgcgacatttcacgaacctcaagta

SEQ ID NO: 978418 - DNA, 25 bp, Mus musculus
tgcgacatttcaggaacctcaagta

SEQ ID NO: 978419 - DNA, 25 bp, Mus musculus
tgcgacccagccattcattgagaag

SEQ ID NO: 978420 - DNA, 25 bp, Mus musculus
tgcgacccagctgcctggctgcagc

SEQ ID NO: 978421 - DNA, 25 bp, Mus musculus
tgcgacccaggcattcattgagaag

SEQ ID NO: 978422 - DNA, 25 bp, Mus musculus
tgcgacccaggtgcctggctgcagc

SEQ ID NO: 978423 - DNA, 25 bp, Mus musculus
tgcgacggccctaacgtttgaggat

SEQ ID NO: 978424 - DNA, 25 bp, Mus musculus
tgcgacggccctaactgggagccgg

SEQ ID NO: 978425 - DNA, 25 bp, Mus musculus
tgcgacggccctaaggtttgaggat

SEQ ID NO: 978426 - DNA, 25 bp, Mus musculus
tgcgacggccctaagtgggagccgg

SEQ ID NO: 978427 - DNA, 25 bp, Mus musculus
tgcgactctgagagcagaggggcag

SEQ ID NO: 978428 - DNA, 25 bp, Mus musculus
tgcgactctgagtgcagaggggcag

SEQ ID NO: 978429 - DNA, 25 bp, Mus musculus
tgcgactgcaagcacttgtcctaca

SEQ ID NO: 978430 - DNA, 25 bp, Mus musculus
tgcgactgcaaggacttgtcctaca

SEQ ID NO: 978431 - DNA, 25 bp, Mus musculus
tgcgacttctaacggcggcagacat

SEQ ID NO: 978432 - DNA, 25 bp, Mus musculus
tgcgacttctaagggcggcagacat

SEQ ID NO: 978433 - DNA, 25 bp, Mus musculus
tgcgagagatgaatcggaagtatgt

SEQ ID NO: 978434 - DNA, 25 bp, Mus musculus
tgcgagagatgaatgggaagtatgt

SEQ ID NO: 978435 - DNA, 25 bp, Mus musculus
tgcgagataactttggggaggcctt

SEQ ID NO: 978436 - DNA, 25 bp, Mus musculus
tgcgagataagtttggggaggcctt

SEQ ID NO: 978437 - DNA, 25 bp, Mus musculus
tgcgagccgcagaggttttatgaag

SEQ ID NO: 978438 - DNA, 25 bp, Mus musculus
tgcgagccgcagtggttttatgaag

SEQ ID NO: 978439 - DNA, 25 bp, Mus musculus
tgcgagctctgcatgctggttgttg

SEQ ID NO: 978440 - DNA, 25 bp, Mus musculus
tgcgagctctgcttgctggttgttg

SEQ ID NO: 978441 - DNA, 25 bp, Mus musculus
tgcgaggccaaactgcattgctctc

SEQ ID NO: 978442 - DNA, 25 bp, Mus musculus
tgcgaggccaaagtgcattgctctc

SEQ ID NO: 978443 - DNA, 25 bp, Mus musculus
tgcgaggccgcaatctgtcgcttta

SEQ ID NO: 978444 - DNA, 25 bp, Mus musculus
tgcgaggccgcattctgtcgcttta

SEQ ID NO: 978445 - DNA, 25 bp, Mus musculus
tgcgagtaagtccacatctgatttg

SEQ ID NO: 978446 - DNA, 25 bp, Mus musculus
tgcgagtaagtccagatctgatttg

SEQ ID NO: 978447 - DNA, 25 bp, Mus musculus
tgcgatcagcctcgcctttagtaaa

SEQ ID NO: 978448 - DNA, 25 bp, Mus musculus
tgcgatcagcctggcctttagtaaa

SEQ ID NO: 978449 - DNA, 25 bp, Mus musculus
tgcgatgaatggctgtatgcccagc

SEQ ID NO: 978450 - DNA, 25 bp, Mus musculus
tgcgatgaatgggtgtatgcccagc

SEQ ID NO: 978451 - DNA, 25 bp, Mus musculus
tgcgattgaagactcttttcacaga

SEQ ID NO: 978452 - DNA, 25 bp, Mus musculus
tgcgattgaagagtcttttcacaga

SEQ ID NO: 978453 - DNA, 25 bp, Mus musculus
tgcgcaaggaggccgtgcagcgagg

SEQ ID NO: 978454 - DNA, 25 bp, Mus musculus
tgcgcaaggagggcgtgcagcgagg

SEQ ID NO: 978455 - DNA, 25 bp, Mus musculus
tgcgcactaaagcgggctgcctgct

SEQ ID NO: 978456 - DNA, 25 bp, Mus musculus
tgcgcactaaagggggctgcctgct

SEQ ID NO: 978457 - DNA, 25 bp, Mus musculus
tgcgcactagggaacgtcccggatg

SEQ ID NO: 978458 - DNA, 25 bp, Mus musculus
tgcgcactagggaaggtcccggatg

SEQ ID NO: 978459 - DNA, 25 bp, Mus musculus
tgcgcagaaacctgtggatgagatg

SEQ ID NO: 978460 - DNA, 25 bp, Mus musculus
tgcgcagaaagctgtggatgagatg

SEQ ID NO: 978461 - DNA, 25 bp, Mus musculus
tgcgcagaagcccgcaagccgagtg

SEQ ID NO: 978462 - DNA, 25 bp, Mus musculus
tgcgcagaagccggcaagccgagtg

SEQ ID NO: 978463 - DNA, 25 bp, Mus musculus
tgcgcagactactttactggaaaga

SEQ ID NO: 978464 - DNA, 25 bp, Mus musculus
tgcgcagacttctttactggaaaga

SEQ ID NO: 978465 - DNA, 25 bp, Mus musculus
tgcgccacagcaaagcactgccacc

SEQ ID NO: 978466 - DNA, 25 bp, Mus musculus
tgcgccacaggaaagcactgccacc

SEQ ID NO: 978467 - DNA, 25 bp, Mus musculus
tgcgccatgaaccgtttgaacgctt

SEQ ID NO: 978468 - DNA, 25 bp, Mus musculus
tgcgccatgaacggtttgaacgctt

SEQ ID NO: 978469 - DNA, 25 bp, Mus musculus
tgcgccatggagctgatctggttcc

SEQ ID NO: 978470 - DNA, 25 bp, Mus musculus
tgcgccatggtgctgatctggttcc

SEQ ID NO: 978471 - DNA, 25 bp, Mus musculus
tgcgccattggtgacctgaaaaatg

SEQ ID NO: 978472 - DNA, 25 bp, Mus musculus
tgcgccattggtgagctgaaaaatg

SEQ ID NO: 978473 - DNA, 25 bp, Mus musculus
tgcgccccagccaccaccatgccaa

SEQ ID NO: 978474 - DNA, 25 bp, Mus musculus
tgcgccccagcctccaccatgccaa

SEQ ID NO: 978475 - DNA, 25 bp, Mus musculus
tgcgccccggcctccagcataccat

SEQ ID NO: 978476 - DNA, 25 bp, Mus musculus
tgcgccccgggctccagcataccat

SEQ ID NO: 978477 - DNA, 25 bp, Mus musculus
tgcgccgactgcggcacgatcctcc

SEQ ID NO: 978478 - DNA, 25 bp, Mus musculus
tgcgccgactgcgggacgatcctcc

SEQ ID NO: 978479 - DNA, 25 bp, Mus musculus
tgcgccgaggcctaaagaccaagaa

SEQ ID NO: 978480 - DNA, 25 bp, Mus musculus
tgcgccgagggctaaagaccaagaa

SEQ ID NO: 978481 - DNA, 25 bp, Mus musculus
tgcgcctgcgcgatgtagatcatgg

SEQ ID NO: 978482 - DNA, 25 bp, Mus musculus
tgcgcctgcgcgttgtagatcatgg

SEQ ID NO: 978483 - DNA, 25 bp, Mus musculus
tgcgcgacagcctgtttggtctcga

SEQ ID NO: 978484 - DNA, 25 bp, Mus musculus
tgcgcgacagcttctggatggtggt

SEQ ID NO: 978485 - DNA, 25 bp, Mus musculus
tgcgcgacaggctgtttggtctcga

SEQ ID NO: 978486 - DNA, 25 bp, Mus musculus
tgcgcgacaggttctggatggtggt

SEQ ID NO: 978487 - DNA, 25 bp, Mus musculus
tgcgcgtggaagctttgaaccagaa

SEQ ID NO: 978488 - DNA, 25 bp, Mus musculus
tgcgcgtggaaggtttgaaccagaa

SEQ ID NO: 978489 - DNA, 25 bp, Mus musculus
tgcgctaaactttgagacttgcact

SEQ ID NO: 978490 - DNA, 25 bp, Mus musculus
tgcgctaaactttgtgacttgcact

SEQ ID NO: 978491 - DNA, 25 bp, Mus musculus
tgcgctatgggtcacgtagtgggca

SEQ ID NO: 978492 - DNA, 25 bp, Mus musculus
tgcgctatgggtcaggtagtgggca

SEQ ID NO: 978493 - DNA, 25 bp, Mus musculus
tgcgctattgggccttctatgtggg

SEQ ID NO: 978494 - DNA, 25 bp, Mus musculus
tgcgctattggggcttctatgtggg

SEQ ID NO: 978495 - DNA, 25 bp, Mus musculus
tgcgctccacagcacctgctaagac

SEQ ID NO: 978496 - DNA, 25 bp, Mus musculus
tgcgctccacaggacctgctaagac

SEQ ID NO: 978497 - DNA, 25 bp, Mus musculus
tgcgctcgcacacgccctctgtgct

SEQ ID NO: 978498 - DNA, 25 bp, Mus musculus
tgcgctcgcacacgccctggaggtg

SEQ ID NO: 978499 - DNA, 25 bp, Mus musculus
tgcgctcgcacacggcctctgtgct

SEQ ID NO: 978500 - DNA, 25 bp, Mus musculus
tgcgctcgcacacggcctggaggtg

SEQ ID NO: 978501 - DNA, 25 bp, Mus musculus
tgcgctcggaacagtgtcgtgatta

SEQ ID NO: 978502 - DNA, 25 bp, Mus musculus
tgcgctcggaactgtgtcgtgatta

SEQ ID NO: 978503 - DNA, 25 bp, Mus musculus
tgcgctctgcagctcgtcacagctc

SEQ ID NO: 978504 - DNA, 25 bp, Mus musculus
tgcgctctgcagctctatgttgtat

SEQ ID NO: 978505 - DNA, 25 bp, Mus musculus
tgcgctctgcagctggtcacagctc

SEQ ID NO: 978506 - DNA, 25 bp, Mus musculus
tgcgctctgcagctgtatgttgtat

SEQ ID NO: 978507 - DNA, 25 bp, Mus musculus
tgcgctctgccacgagctgtactgt

SEQ ID NO: 978508 - DNA, 25 bp, Mus musculus
tgcgctctgccaggagctgtactgt

SEQ ID NO: 978509 - DNA, 25 bp, Mus musculus
tgcgctgactcaggatgacattcgg

SEQ ID NO: 978510 - DNA, 25 bp, Mus musculus
tgcgctgactgacatctactgccga

SEQ ID NO: 978511 - DNA, 25 bp, Mus musculus
tgcgctgactgagatctactgccga

SEQ ID NO: 978512 - DNA, 25 bp, Mus musculus
tgcgctgactgaggatgacattcgg

SEQ ID NO: 978513 - DNA, 25 bp, Mus musculus
tgcgctgcgctaattgtaaattcac

SEQ ID NO: 978514 - DNA, 25 bp, Mus musculus
tgcgctgcgctatttgtaaattcac

SEQ ID NO: 978515 - DNA, 25 bp, Mus musculus
tgcgctggcaggacccagggatttt

SEQ ID NO: 978516 - DNA, 25 bp, Mus musculus
tgcgctggcaggtcccagggatttt

SEQ ID NO: 978517 - DNA, 25 bp, Mus musculus
tgcgctgtatagaatgcggggttcg

SEQ ID NO: 978518 - DNA, 25 bp, Mus musculus
tgcgctgtatagtatgcggggttcg

SEQ ID NO: 978519 - DNA, 25 bp, Mus musculus
tgcgcttcaaatggcgaattggacg

SEQ ID NO: 978520 - DNA, 25 bp, Mus musculus
tgcgcttcaaatggggaattggacg

SEQ ID NO: 978521 - DNA, 25 bp, Mus musculus
tgcggaaaacctcttcatcaaattc

SEQ ID NO: 978522 - DNA, 25 bp, Mus musculus
tgcggaaaacctgttcatcaaattc

SEQ ID NO: 978523 - DNA, 25 bp, Mus musculus
tgcggaaatgcgagaagaaatgggt

SEQ ID NO: 978524 - DNA, 25 bp, Mus musculus
tgcggaaatgggagaagaaatgggt

SEQ ID NO: 978525 - DNA, 25 bp, Mus musculus
tgcggaatcgacagggccagcattt

SEQ ID NO: 978526 - DNA, 25 bp, Mus musculus
tgcggaatcgtcagggccagcattt

SEQ ID NO: 978527 - DNA, 25 bp, Mus musculus
tgcggagagactcggatgagcacag

SEQ ID NO: 978528 - DNA, 25 bp, Mus musculus
tgcggagagactgggatgagcacag

SEQ ID NO: 978529 - DNA, 25 bp, Mus musculus
tgcggagagcggcacaggttccagg

SEQ ID NO: 978530 - DNA, 25 bp, Mus musculus
tgcggagagcggcagaggttccagg

SEQ ID NO: 978531 - DNA, 25 bp, Mus musculus
tgcggagggcctaccaactccacat

SEQ ID NO: 978532 - DNA, 25 bp, Mus musculus
tgcggagggccttccaactccacat

SEQ ID NO: 978533 - DNA, 25 bp, Mus musculus
tgcggatccaagctcagtttgccca

SEQ ID NO: 978534 - DNA, 25 bp, Mus musculus
tgcggatccaaggtcagtttgccca

SEQ ID NO: 978535 - DNA, 25 bp, Mus musculus
tgcggatgctcgttcaggataagac

SEQ ID NO: 978536 - DNA, 25 bp, Mus musculus
tgcggatgctggttcaggataagac

SEQ ID NO: 978537 - DNA, 25 bp, Mus musculus
tgcggatgctgtgaccacgacagaa

SEQ ID NO: 978538 - DNA, 25 bp, Mus musculus
tgcggatgctgtgagcacgacagaa

SEQ ID NO: 978539 - DNA, 25 bp, Mus musculus
tgcggcaaagagccattctggaatt

SEQ ID NO: 978540 - DNA, 25 bp, Mus musculus
tgcggcaaagaggcattctggaatt

SEQ ID NO: 978541 - DNA, 25 bp, Mus musculus
tgcggcacagcccttcacagtggtg

SEQ ID NO: 978542 - DNA, 25 bp, Mus musculus
tgcggcacaggccttcacagtggtg

SEQ ID NO: 978543 - DNA, 25 bp, Mus musculus
tgcggcacataaatttcacacgaaa

SEQ ID NO: 978544 - DNA, 25 bp, Mus musculus
tgcggcacattaatttcacacgaaa

SEQ ID NO: 978545 - DNA, 25 bp, Mus musculus
tgcggcacccctgactacttggctc

SEQ ID NO: 978546 - DNA, 25 bp, Mus musculus
tgcggcacccctgagtacttggctc

SEQ ID NO: 978547 - DNA, 25 bp, Mus musculus
tgcggcatctcaatcttgagtatca

SEQ ID NO: 978548 - DNA, 25 bp, Mus musculus
tgcggcatctcattcttgagtatca

SEQ ID NO: 978549 - DNA, 25 bp, Mus musculus
tgcggcctacaaagagctagtgact

SEQ ID NO: 978550 - DNA, 25 bp, Mus musculus
tgcggcctacaatgagctagtgact

SEQ ID NO: 978551 - DNA, 25 bp, Mus musculus
tgcggcctgacccggctccactcta

SEQ ID NO: 978552 - DNA, 25 bp, Mus musculus
tgcggcctgaccgggctccactcta

SEQ ID NO: 978553 - DNA, 25 bp, Mus musculus
tgcggcgccaagatccccagctcaa

SEQ ID NO: 978554 - DNA, 25 bp, Mus musculus
tgcggcgccaagttccccagctcaa

SEQ ID NO: 978555 - DNA, 25 bp, Mus musculus
tgcggcggagagatgagcctacggt

SEQ ID NO: 978556 - DNA, 25 bp, Mus musculus
tgcggcggagagttgagcctacggt

SEQ ID NO: 978557 - DNA, 25 bp, Mus musculus
tgcggctcttgacgttttagaagag

SEQ ID NO: 978558 - DNA, 25 bp, Mus musculus
tgcggctcttgaggttttagaagag

SEQ ID NO: 978559 - DNA, 25 bp, Mus musculus
tgcggctttctatacagctgggctc

SEQ ID NO: 978560 - DNA, 25 bp, Mus musculus
tgcggctttctatagagctgggctc

SEQ ID NO: 978561 - DNA, 25 bp, Mus musculus
tgcgggccggcgaaatggcaaaatg

SEQ ID NO: 978562 - DNA, 25 bp, Mus musculus
tgcgggccggcgtaatggcaaaatg

SEQ ID NO: 978563 - DNA, 25 bp, Mus musculus
tgcggggatgcaagctgtgccttga

SEQ ID NO: 978564 - DNA, 25 bp, Mus musculus
tgcggggatggaagctgtgccttga

SEQ ID NO: 978565 - DNA, 25 bp, Mus musculus
tgcgggtgctgtgcccttctattcc

SEQ ID NO: 978566 - DNA, 25 bp, Mus musculus
tgcgggtgctgtgcgcttctattcc

SEQ ID NO: 978567 - DNA, 25 bp, Mus musculus
tgcggtccaggacattgtgccttct

SEQ ID NO: 978568 - DNA, 25 bp, Mus musculus
tgcggtccaggagattgtgccttct

SEQ ID NO: 978569 - DNA, 25 bp, Mus musculus
tgcggtctgccccggaagtgtggcc

SEQ ID NO: 978570 - DNA, 25 bp, Mus musculus
tgcggtctgcccgggaagtgtggcc

SEQ ID NO: 978571 - DNA, 25 bp, Mus musculus
tgcggtggttcacctgaccccatat

SEQ ID NO: 978572 - DNA, 25 bp, Mus musculus
tgcggtggttcagctgaccccatat

SEQ ID NO: 978573 - DNA, 25 bp, Mus musculus
tgcggttaagagagcaaaccaacat

SEQ ID NO: 978574 - DNA, 25 bp, Mus musculus
tgcggttaagtgagcaaaccaacat

SEQ ID NO: 978575 - DNA, 25 bp, Mus musculus
tgcggttacactcggtggagttcca

SEQ ID NO: 978576 - DNA, 25 bp, Mus musculus
tgcggttacactgggtggagttcca

SEQ ID NO: 978577 - DNA, 25 bp, Mus musculus
tgcggttcgaagcgcctgctatggt

SEQ ID NO: 978578 - DNA, 25 bp, Mus musculus
tgcggttcgaagggcctgctatggt

SEQ ID NO: 978579 - DNA, 25 bp, Mus musculus
tgcggttgatgaaaatggaagacaa

SEQ ID NO: 978580 - DNA, 25 bp, Mus musculus
tgcggttgatgataatggaagacaa

SEQ ID NO: 978581 - DNA, 25 bp, Mus musculus
tgcgtagagaatccgggtttccgct

SEQ ID NO: 978582 - DNA, 25 bp, Mus musculus
tgcgtagagaatgcgggtttccgct

SEQ ID NO: 978583 - DNA, 25 bp, Mus musculus
tgcgtaggaaggctggtgctgatcg

SEQ ID NO: 978584 - DNA, 25 bp, Mus musculus
tgcgtaggaagggtggtgctgatcg

SEQ ID NO: 978585 - DNA, 25 bp, Mus musculus
tgcgtcaacacccgcggctccttcc

SEQ ID NO: 978586 - DNA, 25 bp, Mus musculus
tgcgtcaacacccggggctccttcc

SEQ ID NO: 978587 - DNA, 25 bp, Mus musculus
tgcgtcaatgagacacagtgtgatg

SEQ ID NO: 978588 - DNA, 25 bp, Mus musculus
tgcgtcaatgtgacacagtgtgatg

SEQ ID NO: 978589 - DNA, 25 bp, Mus musculus
tgcgtcatgggccccattgacgaca

SEQ ID NO: 978590 - DNA, 25 bp, Mus musculus
tgcgtcatgggcccgattgacgaca

SEQ ID NO: 978591 - DNA, 25 bp, Mus musculus
tgcgtcattcagagaggaatgcgat

SEQ ID NO: 978592 - DNA, 25 bp, Mus musculus
tgcgtcattcagtgaggaatgcgat

SEQ ID NO: 978593 - DNA, 25 bp, Mus musculus
tgcgtccaccaacaacgccagctgc

SEQ ID NO: 978594 - DNA, 25 bp, Mus musculus
tgcgtccaccaagaacgccagctgc

SEQ ID NO: 978595 - DNA, 25 bp, Mus musculus
tgcgtccgcttccacctcccgatgc

SEQ ID NO: 978596 - DNA, 25 bp, Mus musculus
tgcgtccgcttccagctcccgatgc

SEQ ID NO: 978597 - DNA, 25 bp, Mus musculus
tgcgtccgtgcccgttctgtacttc

SEQ ID NO: 978598 - DNA, 25 bp, Mus musculus
tgcgtccgtgccggttctgtacttc

SEQ ID NO: 978599 - DNA, 25 bp, Mus musculus
tgcgtctctgttttagaggagcaaa

SEQ ID NO: 978600 - DNA, 25 bp, Mus musculus
tgcgtctctgtttttgaggagcaaa

SEQ ID NO: 978601 - DNA, 25 bp, Mus musculus
tgcgtctgtttgctttgagcgctgc

SEQ ID NO: 978602 - DNA, 25 bp, Mus musculus
tgcgtctgtttggtttgagcgctgc

SEQ ID NO: 978603 - DNA, 25 bp, Mus musculus
tgcgtctttggacggtggaagagca

SEQ ID NO: 978604 - DNA, 25 bp, Mus musculus
tgcgtctttggagggtggaagagca

SEQ ID NO: 978605 - DNA, 25 bp, Mus musculus
tgcgtgccaaagaaggactccatga

SEQ ID NO: 978606 - DNA, 25 bp, Mus musculus
tgcgtgccaaagcactccatgaaag

SEQ ID NO: 978607 - DNA, 25 bp, Mus musculus
tgcgtgccaaaggactccatgaaag

SEQ ID NO: 978608 - DNA, 25 bp, Mus musculus
tgcgtgccaaagtaggactccatga

SEQ ID NO: 978609 - DNA, 25 bp, Mus musculus
tgcgtgtaacagatgctccatcctc

SEQ ID NO: 978610 - DNA, 25 bp, Mus musculus
tgcgtgtaacagcggctccttattg

SEQ ID NO: 978611 - DNA, 25 bp, Mus musculus
tgcgtgtaacaggggctccttattg

SEQ ID NO: 978612 - DNA, 25 bp, Mus musculus
tgcgtgtaacagttgctccatcctc

SEQ ID NO: 978613 - DNA, 25 bp, Mus musculus
tgcgtgttgctgcatgagtattgga

SEQ ID NO: 978614 - DNA, 25 bp, Mus musculus
tgcgtgttgctgcctgccatgccta

SEQ ID NO: 978615 - DNA, 25 bp, Mus musculus
tgcgtgttgctgcctggattgcctt

SEQ ID NO: 978616 - DNA, 25 bp, Mus musculus
tgcgtgttgctggatgagtattgga

SEQ ID NO: 978617 - DNA, 25 bp, Mus musculus
tgcgtgttgctggctgccatgccta

SEQ ID NO: 978618 - DNA, 25 bp, Mus musculus
tgcgtgttgctggctggattgcctt

SEQ ID NO: 978619 - DNA, 25 bp, Mus musculus
tgcgtgttggtcccctctctgcctt

SEQ ID NO: 978620 - DNA, 25 bp, Mus musculus
tgcgtgttggtcccgggggttctac

SEQ ID NO: 978621 - DNA, 25 bp, Mus musculus
tgcgtgttggtcgcctctctgcctt

SEQ ID NO: 978622 - DNA, 25 bp, Mus musculus
tgcgtgttggtcgcgggggttctac

SEQ ID NO: 978623 - DNA, 25 bp, Mus musculus
tgcgttagactcagaggagctgtga

SEQ ID NO: 978624 - DNA, 25 bp, Mus musculus
tgcgttagactcagagtcataaggt

SEQ ID NO: 978625 - DNA, 25 bp, Mus musculus
tgcgttagactcagtggagctgtga

SEQ ID NO: 978626 - DNA, 25 bp, Mus musculus
tgcgttagactcagtgtcataaggt

SEQ ID NO: 978627 - DNA, 25 bp, Mus musculus
tgcgttctcccacttgattggcatg

SEQ ID NO: 978628 - DNA, 25 bp, Mus musculus
tgcgttctcccagttgattggcatg

SEQ ID NO: 978629 - DNA, 25 bp, Mus musculus
tgcgtttttcaacgatgtcactgat

SEQ ID NO: 978630 - DNA, 25 bp, Mus musculus
tgcgtttttcaactatgaagtcaga

SEQ ID NO: 978631 - DNA, 25 bp, Mus musculus
tgcgtttttcaaggatgtcactgat

SEQ ID NO: 978632 - DNA, 25 bp, Mus musculus
tgcgtttttcaagtatgaagtcaga

SEQ ID NO: 978633 - DNA, 25 bp, Mus musculus
tgctaaagcgcctattaaatccctg

SEQ ID NO: 978634 - DNA, 25 bp, Mus musculus
tgctaaagcggctattaaatccctg

SEQ ID NO: 978635 - DNA, 25 bp, Mus musculus
tgctaaagtcatcaccgatgccaga

SEQ ID NO: 978636 - DNA, 25 bp, Mus musculus
tgctaaagtcatcagcgatgccaga

SEQ ID NO: 978637 - DNA, 25 bp, Mus musculus
tgctaaatatcttctagaagcccat

SEQ ID NO: 978638 - DNA, 25 bp, Mus musculus
tgctaaatatgttctagaagcccat

SEQ ID NO: 978639 - DNA, 25 bp, Mus musculus
tgctaacaggagcttggtggttcga

SEQ ID NO: 978640 - DNA, 25 bp, Mus musculus
tgctaacaggaggttggtggttcga

SEQ ID NO: 978641 - DNA, 25 bp, Mus musculus
tgctaaccagagctgcactagctgt

SEQ ID NO: 978642 - DNA, 25 bp, Mus musculus
tgctaaccagtgctgcactagctgt

SEQ ID NO: 978643 - DNA, 25 bp, Mus musculus
tgctaaccggccatttcagaagatg

SEQ ID NO: 978644 - DNA, 25 bp, Mus musculus
tgctaaccgggcatttcagaagatg

SEQ ID NO: 978645 - DNA, 25 bp, Mus musculus
tgctaagaagagaaaaattgcctgt

SEQ ID NO: 978646 - DNA, 25 bp, Mus musculus
tgctaagaagtgaaaaattgcctgt

SEQ ID NO: 978647 - DNA, 25 bp, Mus musculus
tgctaatcagcgtcagatctttgaa

SEQ ID NO: 978648 - DNA, 25 bp, Mus musculus
tgctaatcagggtcagatctttgaa

SEQ ID NO: 978649 - DNA, 25 bp, Mus musculus
tgctaatgagactcagtccgctagt

SEQ ID NO: 978650 - DNA, 25 bp, Mus musculus
tgctaatgagtctcagtccgctagt

SEQ ID NO: 978651 - DNA, 25 bp, Mus musculus
tgctaatgtgagatccaacgagggt

SEQ ID NO: 978652 - DNA, 25 bp, Mus musculus
tgctaatgtgagttccaacgagggt

SEQ ID NO: 978653 - DNA, 25 bp, Mus musculus
tgctacacagcctcttgccagccag

SEQ ID NO: 978654 - DNA, 25 bp, Mus musculus
tgctacacaggctcttgccagccag

SEQ ID NO: 978655 - DNA, 25 bp, Mus musculus
tgctacagagagcacattctgccct

SEQ ID NO: 978656 - DNA, 25 bp, Mus musculus
tgctacagagagcagattctgccct

SEQ ID NO: 978657 - DNA, 25 bp, Mus musculus
tgctacagagtgctgcccaggtccg

SEQ ID NO: 978658 - DNA, 25 bp, Mus musculus
tgctacagagtggtgcccaggtccg

SEQ ID NO: 978659 - DNA, 25 bp, Mus musculus
tgctacattcaacgatttacttaca

SEQ ID NO: 978660 - DNA, 25 bp, Mus musculus
tgctacattcaaggatttacttaca

SEQ ID NO: 978661 - DNA, 25 bp, Mus musculus
tgctaccagggacgacggacaatgc

SEQ ID NO: 978662 - DNA, 25 bp, Mus musculus
tgctaccagggaggacggacaatgc

SEQ ID NO: 978663 - DNA, 25 bp, Mus musculus
tgctacctcagtctcacggatgatt

SEQ ID NO: 978664 - DNA, 25 bp, Mus musculus
tgctacctcagtgtcacggatgatt

SEQ ID NO: 978665 - DNA, 25 bp, Mus musculus
tgctacctgcaccgtgggagtgtgg

SEQ ID NO: 978666 - DNA, 25 bp, Mus musculus
tgctacctgcacggtgggagtgtgg

SEQ ID NO: 978667 - DNA, 25 bp, Mus musculus
tgctacctggaacagtgcctgctca

SEQ ID NO: 978668 - DNA, 25 bp, Mus musculus
tgctacctggaagagtgcctgctca

SEQ ID NO: 978669 - DNA, 25 bp, Mus musculus
tgctacggagctgccttagctggat

SEQ ID NO: 978670 - DNA, 25 bp, Mus musculus
tgctacggaggtgccttagctggat

SEQ ID NO: 978671 - DNA, 25 bp, Mus musculus
tgctacggccgcactcggaacccac

SEQ ID NO: 978672 - DNA, 25 bp, Mus musculus
tgctacggccgctctcggaacccac

SEQ ID NO: 978673 - DNA, 25 bp, Mus musculus
tgctacgggcagcctggaacgagct

SEQ ID NO: 978674 - DNA, 25 bp, Mus musculus
tgctacgggcaggctggaacgagct

SEQ ID NO: 978675 - DNA, 25 bp, Mus musculus
tgctactcagagtttgctaaagaag

SEQ ID NO: 978676 - DNA, 25 bp, Mus musculus
tgctactcagcgccacgtggtgact

SEQ ID NO: 978677 - DNA, 25 bp, Mus musculus
tgctactcagcggcagttggtgacc

SEQ ID NO: 978678 - DNA, 25 bp, Mus musculus
tgctactcagctgatcggaagagca

SEQ ID NO: 978679 - DNA, 25 bp, Mus musculus
tgctactcagggccacgtggtgact

SEQ ID NO: 978680 - DNA, 25 bp, Mus musculus
tgctactcaggggcagttggtgacc

SEQ ID NO: 978681 - DNA, 25 bp, Mus musculus
tgctactcaggtgatcggaagagca

SEQ ID NO: 978682 - DNA, 25 bp, Mus musculus
tgctactcagtgtttgctaaagaag

SEQ ID NO: 978683 - DNA, 25 bp, Mus musculus
tgctactcccagcggggcctggtgt

SEQ ID NO: 978684 - DNA, 25 bp, Mus musculus
tgctactcccaggggggcctggtgt

SEQ ID NO: 978685 - DNA, 25 bp, Mus musculus
tgctactgatagttcccttatcttc

SEQ ID NO: 978686 - DNA, 25 bp, Mus musculus
tgctactgatagttccggatgacgg

SEQ ID NO: 978687 - DNA, 25 bp, Mus musculus
tgctactgatagttgccttatcttc

SEQ ID NO: 978688 - DNA, 25 bp, Mus musculus
tgctactgatagttgcggatgacgg

SEQ ID NO: 978689 - DNA, 25 bp, Mus musculus
tgctacttctcctgcacgtgcgacc

SEQ ID NO: 978690 - DNA, 25 bp, Mus musculus
tgctacttctcctgccaacgatatc

SEQ ID NO: 978691 - DNA, 25 bp, Mus musculus
tgctacttctcctggacgtgcgacc

SEQ ID NO: 978692 - DNA, 25 bp, Mus musculus
tgctacttctcctggcaacgatatc

SEQ ID NO: 978693 - DNA, 25 bp, Mus musculus
tgctagaattcttacgcaccagagc

SEQ ID NO: 978694 - DNA, 25 bp, Mus musculus
tgctagaattcttaggcaccagagc

SEQ ID NO: 978695 - DNA, 25 bp, Mus musculus
tgctagacagcaagatccatgtcat

SEQ ID NO: 978696 - DNA, 25 bp, Mus musculus
tgctagacagccttgtgttgcggag

SEQ ID NO: 978697 - DNA, 25 bp, Mus musculus
tgctagacagctggaaggctctcaa

SEQ ID NO: 978698 - DNA, 25 bp, Mus musculus
tgctagacaggaagatccatgtcat

SEQ ID NO: 978699 - DNA, 25 bp, Mus musculus
tgctagacaggcttgtgttgcggag

SEQ ID NO: 978700 - DNA, 25 bp, Mus musculus
tgctagacaggtggaaggctctcaa

SEQ ID NO: 978701 - DNA, 25 bp, Mus musculus
tgctagagcatgccccacccctgga

SEQ ID NO: 978702 - DNA, 25 bp, Mus musculus
tgctagagcatggcccacccctgga

SEQ ID NO: 978703 - DNA, 25 bp, Mus musculus
tgctagatgcagctgtcattaagat

SEQ ID NO: 978704 - DNA, 25 bp, Mus musculus
tgctagatgcaggtgtcattaagat

SEQ ID NO: 978705 - DNA, 25 bp, Mus musculus
tgctagattatactgataaacaagc

SEQ ID NO: 978706 - DNA, 25 bp, Mus musculus
tgctagattatagtgataaacaagc

SEQ ID NO: 978707 - DNA, 25 bp, Mus musculus
tgctagcaaacgccgagaagcaatg

SEQ ID NO: 978708 - DNA, 25 bp, Mus musculus
tgctagcaaaggccgagaagcaatg

SEQ ID NO: 978709 - DNA, 25 bp, Mus musculus
tgctagcagacgcggcggaagcaga

SEQ ID NO: 978710 - DNA, 25 bp, Mus musculus
tgctagcagagccgcggcggaagca

SEQ ID NO: 978711 - DNA, 25 bp, Mus musculus
tgctagcagagcggcggcggaagca

SEQ ID NO: 978712 - DNA, 25 bp, Mus musculus
tgctagcagaggcggcggaagcaga

SEQ ID NO: 978713 - DNA, 25 bp, Mus musculus
tgctagccagagctttcgcagttgc

SEQ ID NO: 978714 - DNA, 25 bp, Mus musculus
tgctagccagctatttcttgttgct

SEQ ID NO: 978715 - DNA, 25 bp, Mus musculus
tgctagccaggtatttcttgttgct

SEQ ID NO: 978716 - DNA, 25 bp, Mus musculus
tgctagccagtgctttcgcagttgc

SEQ ID NO: 978717 - DNA, 25 bp, Mus musculus
tgctagcccacccagattaggaagt

SEQ ID NO: 978718 - DNA, 25 bp, Mus musculus
tgctagcccaccgagattaggaagt

SEQ ID NO: 978719 - DNA, 25 bp, Mus musculus
tgctagcttcaacgacccaaagatc

SEQ ID NO: 978720 - DNA, 25 bp, Mus musculus
tgctagcttcaaggacccaaagatc

SEQ ID NO: 978721 - DNA, 25 bp, Mus musculus
tgctaggagagacgaggaaaagcag

SEQ ID NO: 978722 - DNA, 25 bp, Mus musculus
tgctaggagagaggaggaaaagcag

SEQ ID NO: 978723 - DNA, 25 bp, Mus musculus
tgctaggctggctgcctgcctactg

SEQ ID NO: 978724 - DNA, 25 bp, Mus musculus
tgctaggctggctgctagctgccta

SEQ ID NO: 978725 - DNA, 25 bp, Mus musculus
tgctaggctggctggctgcctactg

SEQ ID NO: 978726 - DNA, 25 bp, Mus musculus
tgctaggctggctggtagctgccta

SEQ ID NO: 978727 - DNA, 25 bp, Mus musculus
tgctagtagtgacacgacactactg

SEQ ID NO: 978728 - DNA, 25 bp, Mus musculus
tgctagtagtgacaggacactactg

SEQ ID NO: 978729 - DNA, 25 bp, Mus musculus
tgctagtgcaagaacttttacatca

SEQ ID NO: 978730 - DNA, 25 bp, Mus musculus
tgctagtgcaagtacttttacatca

SEQ ID NO: 978731 - DNA, 25 bp, Mus musculus
tgctagtgctggacgctgctggagt

SEQ ID NO: 978732 - DNA, 25 bp, Mus musculus
tgctagtgctggtcgctgctggagt

SEQ ID NO: 978733 - DNA, 25 bp, Mus musculus
tgctagttggaacgctctgggtggt

SEQ ID NO: 978734 - DNA, 25 bp, Mus musculus
tgctagttggaaggctctgggtggt

SEQ ID NO: 978735 - DNA, 25 bp, Mus musculus
tgctataaagtcagcaaattctgaa

SEQ ID NO: 978736 - DNA, 25 bp, Mus musculus
tgctataaagtctgcaaattctgaa

SEQ ID NO: 978737 - DNA, 25 bp, Mus musculus
tgctatacacagatcaaggtagtga

SEQ ID NO: 978738 - DNA, 25 bp, Mus musculus
tgctatacacagttcaaggtagtga

SEQ ID NO: 978739 - DNA, 25 bp, Mus musculus
tgctatcaagctgcagagcccctct

SEQ ID NO: 978740 - DNA, 25 bp, Mus musculus
tgctatcaaggtgcagagcccctct

SEQ ID NO: 978741 - DNA, 25 bp, Mus musculus
tgctatcatgaacaaattagaagag

SEQ ID NO: 978742 - DNA, 25 bp, Mus musculus
tgctatcatgaagaaattagaagag

SEQ ID NO: 978743 - DNA, 25 bp, Mus musculus
tgctatcatgcgtgagtgcatctcc

SEQ ID NO: 978744 - DNA, 25 bp, Mus musculus
tgctatcatgggtgagtgcatctcc

SEQ ID NO: 978745 - DNA, 25 bp, Mus musculus
tgctatccagatctacgtgccctgg

SEQ ID NO: 978746 - DNA, 25 bp, Mus musculus
tgctatccagatgtacgtgccctgg

SEQ ID NO: 978747 - DNA, 25 bp, Mus musculus
tgctatccagcttgccagttcaaga

SEQ ID NO: 978748 - DNA, 25 bp, Mus musculus
tgctatccaggttgccagttcaaga

SEQ ID NO: 978749 - DNA, 25 bp, Mus musculus
tgctatctgttaagaaacaaatgtc

SEQ ID NO: 978750 - DNA, 25 bp, Mus musculus
tgctatctgttatgaaacaaatgtc

SEQ ID NO: 978751 - DNA, 25 bp, Mus musculus
tgctatgaagctacctacagccagc

SEQ ID NO: 978752 - DNA, 25 bp, Mus musculus
tgctatgaagctctggccatgggca

SEQ ID NO: 978753 - DNA, 25 bp, Mus musculus
tgctatgaagctgtggccatgggca

SEQ ID NO: 978754 - DNA, 25 bp, Mus musculus
tgctatgaagcttcctacagccagc

SEQ ID NO: 978755 - DNA, 25 bp, Mus musculus
tgctatgcccagacttcatagtaga

SEQ ID NO: 978756 - DNA, 25 bp, Mus musculus
tgctatgccctgacttcatagtaga

SEQ ID NO: 978757 - DNA, 25 bp, Mus musculus
tgctatgctaagaatgagagccaga

SEQ ID NO: 978758 - DNA, 25 bp, Mus musculus
tgctatgctaagtatgagagccaga

SEQ ID NO: 978759 - DNA, 25 bp, Mus musculus
tgctattaagagaggctatgatgac

SEQ ID NO: 978760 - DNA, 25 bp, Mus musculus
tgctattaagtgaggctatgatgac

SEQ ID NO: 978761 - DNA, 25 bp, Mus musculus
tgctattccaaagaaactggcattg

SEQ ID NO: 978762 - DNA, 25 bp, Mus musculus
tgctattccaaagatactggcattg

SEQ ID NO: 978763 - DNA, 25 bp, Mus musculus
tgctcaaaaactgctgcaagatcct

SEQ ID NO: 978764 - DNA, 25 bp, Mus musculus
tgctcaaaaagtgctgcaagatcct

SEQ ID NO: 978765 - DNA, 25 bp, Mus musculus
tgctcaagaacactttggtggtaat

SEQ ID NO: 978766 - DNA, 25 bp, Mus musculus
tgctcaagaacagtttggtggtaat

SEQ ID NO: 978767 - DNA, 25 bp, Mus musculus
tgctcaagcaagcagcagactctgg

SEQ ID NO: 978768 - DNA, 25 bp, Mus musculus
tgctcaagcaaggagcagactctgg

SEQ ID NO: 978769 - DNA, 25 bp, Mus musculus
tgctcaagctcgcaggtggcagggt

SEQ ID NO: 978770 - DNA, 25 bp, Mus musculus
tgctcaagctcgctggcagggtaaa

SEQ ID NO: 978771 - DNA, 25 bp, Mus musculus
tgctcaagctcggaggtggcagggt

SEQ ID NO: 978772 - DNA, 25 bp, Mus musculus
tgctcaagctcggtggcagggtaaa

SEQ ID NO: 978773 - DNA, 25 bp, Mus musculus
tgctcacagcctttgcaaatggacg

SEQ ID NO: 978774 - DNA, 25 bp, Mus musculus
tgctcacagcgtttgcaaatggacg

SEQ ID NO: 978775 - DNA, 25 bp, Mus musculus
tgctcaccacagagcgaaacatctt

SEQ ID NO: 978776 - DNA, 25 bp, Mus musculus
tgctcaccacagagggaaacatctt

SEQ ID NO: 978777 - DNA, 25 bp, Mus musculus
tgctcaccaccaactccccggaaca

SEQ ID NO: 978778 - DNA, 25 bp, Mus musculus
tgctcaccaccatctccccggaaca

SEQ ID NO: 978779 - DNA, 25 bp, Mus musculus
tgctcaccatcaaaagcaagccgct

SEQ ID NO: 978780 - DNA, 25 bp, Mus musculus
tgctcaccatcataagcaagccgct

SEQ ID NO: 978781 - DNA, 25 bp, Mus musculus
tgctcacccacacagtgctgaccta

SEQ ID NO: 978782 - DNA, 25 bp, Mus musculus
tgctcacccacagagtgctgaccta

SEQ ID NO: 978783 - DNA, 25 bp, Mus musculus
tgctcagaagagcaaagtccaaaaa

SEQ ID NO: 978784 - DNA, 25 bp, Mus musculus
tgctcagaagtgcaaagtccaaaaa

SEQ ID NO: 978785 - DNA, 25 bp, Mus musculus
tgctcagaccaacgccaccttcttg

SEQ ID NO: 978786 - DNA, 25 bp, Mus musculus
tgctcagaccaaggccaccttcttg

SEQ ID NO: 978787 - DNA, 25 bp, Mus musculus
tgctcagagaccgcaatctcactgg

SEQ ID NO: 978788 - DNA, 25 bp, Mus musculus
tgctcagagaccgcaatgtgtatgt

SEQ ID NO: 978789 - DNA, 25 bp, Mus musculus
tgctcagagaccgctatctcactgg

SEQ ID NO: 978790 - DNA, 25 bp, Mus musculus
tgctcagagaccgctatgtgtatgt

SEQ ID NO: 978791 - DNA, 25 bp, Mus musculus
tgctcagcagaatcgggttgagatt

SEQ ID NO: 978792 - DNA, 25 bp, Mus musculus
tgctcagcagatgcttctacctgtg

SEQ ID NO: 978793 - DNA, 25 bp, Mus musculus
tgctcagcagccactctctacaaac

SEQ ID NO: 978794 - DNA, 25 bp, Mus musculus
tgctcagcagccagcgccacatcaa

SEQ ID NO: 978795 - DNA, 25 bp, Mus musculus
tgctcagcagccagggccacatcaa

SEQ ID NO: 978796 - DNA, 25 bp, Mus musculus
tgctcagcagcgataactctctgcc

SEQ ID NO: 978797 - DNA, 25 bp, Mus musculus
tgctcagcaggcactctctacaaac

SEQ ID NO: 978798 - DNA, 25 bp, Mus musculus
tgctcagcagggataactctctgcc

SEQ ID NO: 978799 - DNA, 25 bp, Mus musculus
tgctcagcagtatcgggttgagatt

SEQ ID NO: 978800 - DNA, 25 bp, Mus musculus
tgctcagcagttgcttctacctgtg

SEQ ID NO: 978801 - DNA, 25 bp, Mus musculus
tgctcaggagctcaacgagctggac

SEQ ID NO: 978802 - DNA, 25 bp, Mus musculus
tgctcaggagctcatcgagctggac

SEQ ID NO: 978803 - DNA, 25 bp, Mus musculus
tgctcaggtgactgattcttctcaa

SEQ ID NO: 978804 - DNA, 25 bp, Mus musculus
tgctcaggtgtctgattcttctcaa

SEQ ID NO: 978805 - DNA, 25 bp, Mus musculus
tgctcagtatccagcacaacagctt

SEQ ID NO: 978806 - DNA, 25 bp, Mus musculus
tgctcagtatccaggacaacagctt

SEQ ID NO: 978807 - DNA, 25 bp, Mus musculus
tgctcataagaggtatgcaatctgc

SEQ ID NO: 978808 - DNA, 25 bp, Mus musculus
tgctcataagtggtatgcaatctgc

SEQ ID NO: 978809 - DNA, 25 bp, Mus musculus
tgctcatcaattcatttggtgccat

SEQ ID NO: 978810 - DNA, 25 bp, Mus musculus
tgctcatcaattgatttggtgccat

SEQ ID NO: 978811 - DNA, 25 bp, Mus musculus
tgctcatcatctccattcctcccca

SEQ ID NO: 978812 - DNA, 25 bp, Mus musculus
tgctcatcatctgcattcctcccca

SEQ ID NO: 978813 - DNA, 25 bp, Mus musculus
tgctcatgaaatgaaagcatcgaca

SEQ ID NO: 978814 - DNA, 25 bp, Mus musculus
tgctcatgaaatgatagcatcgaca

SEQ ID NO: 978815 - DNA, 25 bp, Mus musculus
tgctcatgagcgattcatgatggat

SEQ ID NO: 978816 - DNA, 25 bp, Mus musculus
tgctcatgagggattcatgatggat

SEQ ID NO: 978817 - DNA, 25 bp, Mus musculus
tgctcattcgcgctgtggacagagg

SEQ ID NO: 978818 - DNA, 25 bp, Mus musculus
tgctcattcgcggtgtggacagagg

SEQ ID NO: 978819 - DNA, 25 bp, Mus musculus
tgctcattgcagcccagattaacac

SEQ ID NO: 978820 - DNA, 25 bp, Mus musculus
tgctcattgcaggccagattaacac

SEQ ID NO: 978821 - DNA, 25 bp, Mus musculus
tgctccaaagagatttccgcatatt

SEQ ID NO: 978822 - DNA, 25 bp, Mus musculus
tgctccaaagtgatttccgcatatt

SEQ ID NO: 978823 - DNA, 25 bp, Mus musculus
tgctccacagcacaattggtcagaa

SEQ ID NO: 978824 - DNA, 25 bp, Mus musculus
tgctccacagcacatttggtcagaa

SEQ ID NO: 978825 - DNA, 25 bp, Mus musculus
tgctccacttctatcagcaatcccg

SEQ ID NO: 978826 - DNA, 25 bp, Mus musculus
tgctccacttgtatcagcaatcccg

SEQ ID NO: 978827 - DNA, 25 bp, Mus musculus
tgctccagctcagctaccaacgtcc

SEQ ID NO: 978828 - DNA, 25 bp, Mus musculus
tgctccagctctaccaacgtccttc

SEQ ID NO: 978829 - DNA, 25 bp, Mus musculus
tgctccagctgagctaccaacgtcc

SEQ ID NO: 978830 - DNA, 25 bp, Mus musculus
tgctccagctgtaccaacgtccttc

SEQ ID NO: 978831 - DNA, 25 bp, Mus musculus
tgctccaggccccacctttggtggc

SEQ ID NO: 978832 - DNA, 25 bp, Mus musculus
tgctccaggccccagctttggtggc

SEQ ID NO: 978833 - DNA, 25 bp, Mus musculus
tgctccatcggcggcgaagtttggt

SEQ ID NO: 978834 - DNA, 25 bp, Mus musculus
tgctccatcggcggggaagtttggt

SEQ ID NO: 978835 - DNA, 25 bp, Mus musculus
tgctccatgaagctccacctgctct

SEQ ID NO: 978836 - DNA, 25 bp, Mus musculus
tgctccatgaaggtccacctgctct

SEQ ID NO: 978837 - DNA, 25 bp, Mus musculus
tgctcccacccacaaggctgccttc

SEQ ID NO: 978838 - DNA, 25 bp, Mus musculus
tgctcccacccagaaggctgccttc

SEQ ID NO: 978839 - DNA, 25 bp, Mus musculus
tgctcccagatgctgtcataagccg

SEQ ID NO: 978840 - DNA, 25 bp, Mus musculus
tgctcccagatggtgtcataagccg

SEQ ID NO: 978841 - DNA, 25 bp, Mus musculus
tgctcccatgcttatcattgcaagt

SEQ ID NO: 978842 - DNA, 25 bp, Mus musculus
tgctcccatggttatcattgcaagt

SEQ ID NO: 978843 - DNA, 25 bp, Mus musculus
tgctccccagcacctccctggaatc

SEQ ID NO: 978844 - DNA, 25 bp, Mus musculus
tgctccccagcagctccctggaatc

SEQ ID NO: 978845 - DNA, 25 bp, Mus musculus
tgctccccagccctgaggtgcgcac

SEQ ID NO: 978846 - DNA, 25 bp, Mus musculus
tgctccccaggcctgaggtgcgcac

SEQ ID NO: 978847 - DNA, 25 bp, Mus musculus
tgctcccctcttcgatgtcacggca

SEQ ID NO: 978848 - DNA, 25 bp, Mus musculus
tgctcccctcttggatgtcacggca

SEQ ID NO: 978849 - DNA, 25 bp, Mus musculus
tgctcccgagaacgtgatcgtgaag

SEQ ID NO: 978850 - DNA, 25 bp, Mus musculus
tgctcccgagaaggtgatcgtgaag

SEQ ID NO: 978851 - DNA, 25 bp, Mus musculus
tgctccctcgcttagcgctctgtgg

SEQ ID NO: 978852 - DNA, 25 bp, Mus musculus
tgctccctcggttagcgctctgtgg

SEQ ID NO: 978853 - DNA, 25 bp, Mus musculus
tgctccgcagccgacgctcgcgctg

SEQ ID NO: 978854 - DNA, 25 bp, Mus musculus
tgctccgcagccgaggctcgcgctg

SEQ ID NO: 978855 - DNA, 25 bp, Mus musculus
tgctccgcgccacgctcctgcttca

SEQ ID NO: 978856 - DNA, 25 bp, Mus musculus
tgctccgcgccaggctcctgcttca

SEQ ID NO: 978857 - DNA, 25 bp, Mus musculus
tgctccgtcctgcatactccatgtt

SEQ ID NO: 978858 - DNA, 25 bp, Mus musculus
tgctccgtcctggatactccatgtt

SEQ ID NO: 978859 - DNA, 25 bp, Mus musculus
tgctccgtgcccgactttcaggtgc

SEQ ID NO: 978860 - DNA, 25 bp, Mus musculus
tgctccgtgcccgagtttcaggtgc

SEQ ID NO: 978861 - DNA, 25 bp, Mus musculus
tgctccgtggtgcaccggcttcggc

SEQ ID NO: 978862 - DNA, 25 bp, Mus musculus
tgctccgtggtggaccggcttcggc

SEQ ID NO: 978863 - DNA, 25 bp, Mus musculus
tgctcctatttgtgcgattgttcat

SEQ ID NO: 978864 - DNA, 25 bp, Mus musculus
tgctcctatttgtgggattgttcat

SEQ ID NO: 978865 - DNA, 25 bp, Mus musculus
tgctcctcacagaggaaggaaagat

SEQ ID NO: 978866 - DNA, 25 bp, Mus musculus
tgctcctcacagtggaaggaaagat

SEQ ID NO: 978867 - DNA, 25 bp, Mus musculus
tgctcctcagacagcgtgtgctggg

SEQ ID NO: 978868 - DNA, 25 bp, Mus musculus
tgctcctcagacagggtgtgctggg

SEQ ID NO: 978869 - DNA, 25 bp, Mus musculus
tgctcctgagagaacgatgtcacag

SEQ ID NO: 978870 - DNA, 25 bp, Mus musculus
tgctcctgagagaaggatgtcacag

SEQ ID NO: 978871 - DNA, 25 bp, Mus musculus
tgctcctggcatcgtacttttctca

SEQ ID NO: 978872 - DNA, 25 bp, Mus musculus
tgctcctggcatggtacttttctca

SEQ ID NO: 978873 - DNA, 25 bp, Mus musculus
tgctcgccagcaagtagcatctctg

SEQ ID NO: 978874 - DNA, 25 bp, Mus musculus
tgctcgccaggaagtagcatctctg

SEQ ID NO: 978875 - DNA, 25 bp, Mus musculus
tgctcggaatggcaaccctaatggc

SEQ ID NO: 978876 - DNA, 25 bp, Mus musculus
tgctcggaatgggaaccctaatggc

SEQ ID NO: 978877 - DNA, 25 bp, Mus musculus
tgctcgggccaacctccagtacatg

SEQ ID NO: 978878 - DNA, 25 bp, Mus musculus
tgctcgggccaagctccagtacatg

SEQ ID NO: 978879 - DNA, 25 bp, Mus musculus
tgctcgggccgactgaccgtggcgg

SEQ ID NO: 978880 - DNA, 25 bp, Mus musculus
tgctcgggccgagtgaccgtggcgg

SEQ ID NO: 978881 - DNA, 25 bp, Mus musculus
tgctcggtgatgcaagcaacagaag

SEQ ID NO: 978882 - DNA, 25 bp, Mus musculus
tgctcggtgatgccaacagaagaaa

SEQ ID NO: 978883 - DNA, 25 bp, Mus musculus
tgctcggtgatggaagcaacagaag

SEQ ID NO: 978884 - DNA, 25 bp, Mus musculus
tgctcggtgatggcaacagaagaaa

SEQ ID NO: 978885 - DNA, 25 bp, Mus musculus
tgctcgtaccagccacagaagaatg

SEQ ID NO: 978886 - DNA, 25 bp, Mus musculus
tgctcgtaccaggcacagaagaatg

SEQ ID NO: 978887 - DNA, 25 bp, Mus musculus
tgctcgtcagaatcaggtggacacc

SEQ ID NO: 978888 - DNA, 25 bp, Mus musculus
tgctcgtcagtatcaggtggacacc

SEQ ID NO: 978889 - DNA, 25 bp, Mus musculus
tgctcgtccgtggacgttgtcagag

SEQ ID NO: 978890 - DNA, 25 bp, Mus musculus
tgctcgtccgtggaggttgtcagag

SEQ ID NO: 978891 - DNA, 25 bp, Mus musculus
tgctcgtctgcaagactgtgttctc

SEQ ID NO: 978892 - DNA, 25 bp, Mus musculus
tgctcgtctgcaagtctgtgttctc

SEQ ID NO: 978893 - DNA, 25 bp, Mus musculus
tgctctaagagctgcaaaatcaact

SEQ ID NO: 978894 - DNA, 25 bp, Mus musculus
tgctctaagagctggaaaatcaact

SEQ ID NO: 978895 - DNA, 25 bp, Mus musculus
tgctctacacaacgcattttatcct

SEQ ID NO: 978896 - DNA, 25 bp, Mus musculus
tgctctacacaacggattttatcct

SEQ ID NO: 978897 - DNA, 25 bp, Mus musculus
tgctctactcctttcctgctgctgt

SEQ ID NO: 978898 - DNA, 25 bp, Mus musculus
tgctctactcctttgctgctgctgt

SEQ ID NO: 978899 - DNA, 25 bp, Mus musculus
tgctctagagaatggacagcaattt

SEQ ID NO: 978900 - DNA, 25 bp, Mus musculus
tgctctagagtatggacagcaattt

SEQ ID NO: 978901 - DNA, 25 bp, Mus musculus
tgctctatggcacacgaccgctctg

SEQ ID NO: 978902 - DNA, 25 bp, Mus musculus
tgctctatggcacaggaccgctctg

SEQ ID NO: 978903 - DNA, 25 bp, Mus musculus
tgctctcaagcatttgaggtctcaa

SEQ ID NO: 978904 - DNA, 25 bp, Mus musculus
tgctctcaaggatttgaggtctcaa

SEQ ID NO: 978905 - DNA, 25 bp, Mus musculus
tgctctcacaacaattgttcactct

SEQ ID NO: 978906 - DNA, 25 bp, Mus musculus
tgctctcacaactattgttcactct

SEQ ID NO: 978907 - DNA, 25 bp, Mus musculus
tgctctcaggcaaaattccagaatc

SEQ ID NO: 978908 - DNA, 25 bp, Mus musculus
tgctctcagggaaaattccagaatc

SEQ ID NO: 978909 - DNA, 25 bp, Mus musculus
tgctctcccattggcgtgtacacat

SEQ ID NO: 978910 - DNA, 25 bp, Mus musculus
tgctctcccattggggtgtacacat

SEQ ID NO: 978911 - DNA, 25 bp, Mus musculus
tgctctcgacagcaagtcatctcct

SEQ ID NO: 978912 - DNA, 25 bp, Mus musculus
tgctctcgacaggaagtcatctcct

SEQ ID NO: 978913 - DNA, 25 bp, Mus musculus
tgctctcgccaacaccaatataact

SEQ ID NO: 978914 - DNA, 25 bp, Mus musculus
tgctctcgccaacagcaatataact

SEQ ID NO: 978915 - DNA, 25 bp, Mus musculus
tgctctctatttcacgctgcccccg

SEQ ID NO: 978916 - DNA, 25 bp, Mus musculus
tgctctctatttcgagagaaataca

SEQ ID NO: 978917 - DNA, 25 bp, Mus musculus
tgctctctatttgacgctgcccccg

SEQ ID NO: 978918 - DNA, 25 bp, Mus musculus
tgctctctatttggagagaaataca

SEQ ID NO: 978919 - DNA, 25 bp, Mus musculus
tgctctctcagcccatctcctccct

SEQ ID NO: 978920 - DNA, 25 bp, Mus musculus
tgctctctcagcgcatctcctccct

SEQ ID NO: 978921 - DNA, 25 bp, Mus musculus
tgctctctggatccaacattcatta

SEQ ID NO: 978922 - DNA, 25 bp, Mus musculus
tgctctctggatcctacattcatta

SEQ ID NO: 978923 - DNA, 25 bp, Mus musculus
tgctctgactcgagtcttttcactg

SEQ ID NO: 978924 - DNA, 25 bp, Mus musculus
tgctctgactggagtcttttcactg

SEQ ID NO: 978925 - DNA, 25 bp, Mus musculus
tgctctgacttgcgtctgaagactg

SEQ ID NO: 978926 - DNA, 25 bp, Mus musculus
tgctctgacttgggtctgaagactg

SEQ ID NO: 978927 - DNA, 25 bp, Mus musculus
tgctctgagaaacttcaagacagtg

SEQ ID NO: 978928 - DNA, 25 bp, Mus musculus
tgctctgagaaagttcaagacagtg

SEQ ID NO: 978929 - DNA, 25 bp, Mus musculus
tgctctgcagagtgcaattttatca

SEQ ID NO: 978930 - DNA, 25 bp, Mus musculus
tgctctgcagccttcgagtaccttc

SEQ ID NO: 978931 - DNA, 25 bp, Mus musculus
tgctctgcaggcttcgagtaccttc

SEQ ID NO: 978932 - DNA, 25 bp, Mus musculus
tgctctgcagtgacacctgctggct

SEQ ID NO: 978933 - DNA, 25 bp, Mus musculus
tgctctgcagtgtcacctgctggct

SEQ ID NO: 978934 - DNA, 25 bp, Mus musculus
tgctctgcagtgtgcaattttatca

SEQ ID NO: 978935 - DNA, 25 bp, Mus musculus
tgctctggagaccagtgacaagcac

SEQ ID NO: 978936 - DNA, 25 bp, Mus musculus
tgctctggagactcttctcactctg

SEQ ID NO: 978937 - DNA, 25 bp, Mus musculus
tgctctggagagacaagcaccgaga

SEQ ID NO: 978938 - DNA, 25 bp, Mus musculus
tgctctggagctgatggagtctgtg

SEQ ID NO: 978939 - DNA, 25 bp, Mus musculus
tgctctggaggtgatggagtctgtg

SEQ ID NO: 978940 - DNA, 25 bp, Mus musculus
tgctctggagtccagtgacaagcac

SEQ ID NO: 978941 - DNA, 25 bp, Mus musculus
tgctctggagtctcttctcactctg

SEQ ID NO: 978942 - DNA, 25 bp, Mus musculus
tgctctggagtgacaagcaccgaga

SEQ ID NO: 978943 - DNA, 25 bp, Mus musculus
tgctctggatgacagggagatgaga

SEQ ID NO: 978944 - DNA, 25 bp, Mus musculus
tgctctggatgagagggagatgaga

SEQ ID NO: 978945 - DNA, 25 bp, Mus musculus
tgctctgtcttgcactgactctgag

SEQ ID NO: 978946 - DNA, 25 bp, Mus musculus
tgctctgtcttggactgactctgag

SEQ ID NO: 978947 - DNA, 25 bp, Mus musculus
tgctctgttgtgacttcctgataca

SEQ ID NO: 978948 - DNA, 25 bp, Mus musculus
tgctctgttgtgtcttcctgataca

SEQ ID NO: 978949 - DNA, 25 bp, Mus musculus
tgctcttagcatcgttcataagttc

SEQ ID NO: 978950 - DNA, 25 bp, Mus musculus
tgctcttagcatggttcataagttc

SEQ ID NO: 978951 - DNA, 25 bp, Mus musculus
tgctcttattaacgatacagccatg

SEQ ID NO: 978952 - DNA, 25 bp, Mus musculus
tgctcttattaaggatacagccatg

SEQ ID NO: 978953 - DNA, 25 bp, Mus musculus
tgctcttcagaatgtgaagagactc

SEQ ID NO: 978954 - DNA, 25 bp, Mus musculus
tgctcttcagtatgtgaagagactc

SEQ ID NO: 978955 - DNA, 25 bp, Mus musculus
tgctcttcgtggctgagaagatgtt

SEQ ID NO: 978956 - DNA, 25 bp, Mus musculus
tgctcttcgtgggtgagaagatgtt

SEQ ID NO: 978957 - DNA, 25 bp, Mus musculus
tgctcttgcagctgactagcccatg

SEQ ID NO: 978958 - DNA, 25 bp, Mus musculus
tgctcttgcagctgtctagcccatg

SEQ ID NO: 978959 - DNA, 25 bp, Mus musculus
tgctcttgtctccaacctgagcccc

SEQ ID NO: 978960 - DNA, 25 bp, Mus musculus
tgctcttgtctccatcctgagcccc

SEQ ID NO: 978961 - DNA, 25 bp, Mus musculus
tgctgaaagaccccctgactgggtg

SEQ ID NO: 978962 - DNA, 25 bp, Mus musculus
tgctgaaagagcccctgactgggtg

SEQ ID NO: 978963 - DNA, 25 bp, Mus musculus
tgctgaacaacaatgacggaaattt

SEQ ID NO: 978964 - DNA, 25 bp, Mus musculus
tgctgaacaagaatgacggaaattt

SEQ ID NO: 978965 - DNA, 25 bp, Mus musculus
tgctgaacagagcctggatatggac

SEQ ID NO: 978966 - DNA, 25 bp, Mus musculus
tgctgaacagtgcctggatatggac

SEQ ID NO: 978967 - DNA, 25 bp, Mus musculus
tgctgaagaaaactactctcaaaaa

SEQ ID NO: 978968 - DNA, 25 bp, Mus musculus
tgctgaagaaaagtactctcaaaaa

SEQ ID NO: 978969 - DNA, 25 bp, Mus musculus
tgctgaagctacaacaggcagagct

SEQ ID NO: 978970 - DNA, 25 bp, Mus musculus
tgctgaagcttcaacaggcagagct

SEQ ID NO: 978971 - DNA, 25 bp, Mus musculus
tgctgaaggaagctgtgcgccttga

SEQ ID NO: 978972 - DNA, 25 bp, Mus musculus
tgctgaaggaaggtgtgcgccttga

SEQ ID NO: 978973 - DNA, 25 bp, Mus musculus
tgctgaatgctccacgactcaatta

SEQ ID NO: 978974 - DNA, 25 bp, Mus musculus
tgctgaatgctccaggactcaatta

SEQ ID NO: 978975 - DNA, 25 bp, Mus musculus
tgctgaattttacagaacgagttag

SEQ ID NO: 978976 - DNA, 25 bp, Mus musculus
tgctgaattttacagaatggctctg

SEQ ID NO: 978977 - DNA, 25 bp, Mus musculus
tgctgaattttagagaacgagttag

SEQ ID NO: 978978 - DNA, 25 bp, Mus musculus
tgctgaattttagagaatggctctg

SEQ ID NO: 978979 - DNA, 25 bp, Mus musculus
tgctgacaagatcctgtgggaaatc

SEQ ID NO: 978980 - DNA, 25 bp, Mus musculus
tgctgacaagcggtttgctcgggcg

SEQ ID NO: 978981 - DNA, 25 bp, Mus musculus
tgctgacaaggggtttgctcgggcg

SEQ ID NO: 978982 - DNA, 25 bp, Mus musculus
tgctgacaagttcctgtgggaaatc

SEQ ID NO: 978983 - DNA, 25 bp, Mus musculus
tgctgaccgttgaatcttttgagca

SEQ ID NO: 978984 - DNA, 25 bp, Mus musculus
tgctgaccgttgtatcttttgagca

SEQ ID NO: 978985 - DNA, 25 bp, Mus musculus
tgctgactctaacaaaagagaaggc

SEQ ID NO: 978986 - DNA, 25 bp, Mus musculus
tgctgactctaagaaaagagaaggc

SEQ ID NO: 978987 - DNA, 25 bp, Mus musculus
tgctgagatcaacgcccagctggag

SEQ ID NO: 978988 - DNA, 25 bp, Mus musculus
tgctgagatcaaggcccagctggag

SEQ ID NO: 978989 - DNA, 25 bp, Mus musculus
tgctgagatcattacgaaacaggtc

SEQ ID NO: 978990 - DNA, 25 bp, Mus musculus
tgctgagatcattacgtctcagcca

SEQ ID NO: 978991 - DNA, 25 bp, Mus musculus
tgctgagatcattaggaaacaggtc

SEQ ID NO: 978992 - DNA, 25 bp, Mus musculus
tgctgagatcattaggtctcagcca

SEQ ID NO: 978993 - DNA, 25 bp, Mus musculus
tgctgagcaaagatgaagcggcagc

SEQ ID NO: 978994 - DNA, 25 bp, Mus musculus
tgctgagcaaagttgaagcggcagc

SEQ ID NO: 978995 - DNA, 25 bp, Mus musculus
tgctgagcacagcacaaggtgtggt

SEQ ID NO: 978996 - DNA, 25 bp, Mus musculus
tgctgagcacaggacaaggtgtggt

SEQ ID NO: 978997 - DNA, 25 bp, Mus musculus
tgctgagcaccggtactatgggaaa

SEQ ID NO: 978998 - DNA, 25 bp, Mus musculus
tgctgagcacgggtactatgggaaa

SEQ ID NO: 978999 - DNA, 25 bp, Mus musculus
tgctgagcagcttcaattttatata

SEQ ID NO: 979000 - DNA, 25 bp, Mus musculus
tgctgagcaggttcaattttatata

SEQ ID NO: 979001 - DNA, 25 bp, Mus musculus
tgctgagcctggcgaacaaaaactg

SEQ ID NO: 979002 - DNA, 25 bp, Mus musculus
tgctgagcctggctcactgttctgg

SEQ ID NO: 979003 - DNA, 25 bp, Mus musculus
tgctgagcctggggaacaaaaactg

SEQ ID NO: 979004 - DNA, 25 bp, Mus musculus
tgctgagcctgggtcactgttctgg

SEQ ID NO: 979005 - DNA, 25 bp, Mus musculus
tgctgagcgagagacggaactggag

SEQ ID NO: 979006 - DNA, 25 bp, Mus musculus
tgctgagcgagagagggaactggag

SEQ ID NO: 979007 - DNA, 25 bp, Mus musculus
tgctgagtccaggtccagctgctgg

SEQ ID NO: 979008 - DNA, 25 bp, Mus musculus
tgctgagtccaggtcttttggttca

SEQ ID NO: 979009 - DNA, 25 bp, Mus musculus
tgctgagtccaggtgcagctgctgg

SEQ ID NO: 979010 - DNA, 25 bp, Mus musculus
tgctgagtccaggtgttttggttca

SEQ ID NO: 979011 - DNA, 25 bp, Mus musculus
tgctgataagagccaagtgtcaatt

SEQ ID NO: 979012 - DNA, 25 bp, Mus musculus
tgctgataagaggcaagtgtcaatt

SEQ ID NO: 979013 - DNA, 25 bp, Mus musculus
tgctgataagatctcccttgatctg

SEQ ID NO: 979014 - DNA, 25 bp, Mus musculus
tgctgataagatgtctggtgagaag

SEQ ID NO: 979015 - DNA, 25 bp, Mus musculus
tgctgataagttctcccttgatctg

SEQ ID NO: 979016 - DNA, 25 bp, Mus musculus
tgctgataagttgtctggtgagaag

SEQ ID NO: 979017 - DNA, 25 bp, Mus musculus
tgctgatctcagatgctgtttccgt

SEQ ID NO: 979018 - DNA, 25 bp, Mus musculus
tgctgatctcagttgctgtttccgt

SEQ ID NO: 979019 - DNA, 25 bp, Mus musculus
tgctgatgcaagctgagaggtacca

SEQ ID NO: 979020 - DNA, 25 bp, Mus musculus
tgctgatgcagcagctgagaggtac

SEQ ID NO: 979021 - DNA, 25 bp, Mus musculus
tgctgatgcagcctgagaggtacca

SEQ ID NO: 979022 - DNA, 25 bp, Mus musculus
tgctgatgcagcgtgagaggtacca

SEQ ID NO: 979023 - DNA, 25 bp, Mus musculus
tgctgatgcagctgctgagaggtac

SEQ ID NO: 979024 - DNA, 25 bp, Mus musculus
tgctgatgcatgctgagaggtacca

SEQ ID NO: 979025 - DNA, 25 bp, Mus musculus
tgctgatggacacccctgggatcga

SEQ ID NO: 979026 - DNA, 25 bp, Mus musculus
tgctgatggacagccctgggatcga

SEQ ID NO: 979027 - DNA, 25 bp, Mus musculus
tgctgatggccacactctgtttgct

SEQ ID NO: 979028 - DNA, 25 bp, Mus musculus
tgctgatggccagactctgtttgct

SEQ ID NO: 979029 - DNA, 25 bp, Mus musculus
tgctgatgtccacaggcaccccttt

SEQ ID NO: 979030 - DNA, 25 bp, Mus musculus
tgctgatgtccagaggcaccccttt

SEQ ID NO: 979031 - DNA, 25 bp, Mus musculus
tgctgcaaaacccaaagccctttgc

SEQ ID NO: 979032 - DNA, 25 bp, Mus musculus
tgctgcaaaacccatagccctttgc

SEQ ID NO: 979033 - DNA, 25 bp, Mus musculus
tgctgcaaccagatctttgtcttgg

SEQ ID NO: 979034 - DNA, 25 bp, Mus musculus
tgctgcaaccagttctttgtcttgg

SEQ ID NO: 979035 - DNA, 25 bp, Mus musculus
tgctgcacctgtacaatgctgacag

SEQ ID NO: 979036 - DNA, 25 bp, Mus musculus
tgctgcacctgttcaatgctgacag

SEQ ID NO: 979037 - DNA, 25 bp, Mus musculus
tgctgcagagctacatctcagaaat

SEQ ID NO: 979038 - DNA, 25 bp, Mus musculus
tgctgcagagcttcacttggttcac

SEQ ID NO: 979039 - DNA, 25 bp, Mus musculus
tgctgcagagcttcatctcagaaat

SEQ ID NO: 979040 - DNA, 25 bp, Mus musculus
tgctgcagaggttcacttggttcac

SEQ ID NO: 979041 - DNA, 25 bp, Mus musculus
tgctgcagccgacggaatgggcttg

SEQ ID NO: 979042 - DNA, 25 bp, Mus musculus
tgctgcagccgagggaatgggcttg

SEQ ID NO: 979043 - DNA, 25 bp, Mus musculus
tgctgcagctgtcacaactcctagc

SEQ ID NO: 979044 - DNA, 25 bp, Mus musculus
tgctgcagctgtgacaactcctagc

SEQ ID NO: 979045 - DNA, 25 bp, Mus musculus
tgctgcagcttccctcttgtggaca

SEQ ID NO: 979046 - DNA, 25 bp, Mus musculus
tgctgcagcttcgctcttgtggaca

SEQ ID NO: 979047 - DNA, 25 bp, Mus musculus
tgctgcaggcgcgacgttctgcaga

SEQ ID NO: 979048 - DNA, 25 bp, Mus musculus
tgctgcaggcgcgaggttctgcaga

SEQ ID NO: 979049 - DNA, 25 bp, Mus musculus
tgctgcagtcctcgtgtgagaagct

SEQ ID NO: 979050 - DNA, 25 bp, Mus musculus
tgctgcagtcctggtgtgagaagct

SEQ ID NO: 979051 - DNA, 25 bp, Mus musculus
tgctgcagtgaaaggtgtgtttgac

SEQ ID NO: 979052 - DNA, 25 bp, Mus musculus
tgctgcagtgaatggtgtgtttgac

SEQ ID NO: 979053 - DNA, 25 bp, Mus musculus
tgctgcagttttgacgcaagaaatc

SEQ ID NO: 979054 - DNA, 25 bp, Mus musculus
tgctgcagttttgaggcaagaaatc

SEQ ID NO: 979055 - DNA, 25 bp, Mus musculus
tgctgcatgaagaacgatgcgggcg

SEQ ID NO: 979056 - DNA, 25 bp, Mus musculus
tgctgcatgaagaaggatgcgggcg

SEQ ID NO: 979057 - DNA, 25 bp, Mus musculus
tgctgcatgcagaacccttaccagt

SEQ ID NO: 979058 - DNA, 25 bp, Mus musculus
tgctgcatgcagctggtgcagaacc

SEQ ID NO: 979059 - DNA, 25 bp, Mus musculus
tgctgcatgcaggtggtgcagaacc

SEQ ID NO: 979060 - DNA, 25 bp, Mus musculus
tgctgcatgcagtacccttaccagt

SEQ ID NO: 979061 - DNA, 25 bp, Mus musculus
tgctgccaagcgctcctccaattcc

SEQ ID NO: 979062 - DNA, 25 bp, Mus musculus
tgctgccaagggctcctccaattcc

SEQ ID NO: 979063 - DNA, 25 bp, Mus musculus
tgctgccaccagatttgccagcggc

SEQ ID NO: 979064 - DNA, 25 bp, Mus musculus
tgctgccaccagttttgccagcggc

SEQ ID NO: 979065 - DNA, 25 bp, Mus musculus
tgctgccatggtagtgatggacaga

SEQ ID NO: 979066 - DNA, 25 bp, Mus musculus
tgctgccatggttgtgatggacaga

SEQ ID NO: 979067 - DNA, 25 bp, Mus musculus
tgctgccattgacaaaatgaaacag

SEQ ID NO: 979068 - DNA, 25 bp, Mus musculus
tgctgccattgacacgtaccaccag

SEQ ID NO: 979069 - DNA, 25 bp, Mus musculus
tgctgccattgagaaaatgaaacag

SEQ ID NO: 979070 - DNA, 25 bp, Mus musculus
tgctgccattgagacgtaccaccag

SEQ ID NO: 979071 - DNA, 25 bp, Mus musculus
tgctgcccagaagggtccgggagag

SEQ ID NO: 979072 - DNA, 25 bp, Mus musculus
tgctgcccagatcttggtgaccaac

SEQ ID NO: 979073 - DNA, 25 bp, Mus musculus
tgctgcccagcgtccgggagagtgg

SEQ ID NO: 979074 - DNA, 25 bp, Mus musculus
tgctgcccagggtccgggagagtgg

SEQ ID NO: 979075 - DNA, 25 bp, Mus musculus
tgctgcccagtagggtccgggagag

SEQ ID NO: 979076 - DNA, 25 bp, Mus musculus
tgctgcccagttcttggtgaccaac

SEQ ID NO: 979077 - DNA, 25 bp, Mus musculus
tgctgcccctcaccagcagcaacag

SEQ ID NO: 979078 - DNA, 25 bp, Mus musculus
tgctgcccctcagcagcagcaacag

SEQ ID NO: 979079 - DNA, 25 bp, Mus musculus
tgctgcccgaaacgctgagaccgct

SEQ ID NO: 979080 - DNA, 25 bp, Mus musculus
tgctgcccgaaaggctgagaccgct

SEQ ID NO: 979081 - DNA, 25 bp, Mus musculus
tgctgccctcagcccctgcagttca

SEQ ID NO: 979082 - DNA, 25 bp, Mus musculus
tgctgccctcaggccctgcagttca

SEQ ID NO: 979083 - DNA, 25 bp, Mus musculus
tgctgccgatctcagtctctggtcc

SEQ ID NO: 979084 - DNA, 25 bp, Mus musculus
tgctgccgatctgagtctctggtcc

SEQ ID NO: 979085 - DNA, 25 bp, Mus musculus
tgctgcctgcagctcgtggctgcac

SEQ ID NO: 979086 - DNA, 25 bp, Mus musculus
tgctgcctgcagctggtggctgcac

SEQ ID NO: 979087 - DNA, 25 bp, Mus musculus
tgctgcctgtatgaccgaggcaacc

SEQ ID NO: 979088 - DNA, 25 bp, Mus musculus
tgctgcctgtatgagcgaggcaacc

SEQ ID NO: 979089 - DNA, 25 bp, Mus musculus
tgctgccttacaccccccgggtgct

SEQ ID NO: 979090 - DNA, 25 bp, Mus musculus
tgctgccttacagcccccgggtgct

SEQ ID NO: 979091 - DNA, 25 bp, Mus musculus
tgctgcgaagaatcatccagaaccg

SEQ ID NO: 979092 - DNA, 25 bp, Mus musculus
tgctgcgaagtatcatccagaaccg

SEQ ID NO: 979093 - DNA, 25 bp, Mus musculus
tgctgcgacaagccccttggactgg

SEQ ID NO: 979094 - DNA, 25 bp, Mus musculus
tgctgcgacaaggcccttggactgg

SEQ ID NO: 979095 - DNA, 25 bp, Mus musculus
tgctgcgcagatgatgctgaataat

SEQ ID NO: 979096 - DNA, 25 bp, Mus musculus
tgctgcgcagatgcagaaccccgac

SEQ ID NO: 979097 - DNA, 25 bp, Mus musculus
tgctgcgcagttgatgctgaataat

SEQ ID NO: 979098 - DNA, 25 bp, Mus musculus
tgctgcgcagttgcagaaccccgac

SEQ ID NO: 979099 - DNA, 25 bp, Mus musculus
tgctgcgcgtggaacctttgaacca

SEQ ID NO: 979100 - DNA, 25 bp, Mus musculus
tgctgcgcgtggaagctttgaacca

SEQ ID NO: 979101 - DNA, 25 bp, Mus musculus
tgctgcgctcagaccctccaaaggc

SEQ ID NO: 979102 - DNA, 25 bp, Mus musculus
tgctgcgctcagtccctccaaaggc

SEQ ID NO: 979103 - DNA, 25 bp, Mus musculus
tgctgcggagagattttgagtcact

SEQ ID NO: 979104 - DNA, 25 bp, Mus musculus
tgctgcggagagtttttgagtcact

SEQ ID NO: 979105 - DNA, 25 bp, Mus musculus
tgctgcgttcagaccccccaaaggc

SEQ ID NO: 979106 - DNA, 25 bp, Mus musculus
tgctgcgttcagaccctccaaaggc

SEQ ID NO: 979107 - DNA, 25 bp, Mus musculus
tgctgcgttcagtccccccaaaggc

SEQ ID NO: 979108 - DNA, 25 bp, Mus musculus
tgctgcgttcagtccctccaaaggc

SEQ ID NO: 979109 - DNA, 25 bp, Mus musculus
tgctgctaatcacggtcagatcttt

SEQ ID NO: 979110 - DNA, 25 bp, Mus musculus
tgctgctaatcagggtcagatcttt

SEQ ID NO: 979111 - DNA, 25 bp, Mus musculus
tgctgctagacacgcttgtgttgcg

SEQ ID NO: 979112 - DNA, 25 bp, Mus musculus
tgctgctagacaggcttgtgttgcg

SEQ ID NO: 979113 - DNA, 25 bp, Mus musculus
tgctgctagccacctatttcttgtt

SEQ ID NO: 979114 - DNA, 25 bp, Mus musculus
tgctgctagccagctatttcttgtt

SEQ ID NO: 979115 - DNA, 25 bp, Mus musculus
tgctgctatccacgttgccagttca

SEQ ID NO: 979116 - DNA, 25 bp, Mus musculus
tgctgctatccaggttgccagttca

SEQ ID NO: 979117 - DNA, 25 bp, Mus musculus
tgctgctatcggaattgcaaatgcc

SEQ ID NO: 979118 - DNA, 25 bp, Mus musculus
tgctgctatcggtattgcaaatgcc

SEQ ID NO: 979119 - DNA, 25 bp, Mus musculus
tgctgctcaaagaggtcctccgggt

SEQ ID NO: 979120 - DNA, 25 bp, Mus musculus
tgctgctcaatgaggtcctccgggt

SEQ ID NO: 979121 - DNA, 25 bp, Mus musculus
tgctgctcactgcattgctggtttt

SEQ ID NO: 979122 - DNA, 25 bp, Mus musculus
tgctgctcactggattgctggtttt

SEQ ID NO: 979123 - DNA, 25 bp, Mus musculus
tgctgctcagaggcctgcctggaac

SEQ ID NO: 979124 - DNA, 25 bp, Mus musculus
tgctgctcagcagaggcctgcctgg

SEQ ID NO: 979125 - DNA, 25 bp, Mus musculus
tgctgctcaggagaggcctgcctgg

SEQ ID NO: 979126 - DNA, 25 bp, Mus musculus
tgctgctcagtggcctgcctggaac

SEQ ID NO: 979127 - DNA, 25 bp, Mus musculus
tgctgctcataactggtatgcaatc

SEQ ID NO: 979128 - DNA, 25 bp, Mus musculus
tgctgctcataagtggtatgcaatc

SEQ ID NO: 979129 - DNA, 25 bp, Mus musculus
tgctgctcctagccaatgactacat

SEQ ID NO: 979130 - DNA, 25 bp, Mus musculus
tgctgctcctaggcaatgactacat

SEQ ID NO: 979131 - DNA, 25 bp, Mus musculus
tgctgctctctattacacgctgccc

SEQ ID NO: 979132 - DNA, 25 bp, Mus musculus
tgctgctctctattaggagagaaat

SEQ ID NO: 979133 - DNA, 25 bp, Mus musculus
tgctgctctctatttcacgctgccc

SEQ ID NO: 979134 - DNA, 25 bp, Mus musculus
tgctgctctctatttggagagaaat

SEQ ID NO: 979135 - DNA, 25 bp, Mus musculus
tgctgctgaacaacaatgacggaaa

SEQ ID NO: 979136 - DNA, 25 bp, Mus musculus
tgctgctgaacatcaatgacggaaa

SEQ ID NO: 979137 - DNA, 25 bp, Mus musculus
tgctgctgcagctgacacaactcct

SEQ ID NO: 979138 - DNA, 25 bp, Mus musculus
tgctgctgcagctgtcacaactcct

SEQ ID NO: 979139 - DNA, 25 bp, Mus musculus
tgctgctgccagataaagatagaga

SEQ ID NO: 979140 - DNA, 25 bp, Mus musculus
tgctgctgccagttaaagatagaga

SEQ ID NO: 979141 - DNA, 25 bp, Mus musculus
tgctgctgcgcttcagctcaactac

SEQ ID NO: 979142 - DNA, 25 bp, Mus musculus
tgctgctgcggttcagctcaactac

SEQ ID NO: 979143 - DNA, 25 bp, Mus musculus
tgctgctgctgctgccctctccgga

SEQ ID NO: 979144 - DNA, 25 bp, Mus musculus
tgctgctgctgctggcctctccgga

SEQ ID NO: 979145 - DNA, 25 bp, Mus musculus
tgctgctgctggcctctccggagtc

SEQ ID NO: 979146 - DNA, 25 bp, Mus musculus
tgctgctgctgggccctgtctcagc

SEQ ID NO: 979147 - DNA, 25 bp, Mus musculus
tgctgctgctgggcgctgtctcagc

SEQ ID NO: 979148 - DNA, 25 bp, Mus musculus
tgctgctgctgggctctccggagtc

SEQ ID NO: 979149 - DNA, 25 bp, Mus musculus
tgctgctgctgtacaatgttaactg

SEQ ID NO: 979150 - DNA, 25 bp, Mus musculus
tgctgctgctgttcaatgttaactg

SEQ ID NO: 979151 - DNA, 25 bp, Mus musculus
tgctgctgggcgctgtctcagcctc

SEQ ID NO: 979152 - DNA, 25 bp, Mus musculus
tgctgctgggcggtgtctcagcctc

SEQ ID NO: 979153 - DNA, 25 bp, Mus musculus
tgctgctgtttgcttttgcagacag

SEQ ID NO: 979154 - DNA, 25 bp, Mus musculus
tgctgctgtttggttttgcagacag

SEQ ID NO: 979155 - DNA, 25 bp, Mus musculus
tgctgcttaaagcacttggactcga

SEQ ID NO: 979156 - DNA, 25 bp, Mus musculus
tgctgcttaaaggacttggactcga

SEQ ID NO: 979157 - DNA, 25 bp, Mus musculus
tgctgcttctcactcaggatggcta

SEQ ID NO: 979158 - DNA, 25 bp, Mus musculus
tgctgcttctcagtcaggatggcta

SEQ ID NO: 979159 - DNA, 25 bp, Mus musculus
tgctgcttctggatttatttattat

SEQ ID NO: 979160 - DNA, 25 bp, Mus musculus
tgctgcttctggctgccggtgaatc

SEQ ID NO: 979161 - DNA, 25 bp, Mus musculus
tgctgcttctggctggccggcctgg

SEQ ID NO: 979162 - DNA, 25 bp, Mus musculus
tgctgcttctgggtgccggtgaatc

SEQ ID NO: 979163 - DNA, 25 bp, Mus musculus
tgctgcttctgggtggccggcctgg

SEQ ID NO: 979164 - DNA, 25 bp, Mus musculus
tgctgcttctggttttatttattat

SEQ ID NO: 979165 - DNA, 25 bp, Mus musculus
tgctgcttcttcagagctctgcagt

SEQ ID NO: 979166 - DNA, 25 bp, Mus musculus
tgctgcttcttcagtgctctgcagt

SEQ ID NO: 979167 - DNA, 25 bp, Mus musculus
tgctgctttctgctcccaccagcag

SEQ ID NO: 979168 - DNA, 25 bp, Mus musculus
tgctgctttctggtcccaccagcag

SEQ ID NO: 979169 - DNA, 25 bp, Mus musculus
tgctggaaaagcgacctgggagaac

SEQ ID NO: 979170 - DNA, 25 bp, Mus musculus
tgctggaaaagcgacgccttggaac

SEQ ID NO: 979171 - DNA, 25 bp, Mus musculus
tgctggaaaagcgagctgggagaac

SEQ ID NO: 979172 - DNA, 25 bp, Mus musculus
tgctggaaaagcgaggccttggaac

SEQ ID NO: 979173 - DNA, 25 bp, Mus musculus
tgctggaaagaccagattttagtac

SEQ ID NO: 979174 - DNA, 25 bp, Mus musculus
tgctggaaagtccagattttagtac

SEQ ID NO: 979175 - DNA, 25 bp, Mus musculus
tgctggaacccactgatgtctccga

SEQ ID NO: 979176 - DNA, 25 bp, Mus musculus
tgctggaacccagtgatgtctccga

SEQ ID NO: 979177 - DNA, 25 bp, Mus musculus
tgctggacagagcagccaaccccct

SEQ ID NO: 979178 - DNA, 25 bp, Mus musculus
tgctggacagaggagccaaccccct

SEQ ID NO: 979179 - DNA, 25 bp, Mus musculus
tgctggacagcacgccccagttctt

SEQ ID NO: 979180 - DNA, 25 bp, Mus musculus
tgctggacagcaggccccagttctt

SEQ ID NO: 979181 - DNA, 25 bp, Mus musculus
tgctggacagccaatccattcccac

SEQ ID NO: 979182 - DNA, 25 bp, Mus musculus
tgctggacagcccggggcccgccgc

SEQ ID NO: 979183 - DNA, 25 bp, Mus musculus
tgctggacaggcaatccattcccac

SEQ ID NO: 979184 - DNA, 25 bp, Mus musculus
tgctggacaggccggggcccgccgc

SEQ ID NO: 979185 - DNA, 25 bp, Mus musculus
tgctggacatcgtacgagtgccagg

SEQ ID NO: 979186 - DNA, 25 bp, Mus musculus
tgctggacatcgtaggagtgccagg

SEQ ID NO: 979187 - DNA, 25 bp, Mus musculus
tgctggactttcccttagagaagga

SEQ ID NO: 979188 - DNA, 25 bp, Mus musculus
tgctggactttcgcttagagaagga

SEQ ID NO: 979189 - DNA, 25 bp, Mus musculus
tgctggactttgcttcagaaaatgc

SEQ ID NO: 979190 - DNA, 25 bp, Mus musculus
tgctggactttggttcagaaaatgc

SEQ ID NO: 979191 - DNA, 25 bp, Mus musculus
tgctggagagcgccttgaaggttat

SEQ ID NO: 979192 - DNA, 25 bp, Mus musculus
tgctggagagggccttgaaggttat

SEQ ID NO: 979193 - DNA, 25 bp, Mus musculus
tgctggaggtcagacactcggagac

SEQ ID NO: 979194 - DNA, 25 bp, Mus musculus
tgctggaggtcagagactcggagac

SEQ ID NO: 979195 - DNA, 25 bp, Mus musculus
tgctggagtgcgtgcacgtggatga

SEQ ID NO: 979196 - DNA, 25 bp, Mus musculus
tgctggagtgcgtggacgtggatga

SEQ ID NO: 979197 - DNA, 25 bp, Mus musculus
tgctggcaagctgctctaccaggtg

SEQ ID NO: 979198 - DNA, 25 bp, Mus musculus
tgctggcaaggtgctctaccaggtg

SEQ ID NO: 979199 - DNA, 25 bp, Mus musculus
tgctggcagtaactcgcaagaagac

SEQ ID NO: 979200 - DNA, 25 bp, Mus musculus
tgctggcagtaactggcaagaagac

SEQ ID NO: 979201 - DNA, 25 bp, Mus musculus
tgctggcatcaacgtgtcggccctg

SEQ ID NO: 979202 - DNA, 25 bp, Mus musculus
tgctggcatcaaggtgtcggccctg

SEQ ID NO: 979203 - DNA, 25 bp, Mus musculus
tgctggcatgagagccctaaaggcc

SEQ ID NO: 979204 - DNA, 25 bp, Mus musculus
tgctggcatgagtgccctaaaggcc

SEQ ID NO: 979205 - DNA, 25 bp, Mus musculus
tgctggccagtcaacatagccagcc

SEQ ID NO: 979206 - DNA, 25 bp, Mus musculus
tgctggccagtcaagatagccagcc

SEQ ID NO: 979207 - DNA, 25 bp, Mus musculus
tgctggccattgaacagtggcagaa

SEQ ID NO: 979208 - DNA, 25 bp, Mus musculus
tgctggccattgaagagtggcagaa

SEQ ID NO: 979209 - DNA, 25 bp, Mus musculus
tgctggcccatgatcgacttcctgc

SEQ ID NO: 979210 - DNA, 25 bp, Mus musculus
tgctggcccatgatggacttcctgc

SEQ ID NO: 979211 - DNA, 25 bp, Mus musculus
tgctggcccgcttgcagttgctgga

SEQ ID NO: 979212 - DNA, 25 bp, Mus musculus
tgctggcccggttgcagttgctgga

SEQ ID NO: 979213 - DNA, 25 bp, Mus musculus
tgctggcctggaagggacactatga

SEQ ID NO: 979214 - DNA, 25 bp, Mus musculus
tgctggcctggacacagtgggacac

SEQ ID NO: 979215 - DNA, 25 bp, Mus musculus
tgctggcctggagacagtgggacac

SEQ ID NO: 979216 - DNA, 25 bp, Mus musculus
tgctggcctggatgggacactatga

SEQ ID NO: 979217 - DNA, 25 bp, Mus musculus
tgctggcgtccacgcaatcctgaac

SEQ ID NO: 979218 - DNA, 25 bp, Mus musculus
tgctggcgtccaggcaatcctgaac

SEQ ID NO: 979219 - DNA, 25 bp, Mus musculus
tgctggcgttggatcgttacatcca

SEQ ID NO: 979220 - DNA, 25 bp, Mus musculus
tgctggcgttggatggttacatcca

SEQ ID NO: 979221 - DNA, 25 bp, Mus musculus
tgctggctgccttccgaacgtaagc

SEQ ID NO: 979222 - DNA, 25 bp, Mus musculus
tgctggctgccttcggaacgtaagc

SEQ ID NO: 979223 - DNA, 25 bp, Mus musculus
tgctggctgtgtgccgtctgttcct

SEQ ID NO: 979224 - DNA, 25 bp, Mus musculus
tgctggctgtgtgcggtctgttcct

SEQ ID NO: 979225 - DNA, 25 bp, Mus musculus
tgctgggaagcacacctggctttgg

SEQ ID NO: 979226 - DNA, 25 bp, Mus musculus
tgctgggaagcacagctggctttgg

SEQ ID NO: 979227 - DNA, 25 bp, Mus musculus
tgctgggacaattgaacaattgcct

SEQ ID NO: 979228 - DNA, 25 bp, Mus musculus
tgctgggacaattgactggctgtgt

SEQ ID NO: 979229 - DNA, 25 bp, Mus musculus
tgctgggacaattgtacaattgcct

SEQ ID NO: 979230 - DNA, 25 bp, Mus musculus
tgctgggacaattgtctggctgtgt

SEQ ID NO: 979231 - DNA, 25 bp, Mus musculus
tgctgggaggagagcgacatgtttg

SEQ ID NO: 979232 - DNA, 25 bp, Mus musculus
tgctgggaggagctggcccagagtg

SEQ ID NO: 979233 - DNA, 25 bp, Mus musculus
tgctgggaggaggtggcccagagtg

SEQ ID NO: 979234 - DNA, 25 bp, Mus musculus
tgctgggaggagtgcgacatgtttg

SEQ ID NO: 979235 - DNA, 25 bp, Mus musculus
tgctgggcacgggaccctatgggaa

SEQ ID NO: 979236 - DNA, 25 bp, Mus musculus
tgctgggcacgggactccgggtttg

SEQ ID NO: 979237 - DNA, 25 bp, Mus musculus
tgctgggcacgggagcctatgggaa

SEQ ID NO: 979238 - DNA, 25 bp, Mus musculus
tgctgggcacgggagtccgggtttg

SEQ ID NO: 979239 - DNA, 25 bp, Mus musculus
tgctgggccagccgcgctctactcc

SEQ ID NO: 979240 - DNA, 25 bp, Mus musculus
tgctgggccagccgggctctactcc

SEQ ID NO: 979241 - DNA, 25 bp, Mus musculus
tgctggggctggagaagctgggaag

SEQ ID NO: 979242 - DNA, 25 bp, Mus musculus
tgctggggctggtgaagctgggaag

SEQ ID NO: 979243 - DNA, 25 bp, Mus musculus
tgctggtaagcattcactaatccag

SEQ ID NO: 979244 - DNA, 25 bp, Mus musculus
tgctggtaaggattcactaatccag

SEQ ID NO: 979245 - DNA, 25 bp, Mus musculus
tgctggtcacgacctcttctgatct

SEQ ID NO: 979246 - DNA, 25 bp, Mus musculus
tgctggtcacgacgtaaccatcttg

SEQ ID NO: 979247 - DNA, 25 bp, Mus musculus
tgctggtcacgagctcttctgatct

SEQ ID NO: 979248 - DNA, 25 bp, Mus musculus
tgctggtcacgaggtaaccatcttg

SEQ ID NO: 979249 - DNA, 25 bp, Mus musculus
tgctggtcagccagagttcacggcc

SEQ ID NO: 979250 - DNA, 25 bp, Mus musculus
tgctggtcagctctgcaatctgagg

SEQ ID NO: 979251 - DNA, 25 bp, Mus musculus
tgctggtcaggcagagttcacggcc

SEQ ID NO: 979252 - DNA, 25 bp, Mus musculus
tgctggtcaggtctgcaatctgagg

SEQ ID NO: 979253 - DNA, 25 bp, Mus musculus
tgctggtgaactatgtgtctgatgt

SEQ ID NO: 979254 - DNA, 25 bp, Mus musculus
tgctggtgaactttgtgtctgatgt

SEQ ID NO: 979255 - DNA, 25 bp, Mus musculus
tgctggtgagagcaagctttgtctc

SEQ ID NO: 979256 - DNA, 25 bp, Mus musculus
tgctggtgagaggaagctttgtctc

SEQ ID NO: 979257 - DNA, 25 bp, Mus musculus
tgctggtgctcacgcattgcagctc

SEQ ID NO: 979258 - DNA, 25 bp, Mus musculus
tgctggtgctcaggcattgcagctc

SEQ ID NO: 979259 - DNA, 25 bp, Mus musculus
tgctggtgctcccgcattgcagctc

SEQ ID NO: 979260 - DNA, 25 bp, Mus musculus
tgctggtgctccctggaccctaatg

SEQ ID NO: 979261 - DNA, 25 bp, Mus musculus
tgctggtgctccggcattgcagctc

SEQ ID NO: 979262 - DNA, 25 bp, Mus musculus
tgctggtgctccgtggaccctaatg

SEQ ID NO: 979263 - DNA, 25 bp, Mus musculus
tgctggtggaagcaggcaggattga

SEQ ID NO: 979264 - DNA, 25 bp, Mus musculus
tgctggtggaaggaggcaggattga

SEQ ID NO: 979265 - DNA, 25 bp, Mus musculus
tgctggtgggaccaatggatcatgg

SEQ ID NO: 979266 - DNA, 25 bp, Mus musculus
tgctggtgggaccattggatcatgg

SEQ ID NO: 979267 - DNA, 25 bp, Mus musculus
tgctggtgggcacgtgtgctgatgt

SEQ ID NO: 979268 - DNA, 25 bp, Mus musculus
tgctggtgggcaggtgtgctgatgt

SEQ ID NO: 979269 - DNA, 25 bp, Mus musculus
tgctggtggtgaactaaagcaccga

SEQ ID NO: 979270 - DNA, 25 bp, Mus musculus
tgctggtggtgaactgctgtatctt

SEQ ID NO: 979271 - DNA, 25 bp, Mus musculus
tgctggtggtgaagtatatcatgta

SEQ ID NO: 979272 - DNA, 25 bp, Mus musculus
tgctggtggtgatctaaagcaccga

SEQ ID NO: 979273 - DNA, 25 bp, Mus musculus
tgctggtggtgatctgctgtatctt

SEQ ID NO: 979274 - DNA, 25 bp, Mus musculus
tgctggtggtgatgtatatcatgta

SEQ ID NO: 979275 - DNA, 25 bp, Mus musculus
tgctggttggtgcttttgggctgtg

SEQ ID NO: 979276 - DNA, 25 bp, Mus musculus
tgctggttggtggttttgggctgtg

SEQ ID NO: 979277 - DNA, 25 bp, Mus musculus
tgctggtttattaacaccaagctgg

SEQ ID NO: 979278 - DNA, 25 bp, Mus musculus
tgctggtttatttacaccaagctgg

SEQ ID NO: 979279 - DNA, 25 bp, Mus musculus
tgctggttttcctgcgtctcggtct

SEQ ID NO: 979280 - DNA, 25 bp, Mus musculus
tgctggttttcctgggtctcggtct

SEQ ID NO: 979281 - DNA, 25 bp, Mus musculus
tgctgtacagaagagtgtggaaaca

SEQ ID NO: 979282 - DNA, 25 bp, Mus musculus
tgctgtacagagtgtggaaacagga

SEQ ID NO: 979283 - DNA, 25 bp, Mus musculus
tgctgtacagtagagtgtggaaaca

SEQ ID NO: 979284 - DNA, 25 bp, Mus musculus
tgctgtacagtgtgtggaaacagga

SEQ ID NO: 979285 - DNA, 25 bp, Mus musculus
tgctgtaggactttcagctgaggct

SEQ ID NO: 979286 - DNA, 25 bp, Mus musculus
tgctgtaggactttgagctgaggct

SEQ ID NO: 979287 - DNA, 25 bp, Mus musculus
tgctgtatggagcccagcacggcct

SEQ ID NO: 979288 - DNA, 25 bp, Mus musculus
tgctgtatggctggtctatcacacc

SEQ ID NO: 979289 - DNA, 25 bp, Mus musculus
tgctgtatgggtggtctatcacacc

SEQ ID NO: 979290 - DNA, 25 bp, Mus musculus
tgctgtatggtgcccagcacggcct

SEQ ID NO: 979291 - DNA, 25 bp, Mus musculus
tgctgtatgtataccacaccacggc

SEQ ID NO: 979292 - DNA, 25 bp, Mus musculus
tgctgtatgtataccatccccccac

SEQ ID NO: 979293 - DNA, 25 bp, Mus musculus
tgctgtatgtatacgacaccacggc

SEQ ID NO: 979294 - DNA, 25 bp, Mus musculus
tgctgtatgtatacgatccccccac

SEQ ID NO: 979295 - DNA, 25 bp, Mus musculus
tgctgtcaaaaacgtacgactcgag

SEQ ID NO: 979296 - DNA, 25 bp, Mus musculus
tgctgtcaaaaaggtacgactcgag

SEQ ID NO: 979297 - DNA, 25 bp, Mus musculus
tgctgtcaagatcattgagaagcag

SEQ ID NO: 979298 - DNA, 25 bp, Mus musculus
tgctgtcaagttcattgagaagcag

SEQ ID NO: 979299 - DNA, 25 bp, Mus musculus
tgctgtcacgccggcgactgaccag

SEQ ID NO: 979300 - DNA, 25 bp, Mus musculus
tgctgtcacgccggggactgaccag

SEQ ID NO: 979301 - DNA, 25 bp, Mus musculus
tgctgtcaggcgatgggccgagctg

SEQ ID NO: 979302 - DNA, 25 bp, Mus musculus
tgctgtcaggggatgggccgagctg

SEQ ID NO: 979303 - DNA, 25 bp, Mus musculus
tgctgtcattgacctgctggggttg

SEQ ID NO: 979304 - DNA, 25 bp, Mus musculus
tgctgtcattgagctgctggggttg

SEQ ID NO: 979305 - DNA, 25 bp, Mus musculus
tgctgtccacagctccacggtgtgg

SEQ ID NO: 979306 - DNA, 25 bp, Mus musculus
tgctgtccacaggtccacggtgtgg

SEQ ID NO: 979307 - DNA, 25 bp, Mus musculus
tgctgtccagaacgtggggcttatg

SEQ ID NO: 979308 - DNA, 25 bp, Mus musculus
tgctgtccagaaggtggggcttatg

SEQ ID NO: 979309 - DNA, 25 bp, Mus musculus
tgctgtccagaatgtgctggatacg

SEQ ID NO: 979310 - DNA, 25 bp, Mus musculus
tgctgtccagacagtaaggtgcctg

SEQ ID NO: 979311 - DNA, 25 bp, Mus musculus
tgctgtccagactgtaaggtgcctg

SEQ ID NO: 979312 - DNA, 25 bp, Mus musculus
tgctgtccagaggggacctccaggt

SEQ ID NO: 979313 - DNA, 25 bp, Mus musculus
tgctgtccagtatgtgctggatacg

SEQ ID NO: 979314 - DNA, 25 bp, Mus musculus
tgctgtccagtggggacctccaggt

SEQ ID NO: 979315 - DNA, 25 bp, Mus musculus
tgctgtccgagcagtccactcccac

SEQ ID NO: 979316 - DNA, 25 bp, Mus musculus
tgctgtccgagctgtccactcccac

SEQ ID NO: 979317 - DNA, 25 bp, Mus musculus
tgctgtccgcgcgccgggagctgcc

SEQ ID NO: 979318 - DNA, 25 bp, Mus musculus
tgctgtccgcgcgcggggagctgcc

SEQ ID NO: 979319 - DNA, 25 bp, Mus musculus
tgctgtcctgagcattcggcccttt

SEQ ID NO: 979320 - DNA, 25 bp, Mus musculus
tgctgtcctgaggattcggcccttt

SEQ ID NO: 979321 - DNA, 25 bp, Mus musculus
tgctgtgcagagcacatctggtggc

SEQ ID NO: 979322 - DNA, 25 bp, Mus musculus
tgctgtgcagagcagatctggtggc

SEQ ID NO: 979323 - DNA, 25 bp, Mus musculus
tgctgtgcagccatttttgcagatg

SEQ ID NO: 979324 - DNA, 25 bp, Mus musculus
tgctgtgcaggcatttttgcagatg

SEQ ID NO: 979325 - DNA, 25 bp, Mus musculus
tgctgtgcccagaagtaacacagca

SEQ ID NO: 979326 - DNA, 25 bp, Mus musculus
tgctgtgcccagtagtaacacagca

SEQ ID NO: 979327 - DNA, 25 bp, Mus musculus
tgctgtgccgactacgtggaggagc

SEQ ID NO: 979328 - DNA, 25 bp, Mus musculus
tgctgtgccgactaggtggaggagc

SEQ ID NO: 979329 - DNA, 25 bp, Mus musculus
tgctgtgcctcacggcttagtcaaa

SEQ ID NO: 979330 - DNA, 25 bp, Mus musculus
tgctgtgcctcagggcttagtcaaa

SEQ ID NO: 979331 - DNA, 25 bp, Mus musculus
tgctgtggaccactacctgatacta

SEQ ID NO: 979332 - DNA, 25 bp, Mus musculus
tgctgtggaccagtacctgatacta

SEQ ID NO: 979333 - DNA, 25 bp, Mus musculus
tgctgtggagatcggcctggccttc

SEQ ID NO: 979334 - DNA, 25 bp, Mus musculus
tgctgtggagccagtggagcggctc

SEQ ID NO: 979335 - DNA, 25 bp, Mus musculus
tgctgtggagctccttcaaaaaatg

SEQ ID NO: 979336 - DNA, 25 bp, Mus musculus
tgctgtggaggcagtggagcggctc

SEQ ID NO: 979337 - DNA, 25 bp, Mus musculus
tgctgtggaggtccttcaaaaaatg

SEQ ID NO: 979338 - DNA, 25 bp, Mus musculus
tgctgtggagttcggcctggccttc

SEQ ID NO: 979339 - DNA, 25 bp, Mus musculus
tgctgtggcattaaccactgaatgc

SEQ ID NO: 979340 - DNA, 25 bp, Mus musculus
tgctgtggcattaagcactgaatgc

SEQ ID NO: 979341 - DNA, 25 bp, Mus musculus
tgctgtgggaaactacattgagcat

SEQ ID NO: 979342 - DNA, 25 bp, Mus musculus
tgctgtgggaaagtacattgagcat

SEQ ID NO: 979343 - DNA, 25 bp, Mus musculus
tgctgtgtgcagctgtgcggcgctg

SEQ ID NO: 979344 - DNA, 25 bp, Mus musculus
tgctgtgtgcaggtgtgcggcgctg

SEQ ID NO: 979345 - DNA, 25 bp, Mus musculus
tgctgtgttactgacggactttgta

SEQ ID NO: 979346 - DNA, 25 bp, Mus musculus
tgctgtgttactgagggactttgta

SEQ ID NO: 979347 - DNA, 25 bp, Mus musculus
tgctgttaagcaaatgcggcgctct

SEQ ID NO: 979348 - DNA, 25 bp, Mus musculus
tgctgttaaggaaatgcggcgctct

SEQ ID NO: 979349 - DNA, 25 bp, Mus musculus
tgctgttcagcactatattcaacag

SEQ ID NO: 979350 - DNA, 25 bp, Mus musculus
tgctgttcagcagtatattcaacag

SEQ ID NO: 979351 - DNA, 25 bp, Mus musculus
tgctgttctgaatgaagggacctga

SEQ ID NO: 979352 - DNA, 25 bp, Mus musculus
tgctgttctgcttccttgccttgac

SEQ ID NO: 979353 - DNA, 25 bp, Mus musculus
tgctgttctggttccttgccttgac

SEQ ID NO: 979354 - DNA, 25 bp, Mus musculus
tgctgttctgtatgaagggacctga

SEQ ID NO: 979355 - DNA, 25 bp, Mus musculus
tgctgttcttggcgcactgcaaaac

SEQ ID NO: 979356 - DNA, 25 bp, Mus musculus
tgctgttcttggggcactgcaaaac

SEQ ID NO: 979357 - DNA, 25 bp, Mus musculus
tgctgttgctcgctgcgggcgagtc

SEQ ID NO: 979358 - DNA, 25 bp, Mus musculus
tgctgttgctcggtgcgggcgagtc

SEQ ID NO: 979359 - DNA, 25 bp, Mus musculus
tgctgtttcccgcgcgcaaggcacg

SEQ ID NO: 979360 - DNA, 25 bp, Mus musculus
tgctgtttcccgcgcgtgtcctggc

SEQ ID NO: 979361 - DNA, 25 bp, Mus musculus
tgctgtttcccgcgggcaaggcacg

SEQ ID NO: 979362 - DNA, 25 bp, Mus musculus
tgctgtttcccgcgggtgtcctggc

SEQ ID NO: 979363 - DNA, 25 bp, Mus musculus
tgctgtttgataagctgacagtgga

SEQ ID NO: 979364 - DNA, 25 bp, Mus musculus
tgctgtttgatatgctgacagtgga

SEQ ID NO: 979365 - DNA, 25 bp, Mus musculus
tgctgtttgcaacaatgcatcttaa

SEQ ID NO: 979366 - DNA, 25 bp, Mus musculus
tgctgtttgcaacgtatccattatg

SEQ ID NO: 979367 - DNA, 25 bp, Mus musculus
tgctgtttgcaagaatgcatcttaa

SEQ ID NO: 979368 - DNA, 25 bp, Mus musculus
tgctgtttgcaaggtatccattatg

SEQ ID NO: 979369 - DNA, 25 bp, Mus musculus
tgctgtttttacaacgcgaggagaa

SEQ ID NO: 979370 - DNA, 25 bp, Mus musculus
tgctgtttttacaaggcgaggagaa

SEQ ID NO: 979371 - DNA, 25 bp, Mus musculus
tgcttaaaatcacgaaattttgcca

SEQ ID NO: 979372 - DNA, 25 bp, Mus musculus
tgcttaaaatcacgcagggagaaga

SEQ ID NO: 979373 - DNA, 25 bp, Mus musculus
tgcttaaaatcaggaaattttgcca

SEQ ID NO: 979374 - DNA, 25 bp, Mus musculus
tgcttaaaatcaggcagggagaaga

SEQ ID NO: 979375 - DNA, 25 bp, Mus musculus
tgcttaagagaacgtgttaggagtg

SEQ ID NO: 979376 - DNA, 25 bp, Mus musculus
tgcttaagagaaggtgttaggagtg

SEQ ID NO: 979377 - DNA, 25 bp, Mus musculus
tgcttagaaaaaaacgtggacatga

SEQ ID NO: 979378 - DNA, 25 bp, Mus musculus
tgcttagaaaaaaaggtggacatga

SEQ ID NO: 979379 - DNA, 25 bp, Mus musculus
tgcttagaactgcacttattccgag

SEQ ID NO: 979380 - DNA, 25 bp, Mus musculus
tgcttagaactgcagttattccgag

SEQ ID NO: 979381 - DNA, 25 bp, Mus musculus
tgcttagaagatttagatctttcaa

SEQ ID NO: 979382 - DNA, 25 bp, Mus musculus
tgcttagaagattttgatctttcaa

SEQ ID NO: 979383 - DNA, 25 bp, Mus musculus
tgcttagagacttttgtcaagagtc

SEQ ID NO: 979384 - DNA, 25 bp, Mus musculus
tgcttagagagttttgtcaagagtc

SEQ ID NO: 979385 - DNA, 25 bp, Mus musculus
tgcttatgacaaacatttttcagta

SEQ ID NO: 979386 - DNA, 25 bp, Mus musculus
tgcttatgacaaacttttttcagta

SEQ ID NO: 979387 - DNA, 25 bp, Mus musculus
tgcttatgacagcattgtggttgct

SEQ ID NO: 979388 - DNA, 25 bp, Mus musculus
tgcttatgacagcctgaagccatca

SEQ ID NO: 979389 - DNA, 25 bp, Mus musculus
tgcttatgacaggattgtggttgct

SEQ ID NO: 979390 - DNA, 25 bp, Mus musculus
tgcttatgacaggctgaagccatca

SEQ ID NO: 979391 - DNA, 25 bp, Mus musculus
tgcttatgatagcctgtcatccact

SEQ ID NO: 979392 - DNA, 25 bp, Mus musculus
tgcttatgattgcctgtcatccact

SEQ ID NO: 979393 - DNA, 25 bp, Mus musculus
tgcttatggatgactccttaacctc

SEQ ID NO: 979394 - DNA, 25 bp, Mus musculus
tgcttatggatgtctccttaacctc

SEQ ID NO: 979395 - DNA, 25 bp, Mus musculus
tgcttcaagcagagtggcattgtcc

SEQ ID NO: 979396 - DNA, 25 bp, Mus musculus
tgcttcaagcagcatgattgggctg

SEQ ID NO: 979397 - DNA, 25 bp, Mus musculus
tgcttcaagcagcgttccacgccta

SEQ ID NO: 979398 - DNA, 25 bp, Mus musculus
tgcttcaagcaggatgattgggctg

SEQ ID NO: 979399 - DNA, 25 bp, Mus musculus
tgcttcaagcagggttccacgccta

SEQ ID NO: 979400 - DNA, 25 bp, Mus musculus
tgcttcaagcagtgtggcattgtcc

SEQ ID NO: 979401 - DNA, 25 bp, Mus musculus
tgcttcacagagagcagaatgtatg

SEQ ID NO: 979402 - DNA, 25 bp, Mus musculus
tgcttcacagtgagcagaatgtatg

SEQ ID NO: 979403 - DNA, 25 bp, Mus musculus
tgcttcagaggagaagcggaagctg

SEQ ID NO: 979404 - DNA, 25 bp, Mus musculus
tgcttcagaggagatgcggaagctg

SEQ ID NO: 979405 - DNA, 25 bp, Mus musculus
tgcttcagcaaaaccaaatgcagag

SEQ ID NO: 979406 - DNA, 25 bp, Mus musculus
tgcttcagcataaccaaatgcagag

SEQ ID NO: 979407 - DNA, 25 bp, Mus musculus
tgcttcatgtctcgatgtgtctagt

SEQ ID NO: 979408 - DNA, 25 bp, Mus musculus
tgcttcatgtctggatgtgtctagt

SEQ ID NO: 979409 - DNA, 25 bp, Mus musculus
tgcttccaatttcccaataataaac

SEQ ID NO: 979410 - DNA, 25 bp, Mus musculus
tgcttccaatttgccaataataaac

SEQ ID NO: 979411 - DNA, 25 bp, Mus musculus
tgcttccatgacaggcataccagag

SEQ ID NO: 979412 - DNA, 25 bp, Mus musculus
tgcttccatgactggcataccagag

SEQ ID NO: 979413 - DNA, 25 bp, Mus musculus
tgcttcccagaggaagtcacagaca

SEQ ID NO: 979414 - DNA, 25 bp, Mus musculus
tgcttcccagtggaagtcacagaca

SEQ ID NO: 979415 - DNA, 25 bp, Mus musculus
tgcttccctgcacctacaaactctg

SEQ ID NO: 979416 - DNA, 25 bp, Mus musculus
tgcttccctgcagctacaaactctg

SEQ ID NO: 979417 - DNA, 25 bp, Mus musculus
tgcttcctccagcatggattcatgg

SEQ ID NO: 979418 - DNA, 25 bp, Mus musculus
tgcttcctccaggatggattcatgg

SEQ ID NO: 979419 - DNA, 25 bp, Mus musculus
tgcttcctgccccacaaaacatcgg

SEQ ID NO: 979420 - DNA, 25 bp, Mus musculus
tgcttcctgccccagaaaacatcgg

SEQ ID NO: 979421 - DNA, 25 bp, Mus musculus
tgcttcggaaagaccttcaggctcc

SEQ ID NO: 979422 - DNA, 25 bp, Mus musculus
tgcttcggaaagtccttcaggctcc

SEQ ID NO: 979423 - DNA, 25 bp, Mus musculus
tgcttcggacagcgcaacgtttcat

SEQ ID NO: 979424 - DNA, 25 bp, Mus musculus
tgcttcggacagggcaacgtttcat

SEQ ID NO: 979425 - DNA, 25 bp, Mus musculus
tgcttcggtctccacattcgcctct

SEQ ID NO: 979426 - DNA, 25 bp, Mus musculus
tgcttcggtctccagattcgcctct

SEQ ID NO: 979427 - DNA, 25 bp, Mus musculus
tgcttcgtttccaccgtggaatgca

SEQ ID NO: 979428 - DNA, 25 bp, Mus musculus
tgcttcgtttccacggtggaatgca

SEQ ID NO: 979429 - DNA, 25 bp, Mus musculus
tgcttctaagacaggaagtcttaga

SEQ ID NO: 979430 - DNA, 25 bp, Mus musculus
tgcttctaagactggaagtcttaga

SEQ ID NO: 979431 - DNA, 25 bp, Mus musculus
tgcttctcagacaggatggctaaag

SEQ ID NO: 979432 - DNA, 25 bp, Mus musculus
tgcttctcagcgcacgttgtgacaa

SEQ ID NO: 979433 - DNA, 25 bp, Mus musculus
tgcttctcagcgcaggttgtgacaa

SEQ ID NO: 979434 - DNA, 25 bp, Mus musculus
tgcttctcagtcaggatggctaaag

SEQ ID NO: 979435 - DNA, 25 bp, Mus musculus
tgcttctcagtgcacgttgtgacaa

SEQ ID NO: 979436 - DNA, 25 bp, Mus musculus
tgcttctcagtgcaggttgtgacaa

SEQ ID NO: 979437 - DNA, 25 bp, Mus musculus
tgcttctcccagctgccgtggagtc

SEQ ID NO: 979438 - DNA, 25 bp, Mus musculus
tgcttctcccaggtgccgtggagtc

SEQ ID NO: 979439 - DNA, 25 bp, Mus musculus
tgcttctcggagcgtctgccagtga

SEQ ID NO: 979440 - DNA, 25 bp, Mus musculus
tgcttctcggagggtctgccagtga

SEQ ID NO: 979441 - DNA, 25 bp, Mus musculus
tgcttctgagcctcagtttgtagct

SEQ ID NO: 979442 - DNA, 25 bp, Mus musculus
tgcttctgaggctcagtttgtagct

SEQ ID NO: 979443 - DNA, 25 bp, Mus musculus
tgcttctgctcccctccccattcac

SEQ ID NO: 979444 - DNA, 25 bp, Mus musculus
tgcttctgctccgctccccattcac

SEQ ID NO: 979445 - DNA, 25 bp, Mus musculus
tgcttctggaccaagtacatgaacc

SEQ ID NO: 979446 - DNA, 25 bp, Mus musculus
tgcttctggacctagtacatgaacc

SEQ ID NO: 979447 - DNA, 25 bp, Mus musculus
tgcttctgtccacgaccagacgaca

SEQ ID NO: 979448 - DNA, 25 bp, Mus musculus
tgcttctgtccaggaccagacgaca

SEQ ID NO: 979449 - DNA, 25 bp, Mus musculus
tgcttctgttagctgctggagagtc

SEQ ID NO: 979450 - DNA, 25 bp, Mus musculus
tgcttctgttaggtgctggagagtc

SEQ ID NO: 979451 - DNA, 25 bp, Mus musculus
tgcttcttcagacctctgcagtcct

SEQ ID NO: 979452 - DNA, 25 bp, Mus musculus
tgcttcttcagagctctgcagtcct

SEQ ID NO: 979453 - DNA, 25 bp, Mus musculus
tgcttcttccaccaatttgaaagat

SEQ ID NO: 979454 - DNA, 25 bp, Mus musculus
tgcttcttccacgaatttgaaagat

SEQ ID NO: 979455 - DNA, 25 bp, Mus musculus
tgcttcttgttgcggatgtggctca

SEQ ID NO: 979456 - DNA, 25 bp, Mus musculus
tgcttcttgttggggatgtggctca

SEQ ID NO: 979457 - DNA, 25 bp, Mus musculus
tgcttgaacagctccacatgcgtcg

SEQ ID NO: 979458 - DNA, 25 bp, Mus musculus
tgcttgaacagctcgacatgcgtcg

SEQ ID NO: 979459 - DNA, 25 bp, Mus musculus
tgcttgagtccacgttcacattgag

SEQ ID NO: 979460 - DNA, 25 bp, Mus musculus
tgcttgagtccaggttcacattgag

SEQ ID NO: 979461 - DNA, 25 bp, Mus musculus
tgcttgcaaacacgatgtctctcca

SEQ ID NO: 979462 - DNA, 25 bp, Mus musculus
tgcttgcaaacaggatgtctctcca

SEQ ID NO: 979463 - DNA, 25 bp, Mus musculus
tgcttgccagcttttgctggacaga

SEQ ID NO: 979464 - DNA, 25 bp, Mus musculus
tgcttgccaggttttgctggacaga

SEQ ID NO: 979465 - DNA, 25 bp, Mus musculus
tgcttgctgaacccccacagaacct

SEQ ID NO: 979466 - DNA, 25 bp, Mus musculus
tgcttgctgaacgcccacagaacct

SEQ ID NO: 979467 - DNA, 25 bp, Mus musculus
tgcttgctgggtctctactttgtct

SEQ ID NO: 979468 - DNA, 25 bp, Mus musculus
tgcttgctgggtctgtactttgtct

SEQ ID NO: 979469 - DNA, 25 bp, Mus musculus
tgcttggaacctcattgccaacgtg

SEQ ID NO: 979470 - DNA, 25 bp, Mus musculus
tgcttggaacctgattgccaacgtg

SEQ ID NO: 979471 - DNA, 25 bp, Mus musculus
tgcttggcggcgcctgtgagagaga

SEQ ID NO: 979472 - DNA, 25 bp, Mus musculus
tgcttggcggggcctgtgagagaga

SEQ ID NO: 979473 - DNA, 25 bp, Mus musculus
tgcttggtgctgcgatcctgtttac

SEQ ID NO: 979474 - DNA, 25 bp, Mus musculus
tgcttggtgctgggatcctgtttac

SEQ ID NO: 979475 - DNA, 25 bp, Mus musculus
tgcttgtcaacacgaggagccatgg

SEQ ID NO: 979476 - DNA, 25 bp, Mus musculus
tgcttgtcaacacggtccaggtgca

SEQ ID NO: 979477 - DNA, 25 bp, Mus musculus
tgcttgtcaacaggaggagccatgg

SEQ ID NO: 979478 - DNA, 25 bp, Mus musculus
tgcttgtcaacagggtccaggtgca

SEQ ID NO: 979479 - DNA, 25 bp, Mus musculus
tgcttgtcatagaactgggcggcaa

SEQ ID NO: 979480 - DNA, 25 bp, Mus musculus
tgcttgtcatagtactgggcggcaa

SEQ ID NO: 979481 - DNA, 25 bp, Mus musculus
tgcttgtgagcatactctcctctta

SEQ ID NO: 979482 - DNA, 25 bp, Mus musculus
tgcttgtgaggatactctcctctta

SEQ ID NO: 979483 - DNA, 25 bp, Mus musculus
tgctttaattgacacattagcttta

SEQ ID NO: 979484 - DNA, 25 bp, Mus musculus
tgctttaattgacagattagcttta

SEQ ID NO: 979485 - DNA, 25 bp, Mus musculus
tgctttatcaaacatttcacaaagg

SEQ ID NO: 979486 - DNA, 25 bp, Mus musculus
tgctttatcaaagatttcacaaagg

SEQ ID NO: 979487 - DNA, 25 bp, Mus musculus
tgctttccagaggccgccagcaggt

SEQ ID NO: 979488 - DNA, 25 bp, Mus musculus
tgctttccagaggcggccagcaggt

SEQ ID NO: 979489 - DNA, 25 bp, Mus musculus
tgctttcccgcctagccactctctt

SEQ ID NO: 979490 - DNA, 25 bp, Mus musculus
tgctttcccggctagccactctctt

SEQ ID NO: 979491 - DNA, 25 bp, Mus musculus
tgctttccgcaacgccctttatggg

SEQ ID NO: 979492 - DNA, 25 bp, Mus musculus
tgctttccgcaaggccctttatggg

SEQ ID NO: 979493 - DNA, 25 bp, Mus musculus
tgctttctctggcaatgtgattttc

SEQ ID NO: 979494 - DNA, 25 bp, Mus musculus
tgctttctctgggaatgtgattttc

SEQ ID NO: 979495 - DNA, 25 bp, Mus musculus
tgctttctggtacacgaccctgacg

SEQ ID NO: 979496 - DNA, 25 bp, Mus musculus
tgctttctggtacaggaccctgacg

SEQ ID NO: 979497 - DNA, 25 bp, Mus musculus
tgctttgatgacccgcatggttcga

SEQ ID NO: 979498 - DNA, 25 bp, Mus musculus
tgctttgatgtcccgcatggttcga

SEQ ID NO: 979499 - DNA, 25 bp, Mus musculus
tgctttgccaagcctgaactcacgg

SEQ ID NO: 979500 - DNA, 25 bp, Mus musculus
tgctttgccaaggctgaactcacgg

SEQ ID NO: 979501 - DNA, 25 bp, Mus musculus
tgctttggaggttcagggacagcaa

SEQ ID NO: 979502 - DNA, 25 bp, Mus musculus
tgctttggaggttctgggacagcaa

SEQ ID NO: 979503 - DNA, 25 bp, Mus musculus
tgctttgtgacgaactctacagtag

SEQ ID NO: 979504 - DNA, 25 bp, Mus musculus
tgctttgtgacgtactctacagtag

SEQ ID NO: 979505 - DNA, 25 bp, Mus musculus
tgctttgtttttagcctgcagccgg

SEQ ID NO: 979506 - DNA, 25 bp, Mus musculus
tgctttgtttttaggctgcagccgg

SEQ ID NO: 979507 - DNA, 25 bp, Mus musculus
tgcttttacattagtcataatcctt

SEQ ID NO: 979508 - DNA, 25 bp, Mus musculus
tgcttttacatttgtcataatcctt

SEQ ID NO: 979509 - DNA, 25 bp, Mus musculus
tgcttttgtggacacgttggtttaa

SEQ ID NO: 979510 - DNA, 25 bp, Mus musculus
tgcttttgtggacactatttttgaa

SEQ ID NO: 979511 - DNA, 25 bp, Mus musculus
tgcttttgtggacaggttggtttaa

SEQ ID NO: 979512 - DNA, 25 bp, Mus musculus
tgcttttgtggacagtatttttgaa

SEQ ID NO: 979513 - DNA, 25 bp, Mus musculus
tgctttttagaggtgatcatgtgtg

SEQ ID NO: 979514 - DNA, 25 bp, Mus musculus
tgctttttagtggtgatcatgtgtg

SEQ ID NO: 979515 - DNA, 25 bp, Mus musculus
tgctttttcttcctcgtctactcac

SEQ ID NO: 979516 - DNA, 25 bp, Mus musculus
tgctttttcttcctggtctactcac

SEQ ID NO: 979517 - DNA, 25 bp, Mus musculus
tggaaaaactgcaacatgatgatca

SEQ ID NO: 979518 - DNA, 25 bp, Mus musculus
tggaaaaactgcaagatgatgatca

SEQ ID NO: 979519 - DNA, 25 bp, Mus musculus
tggaaaaatgctggccaatatgttc

SEQ ID NO: 979520 - DNA, 25 bp, Mus musculus
tggaaaaatggtggccaatatgttc

SEQ ID NO: 979521 - DNA, 25 bp, Mus musculus
tggaaaacagccccacagaacatga

SEQ ID NO: 979522 - DNA, 25 bp, Mus musculus
tggaaaacagcctgagaatgacagt

SEQ ID NO: 979523 - DNA, 25 bp, Mus musculus
tggaaaacaggcccacagaacatga

SEQ ID NO: 979524 - DNA, 25 bp, Mus musculus
tggaaaacaggctgagaatgacagt

SEQ ID NO: 979525 - DNA, 25 bp, Mus musculus
tggaaaagaacccacgagctcacct

SEQ ID NO: 979526 - DNA, 25 bp, Mus musculus
tggaaaagaaccctggctctccagg

SEQ ID NO: 979527 - DNA, 25 bp, Mus musculus
tggaaaagaaccgacgagctcacct

SEQ ID NO: 979528 - DNA, 25 bp, Mus musculus
tggaaaagaaccgtggctctccagg

SEQ ID NO: 979529 - DNA, 25 bp, Mus musculus
tggaaaagatctaacaagagtctat

SEQ ID NO: 979530 - DNA, 25 bp, Mus musculus
tggaaaagatgtaacaagagtctat

SEQ ID NO: 979531 - DNA, 25 bp, Mus musculus
tggaaaagcataacttttccagttg

SEQ ID NO: 979532 - DNA, 25 bp, Mus musculus
tggaaaagcatatcttttccagttg

SEQ ID NO: 979533 - DNA, 25 bp, Mus musculus
tggaaaagcgagcaggcggctcagt

SEQ ID NO: 979534 - DNA, 25 bp, Mus musculus
tggaaaagcgagcccttggaacagc

SEQ ID NO: 979535 - DNA, 25 bp, Mus musculus
tggaaaagcgagctgggagaacagc

SEQ ID NO: 979536 - DNA, 25 bp, Mus musculus
tggaaaagcgaggaggcggctcagt

SEQ ID NO: 979537 - DNA, 25 bp, Mus musculus
tggaaaagcgaggccttggaacagc

SEQ ID NO: 979538 - DNA, 25 bp, Mus musculus
tggaaaagcgaggtgggagaacagc

SEQ ID NO: 979539 - DNA, 25 bp, Mus musculus
tggaaaaggacacaatcatagagat

SEQ ID NO: 979540 - DNA, 25 bp, Mus musculus
tggaaaaggacagaatcatagagat

SEQ ID NO: 979541 - DNA, 25 bp, Mus musculus
tggaaaatacagagcatacgatgcg

SEQ ID NO: 979542 - DNA, 25 bp, Mus musculus
tggaaaatacagatctgtgtcagca

SEQ ID NO: 979543 - DNA, 25 bp, Mus musculus
tggaaaatacagtgcatacgatgcg

SEQ ID NO: 979544 - DNA, 25 bp, Mus musculus
tggaaaatacagttctgtgtcagca

SEQ ID NO: 979545 - DNA, 25 bp, Mus musculus
tggaaaatatcacgaaggagatgaa

SEQ ID NO: 979546 - DNA, 25 bp, Mus musculus
tggaaaatatcaggaaggagatgaa

SEQ ID NO: 979547 - DNA, 25 bp, Mus musculus
tggaaacaatggccactttatcgcc

SEQ ID NO: 979548 - DNA, 25 bp, Mus musculus
tggaaacaatgggcactttatcgcc

SEQ ID NO: 979549 - DNA, 25 bp, Mus musculus
tggaaacacaatcacatgtcgtttg

SEQ ID NO: 979550 - DNA, 25 bp, Mus musculus
tggaaacacaatcacccgcataact

SEQ ID NO: 979551 - DNA, 25 bp, Mus musculus
tggaaacacaatcacccgtcattca

SEQ ID NO: 979552 - DNA, 25 bp, Mus musculus
tggaaacacaatcactcgaaggggg

SEQ ID NO: 979553 - DNA, 25 bp, Mus musculus
tggaaacacaatcagatgtcgtttg

SEQ ID NO: 979554 - DNA, 25 bp, Mus musculus
tggaaacacaatcagccgcataact

SEQ ID NO: 979555 - DNA, 25 bp, Mus musculus
tggaaacacaatcagccgtcattca

SEQ ID NO: 979556 - DNA, 25 bp, Mus musculus
tggaaacacaatcagtcgaaggggg

SEQ ID NO: 979557 - DNA, 25 bp, Mus musculus
tggaaaccagagatgggcaagtcct

SEQ ID NO: 979558 - DNA, 25 bp, Mus musculus
tggaaaccagagttgggcaagtcct

SEQ ID NO: 979559 - DNA, 25 bp, Mus musculus
tggaaaccagcaagtgagtgccttt

SEQ ID NO: 979560 - DNA, 25 bp, Mus musculus
tggaaaccagcagaacagtacggac

SEQ ID NO: 979561 - DNA, 25 bp, Mus musculus
tggaaaccaggaagtgagtgccttt

SEQ ID NO: 979562 - DNA, 25 bp, Mus musculus
tggaaaccaggagaacagtacggac

SEQ ID NO: 979563 - DNA, 25 bp, Mus musculus
tggaaaccatggcacaacaaaaatc

SEQ ID NO: 979564 - DNA, 25 bp, Mus musculus
tggaaaccatggcacgtacagagct

SEQ ID NO: 979565 - DNA, 25 bp, Mus musculus
tggaaaccatggcagaacaaaaatc

SEQ ID NO: 979566 - DNA, 25 bp, Mus musculus
tggaaaccatggcaggtacagagct

SEQ ID NO: 979567 - DNA, 25 bp, Mus musculus
tggaaacctccacacggcacagaat

SEQ ID NO: 979568 - DNA, 25 bp, Mus musculus
tggaaacctccacagggcacagaat

SEQ ID NO: 979569 - DNA, 25 bp, Mus musculus
tggaaactctccccccatcttcatc

SEQ ID NO: 979570 - DNA, 25 bp, Mus musculus
tggaaactctccgcccatcttcatc

SEQ ID NO: 979571 - DNA, 25 bp, Mus musculus
tggaaactgagcacattaatccagt

SEQ ID NO: 979572 - DNA, 25 bp, Mus musculus
tggaaactgagcaccaaacaacatg

SEQ ID NO: 979573 - DNA, 25 bp, Mus musculus
tggaaactgagcaccaagcttacaa

SEQ ID NO: 979574 - DNA, 25 bp, Mus musculus
tggaaactgagcagcagaataaaga

SEQ ID NO: 979575 - DNA, 25 bp, Mus musculus
tggaaactgagcattttgctctgta

SEQ ID NO: 979576 - DNA, 25 bp, Mus musculus
tggaaactgagctcattaatccagt

SEQ ID NO: 979577 - DNA, 25 bp, Mus musculus
tggaaactgagctccaaacaacatg

SEQ ID NO: 979578 - DNA, 25 bp, Mus musculus
tggaaactgagctccaagcttacaa

SEQ ID NO: 979579 - DNA, 25 bp, Mus musculus
tggaaactgagctgcagaataaaga

SEQ ID NO: 979580 - DNA, 25 bp, Mus musculus
tggaaactgagctttttgctctgta

SEQ ID NO: 979581 - DNA, 25 bp, Mus musculus
tggaaacttggaccaggcaccgctc

SEQ ID NO: 979582 - DNA, 25 bp, Mus musculus
tggaaacttggagcaggcaccgctc

SEQ ID NO: 979583 - DNA, 25 bp, Mus musculus
tggaaagacgaacgtcttcctgaag

SEQ ID NO: 979584 - DNA, 25 bp, Mus musculus
tggaaagacgaaggtcttcctgaag

SEQ ID NO: 979585 - DNA, 25 bp, Mus musculus
tggaaagcaaccagaacacagaact

SEQ ID NO: 979586 - DNA, 25 bp, Mus musculus
tggaaagcaagcagaacacagaact

SEQ ID NO: 979587 - DNA, 25 bp, Mus musculus
tggaaagcagctcacctgtctccat

SEQ ID NO: 979588 - DNA, 25 bp, Mus musculus
tggaaagcaggtcacctgtctccat

SEQ ID NO: 979589 - DNA, 25 bp, Mus musculus
tggaaaggaactgtacccagctgaa

SEQ ID NO: 979590 - DNA, 25 bp, Mus musculus
tggaaaggaagtgtacccagctgaa

SEQ ID NO: 979591 - DNA, 25 bp, Mus musculus
tggaaagtcggacacaggcttccgc

SEQ ID NO: 979592 - DNA, 25 bp, Mus musculus
tggaaagtcggacacgcttccgcca

SEQ ID NO: 979593 - DNA, 25 bp, Mus musculus
tggaaagtcggacagaggcttccgc

SEQ ID NO: 979594 - DNA, 25 bp, Mus musculus
tggaaagtcggacaggcttccgcca

SEQ ID NO: 979595 - DNA, 25 bp, Mus musculus
tggaaatcagaggtgatgagttcct

SEQ ID NO: 979596 - DNA, 25 bp, Mus musculus
tggaaatcagtggtgatgagttcct

SEQ ID NO: 979597 - DNA, 25 bp, Mus musculus
tggaaatcctgtcgtgggagcatgc

SEQ ID NO: 979598 - DNA, 25 bp, Mus musculus
tggaaatcctgtggtgggagcatgc

SEQ ID NO: 979599 - DNA, 25 bp, Mus musculus
tggaaatgacagcagatattgatga

SEQ ID NO: 979600 - DNA, 25 bp, Mus musculus
tggaaatgacaggagatattgatga

SEQ ID NO: 979601 - DNA, 25 bp, Mus musculus
tggaaatgagaccgaagctgccact

SEQ ID NO: 979602 - DNA, 25 bp, Mus musculus
tggaaatgagacctgctggagatca

SEQ ID NO: 979603 - DNA, 25 bp, Mus musculus
tggaaatgagacggaagctgccact

SEQ ID NO: 979604 - DNA, 25 bp, Mus musculus
tggaaatgagacgtgctggagatca

SEQ ID NO: 979605 - DNA, 25 bp, Mus musculus
tggaaattaaagcatgaaggtcttc

SEQ ID NO: 979606 - DNA, 25 bp, Mus musculus
tggaaattaaaggatgaaggtcttc

SEQ ID NO: 979607 - DNA, 25 bp, Mus musculus
tggaaattgctgatggtgacaaagt

SEQ ID NO: 979608 - DNA, 25 bp, Mus musculus
tggaaattgctgttggtgacaaagt

SEQ ID NO: 979609 - DNA, 25 bp, Mus musculus
tggaaatttcagcatcattgggact

SEQ ID NO: 979610 - DNA, 25 bp, Mus musculus
tggaaatttcaggatcattgggact

SEQ ID NO: 979611 - DNA, 25 bp, Mus musculus
tggaacaaaactggctgtgctgcta

SEQ ID NO: 979612 - DNA, 25 bp, Mus musculus
tggaacaaaagtggctgtgctgcta

SEQ ID NO: 979613 - DNA, 25 bp, Mus musculus
tggaacaaactcaacatgggaagtc

SEQ ID NO: 979614 - DNA, 25 bp, Mus musculus
tggaacaaactcaagatgggaagtc

SEQ ID NO: 979615 - DNA, 25 bp, Mus musculus
tggaacaaagcatgtaatggagctg

SEQ ID NO: 979616 - DNA, 25 bp, Mus musculus
tggaacaaaggatgtaatggagctg

SEQ ID NO: 979617 - DNA, 25 bp, Mus musculus
tggaacaacccgcaatactggagta

SEQ ID NO: 979618 - DNA, 25 bp, Mus musculus
tggaacaacccggaatactggagta

SEQ ID NO: 979619 - DNA, 25 bp, Mus musculus
tggaacaatggaaaaatacctgaat

SEQ ID NO: 979620 - DNA, 25 bp, Mus musculus
tggaacaatggaaatatacctgaat

SEQ ID NO: 979621 - DNA, 25 bp, Mus musculus
tggaacactgatcacatgctgtttc

SEQ ID NO: 979622 - DNA, 25 bp, Mus musculus
tggaacactgatgacatgctgtttc

SEQ ID NO: 979623 - DNA, 25 bp, Mus musculus
tggaacagatggcttgcaaacatgt

SEQ ID NO: 979624 - DNA, 25 bp, Mus musculus
tggaacagatgggttgcaaacatgt

SEQ ID NO: 979625 - DNA, 25 bp, Mus musculus
tggaacaggcgtcacaaagaaaaat

SEQ ID NO: 979626 - DNA, 25 bp, Mus musculus
tggaacaggcgtcagaaagaaaaat

SEQ ID NO: 979627 - DNA, 25 bp, Mus musculus
tggaacatgaagcccgtgtgcccaa

SEQ ID NO: 979628 - DNA, 25 bp, Mus musculus
tggaacatgaaggccgtgtgcccaa

SEQ ID NO: 979629 - DNA, 25 bp, Mus musculus
tggaacatggctaatgcaccccctc

SEQ ID NO: 979630 - DNA, 25 bp, Mus musculus
tggaacatgggtaatgcaccccctc

SEQ ID NO: 979631 - DNA, 25 bp, Mus musculus
tggaacattattccttcacctctgc

SEQ ID NO: 979632 - DNA, 25 bp, Mus musculus
tggaacattattgcttcacctctgc

SEQ ID NO: 979633 - DNA, 25 bp, Mus musculus
tggaaccatcagcctgctgattttc

SEQ ID NO: 979634 - DNA, 25 bp, Mus musculus
tggaaccatcaggctgctgattttc

SEQ ID NO: 979635 - DNA, 25 bp, Mus musculus
tggaaccatgaaagcccacctgccg

SEQ ID NO: 979636 - DNA, 25 bp, Mus musculus
tggaaccatgaatgcccacctgccg

SEQ ID NO: 979637 - DNA, 25 bp, Mus musculus
tggaacccaacaccatcttgggtca

SEQ ID NO: 979638 - DNA, 25 bp, Mus musculus
tggaacccaacagcatcttgggtca

SEQ ID NO: 979639 - DNA, 25 bp, Mus musculus
tggaacccagagatgtctccgagtc

SEQ ID NO: 979640 - DNA, 25 bp, Mus musculus
tggaacccagtgatgtctccgagtc

SEQ ID NO: 979641 - DNA, 25 bp, Mus musculus
tggaacccatgagactgctttttta

SEQ ID NO: 979642 - DNA, 25 bp, Mus musculus
tggaacccatgagagtgctttttta

SEQ ID NO: 979643 - DNA, 25 bp, Mus musculus
tggaaccccagacggagagttcgtg

SEQ ID NO: 979644 - DNA, 25 bp, Mus musculus
tggaaccccagagggagagttcgtg

SEQ ID NO: 979645 - DNA, 25 bp, Mus musculus
tggaaccctgaaaaagctggagtcc

SEQ ID NO: 979646 - DNA, 25 bp, Mus musculus
tggaaccctgtaaaagctggagtcc

SEQ ID NO: 979647 - DNA, 25 bp, Mus musculus
tggaacgttacaacagattgttcta

SEQ ID NO: 979648 - DNA, 25 bp, Mus musculus
tggaacgttacatcagattgttcta

SEQ ID NO: 979649 - DNA, 25 bp, Mus musculus
tggaactatggtcactttgaccatg

SEQ ID NO: 979650 - DNA, 25 bp, Mus musculus
tggaactatggtcagtttgaccatg

SEQ ID NO: 979651 - DNA, 25 bp, Mus musculus
tggaactgctagaacgtggctcgct

SEQ ID NO: 979652 - DNA, 25 bp, Mus musculus
tggaactgctagaaggtggctcgct

SEQ ID NO: 979653 - DNA, 25 bp, Mus musculus
tggaactggaagctgattatcgaga

SEQ ID NO: 979654 - DNA, 25 bp, Mus musculus
tggaactggaaggtgattatcgaga

SEQ ID NO: 979655 - DNA, 25 bp, Mus musculus
tggaactgtccatccgagcagcagc

SEQ ID NO: 979656 - DNA, 25 bp, Mus musculus
tggaactgtccatcggagcagcagc

SEQ ID NO: 979657 - DNA, 25 bp, Mus musculus
tggaactgtcttaatccgtctacct

SEQ ID NO: 979658 - DNA, 25 bp, Mus musculus
tggaactgtctttatccgtctacct

SEQ ID NO: 979659 - DNA, 25 bp, Mus musculus
tggaacttcctcctcccatctctcc

SEQ ID NO: 979660 - DNA, 25 bp, Mus musculus
tggaacttcctcgtcccatctctcc

SEQ ID NO: 979661 - DNA, 25 bp, Mus musculus
tggaacttggtgtgcagctgagccc

SEQ ID NO: 979662 - DNA, 25 bp, Mus musculus
tggaacttggtgtggagctgagccc

SEQ ID NO: 979663 - DNA, 25 bp, Mus musculus
tggaagaaagccttggggcatatct

SEQ ID NO: 979664 - DNA, 25 bp, Mus musculus
tggaagaaaggcttggggcatatct

SEQ ID NO: 979665 - DNA, 25 bp, Mus musculus
tggaagaacacgagaagctgcagaa

SEQ ID NO: 979666 - DNA, 25 bp, Mus musculus
tggaagaacaggagaagctgcagaa

SEQ ID NO: 979667 - DNA, 25 bp, Mus musculus
tggaagaagctgagcaacttatgac

SEQ ID NO: 979668 - DNA, 25 bp, Mus musculus
tggaagaagctgtgcaacttatgac

SEQ ID NO: 979669 - DNA, 25 bp, Mus musculus
tggaagaatttcagatgcccgtgtg

SEQ ID NO: 979670 - DNA, 25 bp, Mus musculus
tggaagaatttcagtgtctctgaag

SEQ ID NO: 979671 - DNA, 25 bp, Mus musculus
tggaagaatttctgatgcccgtgtg

SEQ ID NO: 979672 - DNA, 25 bp, Mus musculus
tggaagaatttctgtgtctctgaag

SEQ ID NO: 979673 - DNA, 25 bp, Mus musculus
tggaagacaaagaacgacagtgggt

SEQ ID NO: 979674 - DNA, 25 bp, Mus musculus
tggaagacaatgaacgacagtgggt

SEQ ID NO: 979675 - DNA, 25 bp, Mus musculus
tggaagagaacgccctgatggcccc

SEQ ID NO: 979676 - DNA, 25 bp, Mus musculus
tggaagagaaggccctgatggcccc

SEQ ID NO: 979677 - DNA, 25 bp, Mus musculus
tggaagagaatccacatatttttgc

SEQ ID NO: 979678 - DNA, 25 bp, Mus musculus
tggaagagaatccagatatttttgc

SEQ ID NO: 979679 - DNA, 25 bp, Mus musculus
tggaagagccagcggagaagtgcag

SEQ ID NO: 979680 - DNA, 25 bp, Mus musculus
tggaagagccaggggagaagtgcag

SEQ ID NO: 979681 - DNA, 25 bp, Mus musculus
tggaagattcggcacatgtggggga

SEQ ID NO: 979682 - DNA, 25 bp, Mus musculus
tggaagattcggcagatgtggggga

SEQ ID NO: 979683 - DNA, 25 bp, Mus musculus
tggaagattctgccacttcaccaag

SEQ ID NO: 979684 - DNA, 25 bp, Mus musculus
tggaagattctggcacttcaccaag

SEQ ID NO: 979685 - DNA, 25 bp, Mus musculus
tggaagcaagagcttgcagaattca

SEQ ID NO: 979686 - DNA, 25 bp, Mus musculus
tggaagcaagaggttgcagaattca

SEQ ID NO: 979687 - DNA, 25 bp, Mus musculus
tggaagcaagagtgaaatcaaggtt

SEQ ID NO: 979688 - DNA, 25 bp, Mus musculus
tggaagcaagtgtgaaatcaaggtt

SEQ ID NO: 979689 - DNA, 25 bp, Mus musculus
tggaagcaccttcgtgaccagaatg

SEQ ID NO: 979690 - DNA, 25 bp, Mus musculus
tggaagcaccttggtgaccagaatg

SEQ ID NO: 979691 - DNA, 25 bp, Mus musculus
tggaagcattctacagtcctggaca

SEQ ID NO: 979692 - DNA, 25 bp, Mus musculus
tggaagcattctactgtcctggaca

SEQ ID NO: 979693 - DNA, 25 bp, Mus musculus
tggaagccagaaatcgggctggtgt

SEQ ID NO: 979694 - DNA, 25 bp, Mus musculus
tggaagccagaaatggggctggtgt

SEQ ID NO: 979695 - DNA, 25 bp, Mus musculus
tggaagccaggacattagagtgggc

SEQ ID NO: 979696 - DNA, 25 bp, Mus musculus
tggaagccaggactgggcctgaggc

SEQ ID NO: 979697 - DNA, 25 bp, Mus musculus
tggaagccaggagattagagtgggc

SEQ ID NO: 979698 - DNA, 25 bp, Mus musculus
tggaagccaggagtgggcctgaggc

SEQ ID NO: 979699 - DNA, 25 bp, Mus musculus
tggaagccctcgatgccaattctcg

SEQ ID NO: 979700 - DNA, 25 bp, Mus musculus
tggaagccctcgttgccaattctcg

SEQ ID NO: 979701 - DNA, 25 bp, Mus musculus
tggaagcccttagacatgcaacaag

SEQ ID NO: 979702 - DNA, 25 bp, Mus musculus
tggaagcccttagagatgcaacaag

SEQ ID NO: 979703 - DNA, 25 bp, Mus musculus
tggaagctgttgagtatcttggaga

SEQ ID NO: 979704 - DNA, 25 bp, Mus musculus
tggaagctgttgtgtatcttggaga

SEQ ID NO: 979705 - DNA, 25 bp, Mus musculus
tggaaggaagctcaatggagggcta

SEQ ID NO: 979706 - DNA, 25 bp, Mus musculus
tggaaggaaggtcaatggagggcta

SEQ ID NO: 979707 - DNA, 25 bp, Mus musculus
tggaaggacaagcttgttgacctcc

SEQ ID NO: 979708 - DNA, 25 bp, Mus musculus
tggaaggacaaggttgttgacctcc

SEQ ID NO: 979709 - DNA, 25 bp, Mus musculus
tggaaggaggaacagtgagctgggt

SEQ ID NO: 979710 - DNA, 25 bp, Mus musculus
tggaaggaggaagagtgagctgggt

SEQ ID NO: 979711 - DNA, 25 bp, Mus musculus
tggaaggagttagaaacaggtgaga

SEQ ID NO: 979712 - DNA, 25 bp, Mus musculus
tggaaggagttagatacaggtgaga

SEQ ID NO: 979713 - DNA, 25 bp, Mus musculus
tggaaggcaaccacttgaagaggcc

SEQ ID NO: 979714 - DNA, 25 bp, Mus musculus
tggaaggcaagcacttgaagaggcc

SEQ ID NO: 979715 - DNA, 25 bp, Mus musculus
tggaaggctctggacatggcaggtt

SEQ ID NO: 979716 - DNA, 25 bp, Mus musculus
tggaaggctctggagatggcaggtt

SEQ ID NO: 979717 - DNA, 25 bp, Mus musculus
tggaagggctcacccagagtaacag

SEQ ID NO: 979718 - DNA, 25 bp, Mus musculus
tggaagggctcagccagagtaacag

SEQ ID NO: 979719 - DNA, 25 bp, Mus musculus
tggaaggtccagagaaggcaagctg

SEQ ID NO: 979720 - DNA, 25 bp, Mus musculus
tggaaggtccagcacctcagacaag

SEQ ID NO: 979721 - DNA, 25 bp, Mus musculus
tggaaggtccagctatccttgaccc

SEQ ID NO: 979722 - DNA, 25 bp, Mus musculus
tggaaggtccaggacctcagacaag

SEQ ID NO: 979723 - DNA, 25 bp, Mus musculus
tggaaggtccaggtatccttgaccc

SEQ ID NO: 979724 - DNA, 25 bp, Mus musculus
tggaaggtccagtgaaggcaagctg

SEQ ID NO: 979725 - DNA, 25 bp, Mus musculus
tggaaggtcccgcagcatgcaaaac

SEQ ID NO: 979726 - DNA, 25 bp, Mus musculus
tggaaggtcccgcattgaaaagatg

SEQ ID NO: 979727 - DNA, 25 bp, Mus musculus
tggaaggtcccggagcatgcaaaac

SEQ ID NO: 979728 - DNA, 25 bp, Mus musculus
tggaaggtcccggattgaaaagatg

SEQ ID NO: 979729 - DNA, 25 bp, Mus musculus
tggaaggttcagcgagccccatgcc

SEQ ID NO: 979730 - DNA, 25 bp, Mus musculus
tggaaggttcagggagccccatgcc

SEQ ID NO: 979731 - DNA, 25 bp, Mus musculus
tggaaggttctccccctaaagagct

SEQ ID NO: 979732 - DNA, 25 bp, Mus musculus
tggaaggttctcgccctaaagagct

SEQ ID NO: 979733 - DNA, 25 bp, Mus musculus
tggaagtggaaatacgaaaaccagc

SEQ ID NO: 979734 - DNA, 25 bp, Mus musculus
tggaagtggaaataggaaaaccagc

SEQ ID NO: 979735 - DNA, 25 bp, Mus musculus
tggaagtggaggattttgcaagaat

SEQ ID NO: 979736 - DNA, 25 bp, Mus musculus
tggaagtggaggtttttgcaagaat

SEQ ID NO: 979737 - DNA, 25 bp, Mus musculus
tggaataaggagaacgtatacatca

SEQ ID NO: 979738 - DNA, 25 bp, Mus musculus
tggaataaggagaaggtatacatca

SEQ ID NO: 979739 - DNA, 25 bp, Mus musculus
tggaatatttcttgcgtggaatata

SEQ ID NO: 979740 - DNA, 25 bp, Mus musculus
tggaatatttcttgggtggaatata

SEQ ID NO: 979741 - DNA, 25 bp, Mus musculus
tggaatcactggcttatcattgtga

SEQ ID NO: 979742 - DNA, 25 bp, Mus musculus
tggaatcactgggttatcattgtga

SEQ ID NO: 979743 - DNA, 25 bp, Mus musculus
tggaatcccacaacaggagtacagc

SEQ ID NO: 979744 - DNA, 25 bp, Mus musculus
tggaatcccagaacaggagtacagc

SEQ ID NO: 979745 - DNA, 25 bp, Mus musculus
tggaatcctggatacgtgagaaaga

SEQ ID NO: 979746 - DNA, 25 bp, Mus musculus
tggaatcctggataggtgagaaaga

SEQ ID NO: 979747 - DNA, 25 bp, Mus musculus
tggaatcggaagccaggagagtatg

SEQ ID NO: 979748 - DNA, 25 bp, Mus musculus
tggaatcggaaggcaggagagtatg

SEQ ID NO: 979749 - DNA, 25 bp, Mus musculus
tggaatgaccagctttgtgggcatt

SEQ ID NO: 979750 - DNA, 25 bp, Mus musculus
tggaatgaccaggtttgtgggcatt

SEQ ID NO: 979751 - DNA, 25 bp, Mus musculus
tggaatgcagataacaattgaaatt

SEQ ID NO: 979752 - DNA, 25 bp, Mus musculus
tggaatgcagcttgaaggtcttcct

SEQ ID NO: 979753 - DNA, 25 bp, Mus musculus
tggaatgcaggttgaaggtcttcct

SEQ ID NO: 979754 - DNA, 25 bp, Mus musculus
tggaatgcagttaacaattgaaatt

SEQ ID NO: 979755 - DNA, 25 bp, Mus musculus
tggaattaaacacgcatgatgcaca

SEQ ID NO: 979756 - DNA, 25 bp, Mus musculus
tggaattaaacaggcatgatgcaca

SEQ ID NO: 979757 - DNA, 25 bp, Mus musculus
tggaattaccgatgcatctggtggc

SEQ ID NO: 979758 - DNA, 25 bp, Mus musculus
tggaattaccgatggatctggtggc

SEQ ID NO: 979759 - DNA, 25 bp, Mus musculus
tggaattataagtactattaatcct

SEQ ID NO: 979760 - DNA, 25 bp, Mus musculus
tggaattatatgtactattaatcct

SEQ ID NO: 979761 - DNA, 25 bp, Mus musculus
tggaattccagacattaaaactatt

SEQ ID NO: 979762 - DNA, 25 bp, Mus musculus
tggaattccagagattaaaactatt

SEQ ID NO: 979763 - DNA, 25 bp, Mus musculus
tggacaaagatgagtggataagtgg

SEQ ID NO: 979764 - DNA, 25 bp, Mus musculus
tggacaaagatgtgtggataagtgg

SEQ ID NO: 979765 - DNA, 25 bp, Mus musculus
tggacaaatcctcgtggctcctccc

SEQ ID NO: 979766 - DNA, 25 bp, Mus musculus
tggacaaatcctggtggctcctccc

SEQ ID NO: 979767 - DNA, 25 bp, Mus musculus
tggacaacatcacagactggtgcat

SEQ ID NO: 979768 - DNA, 25 bp, Mus musculus
tggacaacatcagagactggtgcat

SEQ ID NO: 979769 - DNA, 25 bp, Mus musculus
tggacaacccagccgctaagcgagt

SEQ ID NO: 979770 - DNA, 25 bp, Mus musculus
tggacaacccaggcgctaagcgagt

SEQ ID NO: 979771 - DNA, 25 bp, Mus musculus
tggacaagaaaattcagcccagagt

SEQ ID NO: 979772 - DNA, 25 bp, Mus musculus
tggacaagaaaattctgcccaggga

SEQ ID NO: 979773 - DNA, 25 bp, Mus musculus
tggacaagaaaattgagcccagagt

SEQ ID NO: 979774 - DNA, 25 bp, Mus musculus
tggacaagaaaattgtgcccaggga

SEQ ID NO: 979775 - DNA, 25 bp, Mus musculus
tggacaagcaagccacatgctctcc

SEQ ID NO: 979776 - DNA, 25 bp, Mus musculus
tggacaagcaaggcacatgctctcc

SEQ ID NO: 979777 - DNA, 25 bp, Mus musculus
tggacaaggaagactttctctgtgt

SEQ ID NO: 979778 - DNA, 25 bp, Mus musculus
tggacaaggaagcttctgagcctgg

SEQ ID NO: 979779 - DNA, 25 bp, Mus musculus
tggacaaggaaggttctgagcctgg

SEQ ID NO: 979780 - DNA, 25 bp, Mus musculus
tggacaaggaagtctttctctgtgt

SEQ ID NO: 979781 - DNA, 25 bp, Mus musculus
tggacaaggaggaccgtgtgccgat

SEQ ID NO: 979782 - DNA, 25 bp, Mus musculus
tggacaaggaggacggtgtgccgat

SEQ ID NO: 979783 - DNA, 25 bp, Mus musculus
tggacaatcatgcctgtcatggtat

SEQ ID NO: 979784 - DNA, 25 bp, Mus musculus
tggacaatcatggctgtcatggtat

SEQ ID NO: 979785 - DNA, 25 bp, Mus musculus
tggacaatgcagcacatttctgcca

SEQ ID NO: 979786 - DNA, 25 bp, Mus musculus
tggacaatgcagcagatttctgcca

SEQ ID NO: 979787 - DNA, 25 bp, Mus musculus
tggacaattacgctgcccgagggcc

SEQ ID NO: 979788 - DNA, 25 bp, Mus musculus
tggacaattacggtgcccgagggcc

SEQ ID NO: 979789 - DNA, 25 bp, Mus musculus
tggacacagcaacagatttagttcc

SEQ ID NO: 979790 - DNA, 25 bp, Mus musculus
tggacacagcaagagatttagttcc

SEQ ID NO: 979791 - DNA, 25 bp, Mus musculus
tggacacaggaacgcattggctgac

SEQ ID NO: 979792 - DNA, 25 bp, Mus musculus
tggacacaggaaggcattggctgac

SEQ ID NO: 979793 - DNA, 25 bp, Mus musculus
tggacaccacagagctccttggtag

SEQ ID NO: 979794 - DNA, 25 bp, Mus musculus
tggacaccacagcaaagaatgtttc

SEQ ID NO: 979795 - DNA, 25 bp, Mus musculus
tggacaccacaggaaagaatgtttc

SEQ ID NO: 979796 - DNA, 25 bp, Mus musculus
tggacaccacagtgctccttggtag

SEQ ID NO: 979797 - DNA, 25 bp, Mus musculus
tggacacctatgaacttgcgatgta

SEQ ID NO: 979798 - DNA, 25 bp, Mus musculus
tggacacctatgatttcaaagatac

SEQ ID NO: 979799 - DNA, 25 bp, Mus musculus
tggacacctatgtacttgcgatgta

SEQ ID NO: 979800 - DNA, 25 bp, Mus musculus
tggacacctatgttttcaaagatac

SEQ ID NO: 979801 - DNA, 25 bp, Mus musculus
tggacacgatcgctcagatgtcctg

SEQ ID NO: 979802 - DNA, 25 bp, Mus musculus
tggacacgatcggtcagatgtcctg

SEQ ID NO: 979803 - DNA, 25 bp, Mus musculus
tggacacgtacctcaggccaagtgc

SEQ ID NO: 979804 - DNA, 25 bp, Mus musculus
tggacacgtacctctggccaagtgc

SEQ ID NO: 979805 - DNA, 25 bp, Mus musculus
tggacactccaacgcatgtagaagt

SEQ ID NO: 979806 - DNA, 25 bp, Mus musculus
tggacactccaaggcatgtagaagt

SEQ ID NO: 979807 - DNA, 25 bp, Mus musculus
tggacagagctgatacagaacattg

SEQ ID NO: 979808 - DNA, 25 bp, Mus musculus
tggacagagctgttacagaacattg

SEQ ID NO: 979809 - DNA, 25 bp, Mus musculus
tggacagattgcagtttttgatgcc

SEQ ID NO: 979810 - DNA, 25 bp, Mus musculus
tggacagattgctgtttttgatgcc

SEQ ID NO: 979811 - DNA, 25 bp, Mus musculus
tggacagcagcacgttcttcgtcct

SEQ ID NO: 979812 - DNA, 25 bp, Mus musculus
tggacagcagcaggttcttcgtcct

SEQ ID NO: 979813 - DNA, 25 bp, Mus musculus
tggacagcagcccccagttcttggt

SEQ ID NO: 979814 - DNA, 25 bp, Mus musculus
tggacagcaggccccagttcttggt

SEQ ID NO: 979815 - DNA, 25 bp, Mus musculus
tggacagcatctcaatggaattaat

SEQ ID NO: 979816 - DNA, 25 bp, Mus musculus
tggacagcatgtcaatggaattaat

SEQ ID NO: 979817 - DNA, 25 bp, Mus musculus
tggacagcttcgtgtggaatttttt

SEQ ID NO: 979818 - DNA, 25 bp, Mus musculus
tggacagcttggtgtggaatttttt

SEQ ID NO: 979819 - DNA, 25 bp, Mus musculus
tggacagtgccacctgaggatggtt

SEQ ID NO: 979820 - DNA, 25 bp, Mus musculus
tggacagtgccagctgaggatggtt

SEQ ID NO: 979821 - DNA, 25 bp, Mus musculus
tggacagtgctcagagaacagtacg

SEQ ID NO: 979822 - DNA, 25 bp, Mus musculus
tggacagtgctctgagaacagtacg

SEQ ID NO: 979823 - DNA, 25 bp, Mus musculus
tggacagtgttcaacggtctcttgt

SEQ ID NO: 979824 - DNA, 25 bp, Mus musculus
tggacagtgttcaagggtctcttgt

SEQ ID NO: 979825 - DNA, 25 bp, Mus musculus
tggacatccgtgcctccattgtcta

SEQ ID NO: 979826 - DNA, 25 bp, Mus musculus
tggacatccgtggctccattgtcta

SEQ ID NO: 979827 - DNA, 25 bp, Mus musculus
tggacatcgtagcagtgccaggagg

SEQ ID NO: 979828 - DNA, 25 bp, Mus musculus
tggacatcgtaggagtgccaggagg

SEQ ID NO: 979829 - DNA, 25 bp, Mus musculus
tggacatctactctttccccaagga

SEQ ID NO: 979830 - DNA, 25 bp, Mus musculus
tggacatctactgtttccccaagga

SEQ ID NO: 979831 - DNA, 25 bp, Mus musculus
tggacatcttcagacacaataaaat

SEQ ID NO: 979832 - DNA, 25 bp, Mus musculus
tggacatcttcagagacaataaaat

SEQ ID NO: 979833 - DNA, 25 bp, Mus musculus
tggacatgaaagaggccgaggtcct

SEQ ID NO: 979834 - DNA, 25 bp, Mus musculus
tggacatgaaagtggccgaggtcct

SEQ ID NO: 979835 - DNA, 25 bp, Mus musculus
tggacatggcaacgctgtggactgg

SEQ ID NO: 979836 - DNA, 25 bp, Mus musculus
tggacatggcaaggctgtggactgg

SEQ ID NO: 979837 - DNA, 25 bp, Mus musculus
tggacatggctattcacccagattc

SEQ ID NO: 979838 - DNA, 25 bp, Mus musculus
tggacatggctattgacccagattc

SEQ ID NO: 979839 - DNA, 25 bp, Mus musculus
tggaccaaaacaaaccacgcgaggc

SEQ ID NO: 979840 - DNA, 25 bp, Mus musculus
tggaccaaaacaaagcacgcgaggc

SEQ ID NO: 979841 - DNA, 25 bp, Mus musculus
tggaccaagaggaccgtgtgccgat

SEQ ID NO: 979842 - DNA, 25 bp, Mus musculus
tggaccaagaggacggtgtgccgat

SEQ ID NO: 979843 - DNA, 25 bp, Mus musculus
tggaccacaccaccattcggagggg

SEQ ID NO: 979844 - DNA, 25 bp, Mus musculus
tggaccacaccacttcctctaattc

SEQ ID NO: 979845 - DNA, 25 bp, Mus musculus
tggaccacaccagcattcggagggg

SEQ ID NO: 979846 - DNA, 25 bp, Mus musculus
tggaccacaccagttcctctaattc

SEQ ID NO: 979847 - DNA, 25 bp, Mus musculus
tggaccacgagtctctcgggaatgc

SEQ ID NO: 979848 - DNA, 25 bp, Mus musculus
tggaccacgagtgtctcgggaatgc

SEQ ID NO: 979849 - DNA, 25 bp, Mus musculus
tggaccagaaccaggatggctgcat

SEQ ID NO: 979850 - DNA, 25 bp, Mus musculus
tggaccagaacctggatggctgcat

SEQ ID NO: 979851 - DNA, 25 bp, Mus musculus
tggaccagagaacaagccacaggaa

SEQ ID NO: 979852 - DNA, 25 bp, Mus musculus
tggaccagagaaccagaagccacag

SEQ ID NO: 979853 - DNA, 25 bp, Mus musculus
tggaccagagaagaagccacaggaa

SEQ ID NO: 979854 - DNA, 25 bp, Mus musculus
tggaccagagaagcagaagccacag

SEQ ID NO: 979855 - DNA, 25 bp, Mus musculus
tggaccagctgccggcctgtcaagc

SEQ ID NO: 979856 - DNA, 25 bp, Mus musculus
tggaccagctgcgggcctgtcaagc

SEQ ID NO: 979857 - DNA, 25 bp, Mus musculus
tggaccaggcagaacctgggaagtc

SEQ ID NO: 979858 - DNA, 25 bp, Mus musculus
tggaccaggcagaagctgggaagtc

SEQ ID NO: 979859 - DNA, 25 bp, Mus musculus
tggaccatcgcacgggcggaacaca

SEQ ID NO: 979860 - DNA, 25 bp, Mus musculus
tggaccatcgcaggggcggaacaca

SEQ ID NO: 979861 - DNA, 25 bp, Mus musculus
tggaccatgtgcagcctgagctgct

SEQ ID NO: 979862 - DNA, 25 bp, Mus musculus
tggaccatgtgcaggctgagctgct

SEQ ID NO: 979863 - DNA, 25 bp, Mus musculus
tggacccacgaggacgacgagcagt

SEQ ID NO: 979864 - DNA, 25 bp, Mus musculus
tggacccacgaggaggacgagcagt

SEQ ID NO: 979865 - DNA, 25 bp, Mus musculus
tggaccccaaagcccatgaagaaga

SEQ ID NO: 979866 - DNA, 25 bp, Mus musculus
tggaccccaaaggccatgaagaaga

SEQ ID NO: 979867 - DNA, 25 bp, Mus musculus
tggaccccagatccaccatgggctt

SEQ ID NO: 979868 - DNA, 25 bp, Mus musculus
tggaccccagatgcaccatgggctt

SEQ ID NO: 979869 - DNA, 25 bp, Mus musculus
tggaccccccagaccaggtggtgtt

SEQ ID NO: 979870 - DNA, 25 bp, Mus musculus
tggaccccccagtccaggtggtgtt

SEQ ID NO: 979871 - DNA, 25 bp, Mus musculus
tggacccctgaacgacatagcattg

SEQ ID NO: 979872 - DNA, 25 bp, Mus musculus
tggacccctgaacgttacagtctct

SEQ ID NO: 979873 - DNA, 25 bp, Mus musculus
tggacccctgaaggacatagcattg

SEQ ID NO: 979874 - DNA, 25 bp, Mus musculus
tggacccctgaaggttacagtctct

SEQ ID NO: 979875 - DNA, 25 bp, Mus musculus
tggaccctaatacacgtctagccct

SEQ ID NO: 979876 - DNA, 25 bp, Mus musculus
tggaccctaatacaggtctagccct

SEQ ID NO: 979877 - DNA, 25 bp, Mus musculus
tggacctagcagccttacagttcct

SEQ ID NO: 979878 - DNA, 25 bp, Mus musculus
tggacctagcaggcttacagttcct

SEQ ID NO: 979879 - DNA, 25 bp, Mus musculus
tggacctagccccgaaggagctgaa

SEQ ID NO: 979880 - DNA, 25 bp, Mus musculus
tggacctagcccggaaggagctgaa

SEQ ID NO: 979881 - DNA, 25 bp, Mus musculus
tggacctcccacagtttactgactg

SEQ ID NO: 979882 - DNA, 25 bp, Mus musculus
tggacctcccacattactgactgct

SEQ ID NO: 979883 - DNA, 25 bp, Mus musculus
tggacctcccactgtttactgactg

SEQ ID NO: 979884 - DNA, 25 bp, Mus musculus
tggacctcccactttactgactgct

SEQ ID NO: 979885 - DNA, 25 bp, Mus musculus
tggacctccgagcacgggactcgtg

SEQ ID NO: 979886 - DNA, 25 bp, Mus musculus
tggacctccgagcaggggactcgtg

SEQ ID NO: 979887 - DNA, 25 bp, Mus musculus
tggacctcggagaacttccaggtcc

SEQ ID NO: 979888 - DNA, 25 bp, Mus musculus
tggacctcggagccacagagatcct

SEQ ID NO: 979889 - DNA, 25 bp, Mus musculus
tggacctcggagcgatgactcgaga

SEQ ID NO: 979890 - DNA, 25 bp, Mus musculus
tggacctcggagctgcccagacccc

SEQ ID NO: 979891 - DNA, 25 bp, Mus musculus
tggacctcggaggcacagagatcct

SEQ ID NO: 979892 - DNA, 25 bp, Mus musculus
tggacctcggagggatgactcgaga

SEQ ID NO: 979893 - DNA, 25 bp, Mus musculus
tggacctcggaggtgcccagacccc

SEQ ID NO: 979894 - DNA, 25 bp, Mus musculus
tggacctcggagtacttccaggtcc

SEQ ID NO: 979895 - DNA, 25 bp, Mus musculus
tggacctggccgaaccatgacccgc

SEQ ID NO: 979896 - DNA, 25 bp, Mus musculus
tggacctggccgaagcatgacccgc

SEQ ID NO: 979897 - DNA, 25 bp, Mus musculus
tggaccttcccaacactgctcctga

SEQ ID NO: 979898 - DNA, 25 bp, Mus musculus
tggaccttcccaactctgctcctga

SEQ ID NO: 979899 - DNA, 25 bp, Mus musculus
tggaccttttggctattgcagttgg

SEQ ID NO: 979900 - DNA, 25 bp, Mus musculus
tggaccttttgggtattgcagttgg

SEQ ID NO: 979901 - DNA, 25 bp, Mus musculus
tggacgaagatgaacgtcaaactgg

SEQ ID NO: 979902 - DNA, 25 bp, Mus musculus
tggacgaagatgaaggtcaaactgg

SEQ ID NO: 979903 - DNA, 25 bp, Mus musculus
tggacgaccgaatctggactagaac

SEQ ID NO: 979904 - DNA, 25 bp, Mus musculus
tggacgaccgccgtgtgcagcctgg

SEQ ID NO: 979905 - DNA, 25 bp, Mus musculus
tggacgaccggcgtgtgcagcctgg

SEQ ID NO: 979906 - DNA, 25 bp, Mus musculus
tggacgaccgtatctggactagaac

SEQ ID NO: 979907 - DNA, 25 bp, Mus musculus
tggacgactacttgcggctcgtgag

SEQ ID NO: 979908 - DNA, 25 bp, Mus musculus
tggacgactacttggggctcgtgag

SEQ ID NO: 979909 - DNA, 25 bp, Mus musculus
tggacgcctcagctccacactgccc

SEQ ID NO: 979910 - DNA, 25 bp, Mus musculus
tggacgcctcagctgcacactgccc

SEQ ID NO: 979911 - DNA, 25 bp, Mus musculus
tggacggaagacaccgagtatatat

SEQ ID NO: 979912 - DNA, 25 bp, Mus musculus
tggacggaagacacggagtatatat

SEQ ID NO: 979913 - DNA, 25 bp, Mus musculus
tggacggcagcccatgttggagccc

SEQ ID NO: 979914 - DNA, 25 bp, Mus musculus
tggacggcaggacgtggtagatttg

SEQ ID NO: 979915 - DNA, 25 bp, Mus musculus
tggacggcaggaggtggtagatttg

SEQ ID NO: 979916 - DNA, 25 bp, Mus musculus
tggacggcaggccatgttggagccc

SEQ ID NO: 979917 - DNA, 25 bp, Mus musculus
tggacggctgctggatgcaggcatt

SEQ ID NO: 979918 - DNA, 25 bp, Mus musculus
tggacggctggtggatgcaggcatt

SEQ ID NO: 979919 - DNA, 25 bp, Mus musculus
tggacgtaagatcgaacaacaggtg

SEQ ID NO: 979920 - DNA, 25 bp, Mus musculus
tggacgtaagttcgaacaacaggtg

SEQ ID NO: 979921 - DNA, 25 bp, Mus musculus
tggacgtgccctgccgatcctaatc

SEQ ID NO: 979922 - DNA, 25 bp, Mus musculus
tggacgtgccctgcggatcctaatc

SEQ ID NO: 979923 - DNA, 25 bp, Mus musculus
tggacgtggaagccattttgtgact

SEQ ID NO: 979924 - DNA, 25 bp, Mus musculus
tggacgtggaagcccttgatcctgc

SEQ ID NO: 979925 - DNA, 25 bp, Mus musculus
tggacgtggaaggcattttgtgact

SEQ ID NO: 979926 - DNA, 25 bp, Mus musculus
tggacgtggaaggccttgatcctgc

SEQ ID NO: 979927 - DNA, 25 bp, Mus musculus
tggacgtggtcacgcactggcagga

SEQ ID NO: 979928 - DNA, 25 bp, Mus musculus
tggacgtggtcaggcactggcagga

SEQ ID NO: 979929 - DNA, 25 bp, Mus musculus
tggactacagaacggtgtactgctg

SEQ ID NO: 979930 - DNA, 25 bp, Mus musculus
tggactacagtacggtgtactgctg

SEQ ID NO: 979931 - DNA, 25 bp, Mus musculus
tggactacctcttacgtctctttga

SEQ ID NO: 979932 - DNA, 25 bp, Mus musculus
tggactacctcttaggtctctttga

SEQ ID NO: 979933 - DNA, 25 bp, Mus musculus
tggactagcgattcaggcctggtct

SEQ ID NO: 979934 - DNA, 25 bp, Mus musculus
tggactagcgccctggtctcagcga

SEQ ID NO: 979935 - DNA, 25 bp, Mus musculus
tggactagcggcctggtctcagcga

SEQ ID NO: 979936 - DNA, 25 bp, Mus musculus
tggactagcgtttcaggcctggtct

SEQ ID NO: 979937 - DNA, 25 bp, Mus musculus
tggactcaggctagatggaatggat

SEQ ID NO: 979938 - DNA, 25 bp, Mus musculus
tggactcagggtagatggaatggat

SEQ ID NO: 979939 - DNA, 25 bp, Mus musculus
tggactcattttcgccaccccgtga

SEQ ID NO: 979940 - DNA, 25 bp, Mus musculus
tggactcattttggccaccccgtga

SEQ ID NO: 979941 - DNA, 25 bp, Mus musculus
tggactccctggaagccatgaccag

SEQ ID NO: 979942 - DNA, 25 bp, Mus musculus
tggactccctggtagccatgaccag

SEQ ID NO: 979943 - DNA, 25 bp, Mus musculus
tggactccggagcaacctggctcac

SEQ ID NO: 979944 - DNA, 25 bp, Mus musculus
tggactccggaggaacctggctcac

SEQ ID NO: 979945 - DNA, 25 bp, Mus musculus
tggactctaaacagcctgccgagct

SEQ ID NO: 979946 - DNA, 25 bp, Mus musculus
tggactctaaactgcctgccgagct

SEQ ID NO: 979947 - DNA, 25 bp, Mus musculus
tggactgaagctacgcagggaatac

SEQ ID NO: 979948 - DNA, 25 bp, Mus musculus
tggactgaaggtacgcagggaatac

SEQ ID NO: 979949 - DNA, 25 bp, Mus musculus
tggactgatgcgaaggaggccatgc

SEQ ID NO: 979950 - DNA, 25 bp, Mus musculus
tggactgatgggaaggaggccatgc

SEQ ID NO: 979951 - DNA, 25 bp, Mus musculus
tggactgcagccaaaatggcaaaat

SEQ ID NO: 979952 - DNA, 25 bp, Mus musculus
tggactgcagcctaaatggcaaaat

SEQ ID NO: 979953 - DNA, 25 bp, Mus musculus
tggactggaagacgcatctgtggtc

SEQ ID NO: 979954 - DNA, 25 bp, Mus musculus
tggactggaagacggcatctgtggt

SEQ ID NO: 979955 - DNA, 25 bp, Mus musculus
tggactggaagaggcatctgtggtc

SEQ ID NO: 979956 - DNA, 25 bp, Mus musculus
tggactggaagagggcatctgtggt

SEQ ID NO: 979957 - DNA, 25 bp, Mus musculus
tggactgtcgcgccttccactacaa

SEQ ID NO: 979958 - DNA, 25 bp, Mus musculus
tggactgtcgggccttccactacaa

SEQ ID NO: 979959 - DNA, 25 bp, Mus musculus
tggactgtctggaacgtcgctgtgc

SEQ ID NO: 979960 - DNA, 25 bp, Mus musculus
tggactgtctggaaggtcgctgtgc

SEQ ID NO: 979961 - DNA, 25 bp, Mus musculus
tggactgttcagcacgtccagtgtc

SEQ ID NO: 979962 - DNA, 25 bp, Mus musculus
tggactgttcagcaggtccagtgtc

SEQ ID NO: 979963 - DNA, 25 bp, Mus musculus
tggacttcagagaatctgttaaaac

SEQ ID NO: 979964 - DNA, 25 bp, Mus musculus
tggacttcagagtatctgttaaaac

SEQ ID NO: 979965 - DNA, 25 bp, Mus musculus
tggacttctatgagcggcaaggccg

SEQ ID NO: 979966 - DNA, 25 bp, Mus musculus
tggacttctatgaggggcaaggccg

SEQ ID NO: 979967 - DNA, 25 bp, Mus musculus
tggacttgagctgtcggaaatggct

SEQ ID NO: 979968 - DNA, 25 bp, Mus musculus
tggacttgaggtgtcggaaatggct

SEQ ID NO: 979969 - DNA, 25 bp, Mus musculus
tggacttgcaagactctttacagaa

SEQ ID NO: 979970 - DNA, 25 bp, Mus musculus
tggacttgcaagtctctttacagaa

SEQ ID NO: 979971 - DNA, 25 bp, Mus musculus
tggacttgccacctttgtcttcatc

SEQ ID NO: 979972 - DNA, 25 bp, Mus musculus
tggacttgccacgtttgtcttcatc

SEQ ID NO: 979973 - DNA, 25 bp, Mus musculus
tggacttggctgaccggcaccaacc

SEQ ID NO: 979974 - DNA, 25 bp, Mus musculus
tggacttggctgacgggcaccaacc

SEQ ID NO: 979975 - DNA, 25 bp, Mus musculus
tggacttgtgcggccccctggcagc

SEQ ID NO: 979976 - DNA, 25 bp, Mus musculus
tggacttgtggggccccctggcagc

SEQ ID NO: 979977 - DNA, 25 bp, Mus musculus
tggactttgaagagtttgtccggat

SEQ ID NO: 979978 - DNA, 25 bp, Mus musculus
tggactttgaagtgtttgtccggat

SEQ ID NO: 979979 - DNA, 25 bp, Mus musculus
tggagaaactcacgcaacgcctgga

SEQ ID NO: 979980 - DNA, 25 bp, Mus musculus
tggagaaactcaggcaacgcctgga

SEQ ID NO: 979981 - DNA, 25 bp, Mus musculus
tggagaaaggcgcattgatgggctt

SEQ ID NO: 979982 - DNA, 25 bp, Mus musculus
tggagaaaggggcattgatgggctt

SEQ ID NO: 979983 - DNA, 25 bp, Mus musculus
tggagaacaacacttcacctttgaa

SEQ ID NO: 979984 - DNA, 25 bp, Mus musculus
tggagaacaagacttcacctttgaa

SEQ ID NO: 979985 - DNA, 25 bp, Mus musculus
tggagaacaatgagcccctggagct

SEQ ID NO: 979986 - DNA, 25 bp, Mus musculus
tggagaacaatgaggccctggagct

SEQ ID NO: 979987 - DNA, 25 bp, Mus musculus
tggagaacagctgcttttacaactc

SEQ ID NO: 979988 - DNA, 25 bp, Mus musculus
tggagaacaggtgcttttacaactc

SEQ ID NO: 979989 - DNA, 25 bp, Mus musculus
tggagaagaagcgacaaacatcaat

SEQ ID NO: 979990 - DNA, 25 bp, Mus musculus
tggagaagaagcgagaaacatcaat

SEQ ID NO: 979991 - DNA, 25 bp, Mus musculus
tggagaagaggacgttgtcatccct

SEQ ID NO: 979992 - DNA, 25 bp, Mus musculus
tggagaagaggaggttgtcatccct

SEQ ID NO: 979993 - DNA, 25 bp, Mus musculus
tggagaaggataaacggctgcagac

SEQ ID NO: 979994 - DNA, 25 bp, Mus musculus
tggagaaggataaagggctgcagac

SEQ ID NO: 979995 - DNA, 25 bp, Mus musculus
tggagaataatttacgggctgctgt

SEQ ID NO: 979996 - DNA, 25 bp, Mus musculus
tggagaataatttaggggctgctgt

SEQ ID NO: 979997 - DNA, 25 bp, Mus musculus
tggagaattacactactgtttatca

SEQ ID NO: 979998 - DNA, 25 bp, Mus musculus
tggagaattacagtactgtttatca

SEQ ID NO: 979999 - DNA, 25 bp, Mus musculus
tggagaattgagaaaatggagctgg

SEQ ID NO: 980000 - DNA, 25 bp, Mus musculus
tggagaattgagtaaatggagctgg

SEQ ID NO: 980001 - DNA, 25 bp, Mus musculus
tggagaatttctcaaagtgcaacag

SEQ ID NO: 980002 - DNA, 25 bp, Mus musculus
tggagaatttctgaaagtgcaacag

SEQ ID NO: 980003 - DNA, 25 bp, Mus musculus
tggagacaacggaaagacgatgctc

SEQ ID NO: 980004 - DNA, 25 bp, Mus musculus
tggagacaacggtaagacgatgctc

SEQ ID NO: 980005 - DNA, 25 bp, Mus musculus
tggagacaagctacgcatggagtac

SEQ ID NO: 980006 - DNA, 25 bp, Mus musculus
tggagacaaggtacgcatggagtac

SEQ ID NO: 980007 - DNA, 25 bp, Mus musculus
tggagacaccacatctgccctgtgg

SEQ ID NO: 980008 - DNA, 25 bp, Mus musculus
tggagacaccacatgtgccctgtgg

SEQ ID NO: 980009 - DNA, 25 bp, Mus musculus
tggagacagaagctcatcagaacaa

SEQ ID NO: 980010 - DNA, 25 bp, Mus musculus
tggagacagaagctggtggagactc

SEQ ID NO: 980011 - DNA, 25 bp, Mus musculus
tggagacagaaggtcatcagaacaa

SEQ ID NO: 980012 - DNA, 25 bp, Mus musculus
tggagacagaaggtggtggagactc

SEQ ID NO: 980013 - DNA, 25 bp, Mus musculus
tggagacagcagccacaccaagatg

SEQ ID NO: 980014 - DNA, 25 bp, Mus musculus
tggagacagcagcggactcggaact

SEQ ID NO: 980015 - DNA, 25 bp, Mus musculus
tggagacagcaggcacaccaagatg

SEQ ID NO: 980016 - DNA, 25 bp, Mus musculus
tggagacagcaggggactcggaact

SEQ ID NO: 980017 - DNA, 25 bp, Mus musculus
tggagacaggcgtcccattggcctc

SEQ ID NO: 980018 - DNA, 25 bp, Mus musculus
tggagacaggggtcccattggcctc

SEQ ID NO: 980019 - DNA, 25 bp, Mus musculus
tggagacatcaaaacaggaattcct

SEQ ID NO: 980020 - DNA, 25 bp, Mus musculus
tggagacatcaaaagaggaattcct

SEQ ID NO: 980021 - DNA, 25 bp, Mus musculus
tggagacatgagactaaggttgtgg

SEQ ID NO: 980022 - DNA, 25 bp, Mus musculus
tggagacatgagcaactcagccacc

SEQ ID NO: 980023 - DNA, 25 bp, Mus musculus
tggagacatgagcagctactccatc

SEQ ID NO: 980024 - DNA, 25 bp, Mus musculus
tggagacatgagcgctcatccgctc

SEQ ID NO: 980025 - DNA, 25 bp, Mus musculus
tggagacatgaggaactcagccacc

SEQ ID NO: 980026 - DNA, 25 bp, Mus musculus
tggagacatgaggagctactccatc

SEQ ID NO: 980027 - DNA, 25 bp, Mus musculus
tggagacatgagggctcatccgctc

SEQ ID NO: 980028 - DNA, 25 bp, Mus musculus
tggagacatgagtctaaggttgtgg

SEQ ID NO: 980029 - DNA, 25 bp, Mus musculus
tggagaccagcatgattgggctgat

SEQ ID NO: 980030 - DNA, 25 bp, Mus musculus
tggagaccaggatgattgggctgat

SEQ ID NO: 980031 - DNA, 25 bp, Mus musculus
tggagaccatagcacaaggatgaga

SEQ ID NO: 980032 - DNA, 25 bp, Mus musculus
tggagaccataggacaaggatgaga

SEQ ID NO: 980033 - DNA, 25 bp, Mus musculus
tggagacccattctgccccaattcc

SEQ ID NO: 980034 - DNA, 25 bp, Mus musculus
tggagacccattgtgccccaattcc

SEQ ID NO: 980035 - DNA, 25 bp, Mus musculus
tggagaccgctgcacatacgaacac

SEQ ID NO: 980036 - DNA, 25 bp, Mus musculus
tggagaccgctgcagatacgaacac

SEQ ID NO: 980037 - DNA, 25 bp, Mus musculus
tggagacctgcatggagaaaatgca

SEQ ID NO: 980038 - DNA, 25 bp, Mus musculus
tggagacctggacgatccccaggac

SEQ ID NO: 980039 - DNA, 25 bp, Mus musculus
tggagacctggaggatccccaggac

SEQ ID NO: 980040 - DNA, 25 bp, Mus musculus
tggagacctggatggagaaaatgca

SEQ ID NO: 980041 - DNA, 25 bp, Mus musculus
tggagacgctcacacctcacgtggt

SEQ ID NO: 980042 - DNA, 25 bp, Mus musculus
tggagacgctcagacctcacgtggt

SEQ ID NO: 980043 - DNA, 25 bp, Mus musculus
tggagacgctgacgcatggcagttt

SEQ ID NO: 980044 - DNA, 25 bp, Mus musculus
tggagacgctgaggcatggcagttt

SEQ ID NO: 980045 - DNA, 25 bp, Mus musculus
tggagacgtgaactttgtgtgtgtt

SEQ ID NO: 980046 - DNA, 25 bp, Mus musculus
tggagacgtgaagtttgtgtgtgtt

SEQ ID NO: 980047 - DNA, 25 bp, Mus musculus
tggagactcagcagctgatgaggaa

SEQ ID NO: 980048 - DNA, 25 bp, Mus musculus
tggagactcagcaggtgatgaggaa

SEQ ID NO: 980049 - DNA, 25 bp, Mus musculus
tggagactctgacgttggattcctg

SEQ ID NO: 980050 - DNA, 25 bp, Mus musculus
tggagactctgaggttggattcctg

SEQ ID NO: 980051 - DNA, 25 bp, Mus musculus
tggagactggtggacgaagaaatag

SEQ ID NO: 980052 - DNA, 25 bp, Mus musculus
tggagactggtggaggaagaaatag

SEQ ID NO: 980053 - DNA, 25 bp, Mus musculus
tggagagaagctggatgtctacgtc

SEQ ID NO: 980054 - DNA, 25 bp, Mus musculus
tggagagaaggtggatgtctacgtc

SEQ ID NO: 980055 - DNA, 25 bp, Mus musculus
tggagagaggaaaacgcatttatat

SEQ ID NO: 980056 - DNA, 25 bp, Mus musculus
tggagagaggaaaaggcatttatat

SEQ ID NO: 980057 - DNA, 25 bp, Mus musculus
tggagagaggcgtctggcaggccct

SEQ ID NO: 980058 - DNA, 25 bp, Mus musculus
tggagagaggggtctggcaggccct

SEQ ID NO: 980059 - DNA, 25 bp, Mus musculus
tggagagatcagatgagacccagga

SEQ ID NO: 980060 - DNA, 25 bp, Mus musculus
tggagagatcagttgagacccagga

SEQ ID NO: 980061 - DNA, 25 bp, Mus musculus
tggagagatgaaggatgatgaggaa

SEQ ID NO: 980062 - DNA, 25 bp, Mus musculus
tggagagatgaaggttgatgaggaa

SEQ ID NO: 980063 - DNA, 25 bp, Mus musculus
tggagagatgagcaagttctatagt

SEQ ID NO: 980064 - DNA, 25 bp, Mus musculus
tggagagatgagcatgttctatagt

SEQ ID NO: 980065 - DNA, 25 bp, Mus musculus
tggagagatgcccaccgggacagac

SEQ ID NO: 980066 - DNA, 25 bp, Mus musculus
tggagagatggccaccgggacagac

SEQ ID NO: 980067 - DNA, 25 bp, Mus musculus
tggagagcaaggacgaagaggatga

SEQ ID NO: 980068 - DNA, 25 bp, Mus musculus
tggagagcaaggtcgaagaggatga

SEQ ID NO: 980069 - DNA, 25 bp, Mus musculus
tggagaggaaaccatcctggggcag

SEQ ID NO: 980070 - DNA, 25 bp, Mus musculus
tggagaggaaacgatcctggggcag

SEQ ID NO: 980071 - DNA, 25 bp, Mus musculus
tggagaggacagaacggaccttaga

SEQ ID NO: 980072 - DNA, 25 bp, Mus musculus
tggagaggacagaagggaccttaga

SEQ ID NO: 980073 - DNA, 25 bp, Mus musculus
tggagaggagcgtctagagacatgt

SEQ ID NO: 980074 - DNA, 25 bp, Mus musculus
tggagaggagggtctagagacatgt

SEQ ID NO: 980075 - DNA, 25 bp, Mus musculus
tggagaggtggactgggatgccttt

SEQ ID NO: 980076 - DNA, 25 bp, Mus musculus
tggagaggtggagtgggatgccttt

SEQ ID NO: 980077 - DNA, 25 bp, Mus musculus
tggagagtccagacttacctccagt

SEQ ID NO: 980078 - DNA, 25 bp, Mus musculus
tggagagtccagtcttacctccagt

SEQ ID NO: 980079 - DNA, 25 bp, Mus musculus
tggagatacccagacccctgcaact

SEQ ID NO: 980080 - DNA, 25 bp, Mus musculus
tggagatacccagagccctgcaact

SEQ ID NO: 980081 - DNA, 25 bp, Mus musculus
tggagatatgagacgaaagtaggtg

SEQ ID NO: 980082 - DNA, 25 bp, Mus musculus
tggagatatgagctactccatccgc

SEQ ID NO: 980083 - DNA, 25 bp, Mus musculus
tggagatatgaggtactccatccgc

SEQ ID NO: 980084 - DNA, 25 bp, Mus musculus
tggagatatgagtcgaaagtaggtg

SEQ ID NO: 980085 - DNA, 25 bp, Mus musculus
tggagatcacagacatgggggtcgt

SEQ ID NO: 980086 - DNA, 25 bp, Mus musculus
tggagatcacagtcatgggggtcgt

SEQ ID NO: 980087 - DNA, 25 bp, Mus musculus
tggagatcagcattcttagattctt

SEQ ID NO: 980088 - DNA, 25 bp, Mus musculus
tggagatcaggattcttagattctt

SEQ ID NO: 980089 - DNA, 25 bp, Mus musculus
tggagatgaactggtgttgataaac

SEQ ID NO: 980090 - DNA, 25 bp, Mus musculus
tggagatgaagtggtgttgataaac

SEQ ID NO: 980091 - DNA, 25 bp, Mus musculus
tggagatggaagaggtccagtcccc

SEQ ID NO: 980092 - DNA, 25 bp, Mus musculus
tggagatggaagtggtccagtcccc

SEQ ID NO: 980093 - DNA, 25 bp, Mus musculus
tggagatgggcaagtccgttgatga

SEQ ID NO: 980094 - DNA, 25 bp, Mus musculus
tggagatggggaagtccgttgatga

SEQ ID NO: 980095 - DNA, 25 bp, Mus musculus
tggagattacagcgtttcctgaggc

SEQ ID NO: 980096 - DNA, 25 bp, Mus musculus
tggagattacagggtttcctgaggc

SEQ ID NO: 980097 - DNA, 25 bp, Mus musculus
tggagattccagcaagcccctgagg

SEQ ID NO: 980098 - DNA, 25 bp, Mus musculus
tggagattccagcaattcctggagt

SEQ ID NO: 980099 - DNA, 25 bp, Mus musculus
tggagattccaggaagcccctgagg

SEQ ID NO: 980100 - DNA, 25 bp, Mus musculus
tggagattccaggaattcctggagt

SEQ ID NO: 980101 - DNA, 25 bp, Mus musculus
tggagcaaaaaatgggctacacata

SEQ ID NO: 980102 - DNA, 25 bp, Mus musculus
tggagcaaaactatgaattaggggc

SEQ ID NO: 980103 - DNA, 25 bp, Mus musculus
tggagcaaaagtatgaattaggggc

SEQ ID NO: 980104 - DNA, 25 bp, Mus musculus
tggagcaaaatatgggctacacata

SEQ ID NO: 980105 - DNA, 25 bp, Mus musculus
tggagcaacaagagaagaagaagct

SEQ ID NO: 980106 - DNA, 25 bp, Mus musculus
tggagcaacaagtgaagaagaagct

SEQ ID NO: 980107 - DNA, 25 bp, Mus musculus
tggagcaaggtgaccatgctgcttg

SEQ ID NO: 980108 - DNA, 25 bp, Mus musculus
tggagcaaggtgacgatgctgcttg

SEQ ID NO: 980109 - DNA, 25 bp, Mus musculus
tggagcaatacacgtccttccaaaa

SEQ ID NO: 980110 - DNA, 25 bp, Mus musculus
tggagcaatacaggtccttccaaaa

SEQ ID NO: 980111 - DNA, 25 bp, Mus musculus
tggagcaatccaagttaaagaaaga

SEQ ID NO: 980112 - DNA, 25 bp, Mus musculus
tggagcaatccaataaagaaagaag

SEQ ID NO: 980113 - DNA, 25 bp, Mus musculus
tggagcaatccatgttaaagaaaga

SEQ ID NO: 980114 - DNA, 25 bp, Mus musculus
tggagcaatccattaaagaaagaag

SEQ ID NO: 980115 - DNA, 25 bp, Mus musculus
tggagcagagcctccaggagttgga

SEQ ID NO: 980116 - DNA, 25 bp, Mus musculus
tggagcagaggctccaggagttgga

SEQ ID NO: 980117 - DNA, 25 bp, Mus musculus
tggagcagcaccctcagggctggct

SEQ ID NO: 980118 - DNA, 25 bp, Mus musculus
tggagcagcagcctcagggctggct

SEQ ID NO: 980119 - DNA, 25 bp, Mus musculus
tggagcagcctgcggaatctatata

SEQ ID NO: 980120 - DNA, 25 bp, Mus musculus
tggagcagcctggggaatctatata

SEQ ID NO: 980121 - DNA, 25 bp, Mus musculus
tggagcaggacaagctggcctcaaa

SEQ ID NO: 980122 - DNA, 25 bp, Mus musculus
tggagcaggacaagtttgcacaccc

SEQ ID NO: 980123 - DNA, 25 bp, Mus musculus
tggagcaggacatgctggcctcaaa

SEQ ID NO: 980124 - DNA, 25 bp, Mus musculus
tggagcaggacatgtttgcacaccc

SEQ ID NO: 980125 - DNA, 25 bp, Mus musculus
tggagcagttctctgaagccagcca

SEQ ID NO: 980126 - DNA, 25 bp, Mus musculus
tggagcagttctgtgaagccagcca

SEQ ID NO: 980127 - DNA, 25 bp, Mus musculus
tggagcatcacgaaagccactttcc

SEQ ID NO: 980128 - DNA, 25 bp, Mus musculus
tggagcatcacgaatgccactttcc

SEQ ID NO: 980129 - DNA, 25 bp, Mus musculus
tggagccaaacaatgaataaaatgg

SEQ ID NO: 980130 - DNA, 25 bp, Mus musculus
tggagccaaacatttctcgggatta

SEQ ID NO: 980131 - DNA, 25 bp, Mus musculus
tggagccaaagaatgaataaaatgg

SEQ ID NO: 980132 - DNA, 25 bp, Mus musculus
tggagccaaagatttctcgggatta

SEQ ID NO: 980133 - DNA, 25 bp, Mus musculus
tggagccacaaaatgcggttgccaa

SEQ ID NO: 980134 - DNA, 25 bp, Mus musculus
tggagccacaaactcctgcttcctg

SEQ ID NO: 980135 - DNA, 25 bp, Mus musculus
tggagccacaaagtcctgcttcctg

SEQ ID NO: 980136 - DNA, 25 bp, Mus musculus
tggagccacaaattgcggttgccaa

SEQ ID NO: 980137 - DNA, 25 bp, Mus musculus
tggagccacaggactgtgagtcaca

SEQ ID NO: 980138 - DNA, 25 bp, Mus musculus
tggagccacaggatcaaataacagt

SEQ ID NO: 980139 - DNA, 25 bp, Mus musculus
tggagccacaggatcatggcagtga

SEQ ID NO: 980140 - DNA, 25 bp, Mus musculus
tggagccacaggatgaaataacagt

SEQ ID NO: 980141 - DNA, 25 bp, Mus musculus
tggagccacaggatgatggcagtga

SEQ ID NO: 980142 - DNA, 25 bp, Mus musculus
tggagccacaggtctgtgagtcaca

SEQ ID NO: 980143 - DNA, 25 bp, Mus musculus
tggagccagcaactccaacaagctt

SEQ ID NO: 980144 - DNA, 25 bp, Mus musculus
tggagccagcaagtccaacaagctt

SEQ ID NO: 980145 - DNA, 25 bp, Mus musculus
tggagcccaaaaagatggcacttcc

SEQ ID NO: 980146 - DNA, 25 bp, Mus musculus
tggagcccaaaatgatggcacttcc

SEQ ID NO: 980147 - DNA, 25 bp, Mus musculus
tggagcccaatgaagtccgactgga

SEQ ID NO: 980148 - DNA, 25 bp, Mus musculus
tggagcccaatgtagtccgactgga

SEQ ID NO: 980149 - DNA, 25 bp, Mus musculus
tggagcccatggaaaagacgaagag

SEQ ID NO: 980150 - DNA, 25 bp, Mus musculus
tggagcccatggaatagacgaagag

SEQ ID NO: 980151 - DNA, 25 bp, Mus musculus
tggagcccccaccaccttcccttca

SEQ ID NO: 980152 - DNA, 25 bp, Mus musculus
tggagcccccaccagcttcccttca

SEQ ID NO: 980153 - DNA, 25 bp, Mus musculus
tggagccccgagcacaggtgagcca

SEQ ID NO: 980154 - DNA, 25 bp, Mus musculus
tggagccccgagcaggacaggtgag

SEQ ID NO: 980155 - DNA, 25 bp, Mus musculus
tggagccccgagcccttccagcagg

SEQ ID NO: 980156 - DNA, 25 bp, Mus musculus
tggagccccgagctcctctaatttc

SEQ ID NO: 980157 - DNA, 25 bp, Mus musculus
tggagccccgaggacaggtgagcca

SEQ ID NO: 980158 - DNA, 25 bp, Mus musculus
tggagccccgaggaggacaggtgag

SEQ ID NO: 980159 - DNA, 25 bp, Mus musculus
tggagccccgaggccttccagcagg

SEQ ID NO: 980160 - DNA, 25 bp, Mus musculus
tggagccccgaggtcctctaatttc

SEQ ID NO: 980161 - DNA, 25 bp, Mus musculus
tggagccctgtgcacatttccctca

SEQ ID NO: 980162 - DNA, 25 bp, Mus musculus
tggagccctgtgcacccttgtgaca

SEQ ID NO: 980163 - DNA, 25 bp, Mus musculus
tggagccctgtgcagatttccctca

SEQ ID NO: 980164 - DNA, 25 bp, Mus musculus
tggagccctgtgcagccttgtgaca

SEQ ID NO: 980165 - DNA, 25 bp, Mus musculus
tggagccgcccggacgtgcttgagg

SEQ ID NO: 980166 - DNA, 25 bp, Mus musculus
tggagccgcccggaggtgcttgagg

SEQ ID NO: 980167 - DNA, 25 bp, Mus musculus
tggagcgacaagctaaaagaagaaa

SEQ ID NO: 980168 - DNA, 25 bp, Mus musculus
tggagcgacaaggtaaaagaagaaa

SEQ ID NO: 980169 - DNA, 25 bp, Mus musculus
tggagcgaggaacgcacctgatgca

SEQ ID NO: 980170 - DNA, 25 bp, Mus musculus
tggagcgaggaacggatcgcttaca

SEQ ID NO: 980171 - DNA, 25 bp, Mus musculus
tggagcgaggaaggcacctgatgca

SEQ ID NO: 980172 - DNA, 25 bp, Mus musculus
tggagcgaggaagggatcgcttaca

SEQ ID NO: 980173 - DNA, 25 bp, Mus musculus
tggagcggagcctctctgcctttca

SEQ ID NO: 980174 - DNA, 25 bp, Mus musculus
tggagcggagctctcattgggagaa

SEQ ID NO: 980175 - DNA, 25 bp, Mus musculus
tggagcggaggctctctgcctttca

SEQ ID NO: 980176 - DNA, 25 bp, Mus musculus
tggagcggaggtctcattgggagaa

SEQ ID NO: 980177 - DNA, 25 bp, Mus musculus
tggagcgtggagaccatcttcaaca

SEQ ID NO: 980178 - DNA, 25 bp, Mus musculus
tggagcgtggagtccatcttcaaca

SEQ ID NO: 980179 - DNA, 25 bp, Mus musculus
tggagctacacgcgttggagctgga

SEQ ID NO: 980180 - DNA, 25 bp, Mus musculus
tggagctacacgggttggagctgga

SEQ ID NO: 980181 - DNA, 25 bp, Mus musculus
tggagctattcacgggatgatggcg

SEQ ID NO: 980182 - DNA, 25 bp, Mus musculus
tggagctattcaggggatgatggcg

SEQ ID NO: 980183 - DNA, 25 bp, Mus musculus
tggagctcagctgcccctgggagca

SEQ ID NO: 980184 - DNA, 25 bp, Mus musculus
tggagctcaggtgcccctgggagca

SEQ ID NO: 980185 - DNA, 25 bp, Mus musculus
tggagctcggcacgcatttcaggga

SEQ ID NO: 980186 - DNA, 25 bp, Mus musculus
tggagctcggcaggcatttcaggga

SEQ ID NO: 980187 - DNA, 25 bp, Mus musculus
tggagctgcgcaagcgtgagcacct

SEQ ID NO: 980188 - DNA, 25 bp, Mus musculus
tggagctgcgcaagggtgagcacct

SEQ ID NO: 980189 - DNA, 25 bp, Mus musculus
tggagctgctggcaagatgctacca

SEQ ID NO: 980190 - DNA, 25 bp, Mus musculus
tggagctgctgggaagatgctacca

SEQ ID NO: 980191 - DNA, 25 bp, Mus musculus
tggagctgcttaagtaccaccctcg

SEQ ID NO: 980192 - DNA, 25 bp, Mus musculus
tggagctgcttatgtaccaccctcg

SEQ ID NO: 980193 - DNA, 25 bp, Mus musculus
tggagctggaagctcttgttgcagc

SEQ ID NO: 980194 - DNA, 25 bp, Mus musculus
tggagctggaaggtcttgttgcagc

SEQ ID NO: 980195 - DNA, 25 bp, Mus musculus
tggagctggaggcctaaaaccgact

SEQ ID NO: 980196 - DNA, 25 bp, Mus musculus
tggagctggagggctaaaaccgact

SEQ ID NO: 980197 - DNA, 25 bp, Mus musculus
tggagctggcagaggcacctcggtt

SEQ ID NO: 980198 - DNA, 25 bp, Mus musculus
tggagctggcagtggcacctcggtt

SEQ ID NO: 980199 - DNA, 25 bp, Mus musculus
tggagctggccacgactgccgcttc

SEQ ID NO: 980200 - DNA, 25 bp, Mus musculus
tggagctggccaggactgccgcttc

SEQ ID NO: 980201 - DNA, 25 bp, Mus musculus
tggagctgtgcaaggtccaaaccct

SEQ ID NO: 980202 - DNA, 25 bp, Mus musculus
tggagctgtggaaggtccaaaccct

SEQ ID NO: 980203 - DNA, 25 bp, Mus musculus
tggagcttcaatcacctccatcagc

SEQ ID NO: 980204 - DNA, 25 bp, Mus musculus
tggagcttcaatcagctccatcagc

SEQ ID NO: 980205 - DNA, 25 bp, Mus musculus
tggagcttgtcacgacaggggacca

SEQ ID NO: 980206 - DNA, 25 bp, Mus musculus
tggagcttgtcaggacaggggacca

SEQ ID NO: 980207 - DNA, 25 bp, Mus musculus
tggagcttttagaccacaacgaagc

SEQ ID NO: 980208 - DNA, 25 bp, Mus musculus
tggagcttttagtccacaacgaagc

SEQ ID NO: 980209 - DNA, 25 bp, Mus musculus
tggaggacaaagctcaagcaggtag

SEQ ID NO: 980210 - DNA, 25 bp, Mus musculus
tggaggacaaaggtcaagcaggtag

SEQ ID NO: 980211 - DNA, 25 bp, Mus musculus
tggaggacgcgatacttctgacaca

SEQ ID NO: 980212 - DNA, 25 bp, Mus musculus
tggaggacgcgatagttctgacaca

SEQ ID NO: 980213 - DNA, 25 bp, Mus musculus
tggaggactgagctggtgaaaaaca

SEQ ID NO: 980214 - DNA, 25 bp, Mus musculus
tggaggactgaggtggtgaaaaaca

SEQ ID NO: 980215 - DNA, 25 bp, Mus musculus
tggaggagagagaatgactctgtgg

SEQ ID NO: 980216 - DNA, 25 bp, Mus musculus
tggaggagagagctacaatttcttc

SEQ ID NO: 980217 - DNA, 25 bp, Mus musculus
tggaggagagaggtacaatttcttc

SEQ ID NO: 980218 - DNA, 25 bp, Mus musculus
tggaggagagagtatgactctgtgg

SEQ ID NO: 980219 - DNA, 25 bp, Mus musculus
tggaggagccagcggccaagccaca

SEQ ID NO: 980220 - DNA, 25 bp, Mus musculus
tggaggagccaggggccaagccaca

SEQ ID NO: 980221 - DNA, 25 bp, Mus musculus
tggaggagcttgagccgggcaggga

SEQ ID NO: 980222 - DNA, 25 bp, Mus musculus
tggaggagcttgaggcgggcaggga

SEQ ID NO: 980223 - DNA, 25 bp, Mus musculus
tggaggaggaaaaggcatgaggatc

SEQ ID NO: 980224 - DNA, 25 bp, Mus musculus
tggaggaggaaatggcatgaggatc

SEQ ID NO: 980225 - DNA, 25 bp, Mus musculus
tggaggaggcagagcgaagacttgc

SEQ ID NO: 980226 - DNA, 25 bp, Mus musculus
tggaggaggcagagggaagacttgc

SEQ ID NO: 980227 - DNA, 25 bp, Mus musculus
tggaggagttgacttaaaagaagat

SEQ ID NO: 980228 - DNA, 25 bp, Mus musculus
tggaggagttgagttaaaagaagat

SEQ ID NO: 980229 - DNA, 25 bp, Mus musculus
tggaggatgaagagatcgagtgcct

SEQ ID NO: 980230 - DNA, 25 bp, Mus musculus
tggaggatgaagtgatcgagtgcct

SEQ ID NO: 980231 - DNA, 25 bp, Mus musculus
tggaggatggggattgcaaacagtc

SEQ ID NO: 980232 - DNA, 25 bp, Mus musculus
tggaggatggggtttgcaaacagtc

SEQ ID NO: 980233 - DNA, 25 bp, Mus musculus
tggaggatttgacgcctacctagga

SEQ ID NO: 980234 - DNA, 25 bp, Mus musculus
tggaggatttgaggcctacctagga

SEQ ID NO: 980235 - DNA, 25 bp, Mus musculus
tggaggcaagatccctttgcggggc

SEQ ID NO: 980236 - DNA, 25 bp, Mus musculus
tggaggcaagatgcctttgcggggc

SEQ ID NO: 980237 - DNA, 25 bp, Mus musculus
tggaggcaagcaaggagcacgaaga

SEQ ID NO: 980238 - DNA, 25 bp, Mus musculus
tggaggcaagcatggccaggctatg

SEQ ID NO: 980239 - DNA, 25 bp, Mus musculus
tggaggcaagcctatgctgtgggat

SEQ ID NO: 980240 - DNA, 25 bp, Mus musculus
tggaggcaaggaaggagcacgaaga

SEQ ID NO: 980241 - DNA, 25 bp, Mus musculus
tggaggcaaggatggccaggctatg

SEQ ID NO: 980242 - DNA, 25 bp, Mus musculus
tggaggcaaggctatgctgtgggat

SEQ ID NO: 980243 - DNA, 25 bp, Mus musculus
tggaggcacggagacccttccatat

SEQ ID NO: 980244 - DNA, 25 bp, Mus musculus
tggaggcacggagagccttccatat

SEQ ID NO: 980245 - DNA, 25 bp, Mus musculus
tggaggcagtagtctgctacagaga

SEQ ID NO: 980246 - DNA, 25 bp, Mus musculus
tggaggcagtctgcaaatagtctac

SEQ ID NO: 980247 - DNA, 25 bp, Mus musculus
tggaggcagtgtgcaaatagtctac

SEQ ID NO: 980248 - DNA, 25 bp, Mus musculus
tggaggcagttgtctgctacagaga

SEQ ID NO: 980249 - DNA, 25 bp, Mus musculus
tggaggcattcgcctgcgccaccaa

SEQ ID NO: 980250 - DNA, 25 bp, Mus musculus
tggaggcattcggctgcgccaccaa

SEQ ID NO: 980251 - DNA, 25 bp, Mus musculus
tggaggccacggcaatgacgtgcca

SEQ ID NO: 980252 - DNA, 25 bp, Mus musculus
tggaggccacgggaatgacgtgcca

SEQ ID NO: 980253 - DNA, 25 bp, Mus musculus
tggaggccagcaaaacggcaactat

SEQ ID NO: 980254 - DNA, 25 bp, Mus musculus
tggaggccaggaaaacggcaactat

SEQ ID NO: 980255 - DNA, 25 bp, Mus musculus
tggaggcccaaacacgtatcatcag

SEQ ID NO: 980256 - DNA, 25 bp, Mus musculus
tggaggcccaaacaggtatcatcag

SEQ ID NO: 980257 - DNA, 25 bp, Mus musculus
tggaggcccccacgattccccctct

SEQ ID NO: 980258 - DNA, 25 bp, Mus musculus
tggaggcccccaggattccccctct

SEQ ID NO: 980259 - DNA, 25 bp, Mus musculus
tggaggcccctcggcaatcagggga

SEQ ID NO: 980260 - DNA, 25 bp, Mus musculus
tggaggcccctcgggaatcagggga

SEQ ID NO: 980261 - DNA, 25 bp, Mus musculus
tggaggccctggagagtggaacctg

SEQ ID NO: 980262 - DNA, 25 bp, Mus musculus
tggaggccctggagtgtggaacctg

SEQ ID NO: 980263 - DNA, 25 bp, Mus musculus
tggaggccggagaggagccgctgct

SEQ ID NO: 980264 - DNA, 25 bp, Mus musculus
tggaggccggagtggagccgctgct

SEQ ID NO: 980265 - DNA, 25 bp, Mus musculus
tggaggcctggagacgaagttctcc

SEQ ID NO: 980266 - DNA, 25 bp, Mus musculus
tggaggcctggagaggaagttctcc

SEQ ID NO: 980267 - DNA, 25 bp, Mus musculus
tggaggccttactgccccggggtgc

SEQ ID NO: 980268 - DNA, 25 bp, Mus musculus
tggaggccttactggcccggggtgc

SEQ ID NO: 980269 - DNA, 25 bp, Mus musculus
tggaggctacaacgttcgctatgcc

SEQ ID NO: 980270 - DNA, 25 bp, Mus musculus
tggaggctacaaggttcgctatgcc

SEQ ID NO: 980271 - DNA, 25 bp, Mus musculus
tggaggctataacgtccccagggag

SEQ ID NO: 980272 - DNA, 25 bp, Mus musculus
tggaggctataaggtccccagggag

SEQ ID NO: 980273 - DNA, 25 bp, Mus musculus
tggaggctgcagacagcagctttgg

SEQ ID NO: 980274 - DNA, 25 bp, Mus musculus
tggaggctgcagtcagcagctttgg

SEQ ID NO: 980275 - DNA, 25 bp, Mus musculus
tggaggcttctacacgtggctgtgg

SEQ ID NO: 980276 - DNA, 25 bp, Mus musculus
tggaggcttctacaggtggctgtgg

SEQ ID NO: 980277 - DNA, 25 bp, Mus musculus
tggagggactcaaccctgcagcccc

SEQ ID NO: 980278 - DNA, 25 bp, Mus musculus
tggagggactcaacgctgcagcccc

SEQ ID NO: 980279 - DNA, 25 bp, Mus musculus
tggagggagacacaagcaggtggca

SEQ ID NO: 980280 - DNA, 25 bp, Mus musculus
tggagggagacacaaggaggtggtg

SEQ ID NO: 980281 - DNA, 25 bp, Mus musculus
tggagggagacagaagcaggtggca

SEQ ID NO: 980282 - DNA, 25 bp, Mus musculus
tggagggagacagaaggaggtggtg

SEQ ID NO: 980283 - DNA, 25 bp, Mus musculus
tggagggcccaatgaggaatcctgt

SEQ ID NO: 980284 - DNA, 25 bp, Mus musculus
tggagggcccaatgtggaatcctgt

SEQ ID NO: 980285 - DNA, 25 bp, Mus musculus
tggagggggtaccacatcctacagt

SEQ ID NO: 980286 - DNA, 25 bp, Mus musculus
tggagggggtaccagatcctacagt

SEQ ID NO: 980287 - DNA, 25 bp, Mus musculus
tggaggtcaacaagtggctggaaac

SEQ ID NO: 980288 - DNA, 25 bp, Mus musculus
tggaggtcaacatgtggctggaaac

SEQ ID NO: 980289 - DNA, 25 bp, Mus musculus
tggaggtcagagactcggagactgc

SEQ ID NO: 980290 - DNA, 25 bp, Mus musculus
tggaggtcagagtctcggagactgc

SEQ ID NO: 980291 - DNA, 25 bp, Mus musculus
tggaggtcagcgtggcagtggtggg

SEQ ID NO: 980292 - DNA, 25 bp, Mus musculus
tggaggtcagggtggcagtggtggg

SEQ ID NO: 980293 - DNA, 25 bp, Mus musculus
tggaggtcatttcacgggagcgttt

SEQ ID NO: 980294 - DNA, 25 bp, Mus musculus
tggaggtcatttcaggggagcgttt

SEQ ID NO: 980295 - DNA, 25 bp, Mus musculus
tggaggtccgagcacaccctgaaag

SEQ ID NO: 980296 - DNA, 25 bp, Mus musculus
tggaggtccgagccgagtgagctca

SEQ ID NO: 980297 - DNA, 25 bp, Mus musculus
tggaggtccgaggacaccctgaaag

SEQ ID NO: 980298 - DNA, 25 bp, Mus musculus
tggaggtccgaggcgagtgagctca

SEQ ID NO: 980299 - DNA, 25 bp, Mus musculus
tggaggtctactcattccctgaaga

SEQ ID NO: 980300 - DNA, 25 bp, Mus musculus
tggaggtctactgattccctgaaga

SEQ ID NO: 980301 - DNA, 25 bp, Mus musculus
tggaggtggcagccttctcagggcc

SEQ ID NO: 980302 - DNA, 25 bp, Mus musculus
tggaggtggcaggcttctcagggcc

SEQ ID NO: 980303 - DNA, 25 bp, Mus musculus
tggaggtgggctgctgtgagtggct

SEQ ID NO: 980304 - DNA, 25 bp, Mus musculus
tggaggtggggtgctgtgagtggct

SEQ ID NO: 980305 - DNA, 25 bp, Mus musculus
tggaggtgttgaacttcttgtagaa

SEQ ID NO: 980306 - DNA, 25 bp, Mus musculus
tggaggtgttgatcttcttgtagaa

SEQ ID NO: 980307 - DNA, 25 bp, Mus musculus
tggaggttctcggacagcaactgtt

SEQ ID NO: 980308 - DNA, 25 bp, Mus musculus
tggaggttctgggacagcaactgtt

SEQ ID NO: 980309 - DNA, 25 bp, Mus musculus
tggaggtttaaactgtctcatgcgg

SEQ ID NO: 980310 - DNA, 25 bp, Mus musculus
tggaggtttaaagtgtctcatgcgg

SEQ ID NO: 980311 - DNA, 25 bp, Mus musculus
tggagtaacgcgactgcaaggacag

SEQ ID NO: 980312 - DNA, 25 bp, Mus musculus
tggagtaacgggactgcaaggacag

SEQ ID NO: 980313 - DNA, 25 bp, Mus musculus
tggagtaagcagagcagacctgcca

SEQ ID NO: 980314 - DNA, 25 bp, Mus musculus
tggagtaagcagaggagacctgcca

SEQ ID NO: 980315 - DNA, 25 bp, Mus musculus
tggagtacagcatcaataagccaag

SEQ ID NO: 980316 - DNA, 25 bp, Mus musculus
tggagtacaggatcaataagccaag

SEQ ID NO: 980317 - DNA, 25 bp, Mus musculus
tggagtatgatgatcgcaccccagc

SEQ ID NO: 980318 - DNA, 25 bp, Mus musculus
tggagtatgatgatggcaccccagc

SEQ ID NO: 980319 - DNA, 25 bp, Mus musculus
tggagtatgccacgtactacatgag

SEQ ID NO: 980320 - DNA, 25 bp, Mus musculus
tggagtatgccaggtactacatgag

SEQ ID NO: 980321 - DNA, 25 bp, Mus musculus
tggagtattctgcttcagtctcctc

SEQ ID NO: 980322 - DNA, 25 bp, Mus musculus
tggagtattctggttcagtctcctc

SEQ ID NO: 980323 - DNA, 25 bp, Mus musculus
tggagtcaaactgggtgtcgctggt

SEQ ID NO: 980324 - DNA, 25 bp, Mus musculus
tggagtcaaagtgggtgtcgctggt

SEQ ID NO: 980325 - DNA, 25 bp, Mus musculus
tggagtccttcacaagcttatccat

SEQ ID NO: 980326 - DNA, 25 bp, Mus musculus
tggagtccttcagaagcttatccat

SEQ ID NO: 980327 - DNA, 25 bp, Mus musculus
tggagtctatgtcacacagggaaca

SEQ ID NO: 980328 - DNA, 25 bp, Mus musculus
tggagtctatgtcagacagggaaca

SEQ ID NO: 980329 - DNA, 25 bp, Mus musculus
tggagtctcaagcggatattgtgtt

SEQ ID NO: 980330 - DNA, 25 bp, Mus musculus
tggagtctcaaggggatattgtgtt

SEQ ID NO: 980331 - DNA, 25 bp, Mus musculus
tggagtctccttcacttaatgtatc

SEQ ID NO: 980332 - DNA, 25 bp, Mus musculus
tggagtctccttcagttaatgtatc

SEQ ID NO: 980333 - DNA, 25 bp, Mus musculus
tggagtgaggaaaatggcacaccat

SEQ ID NO: 980334 - DNA, 25 bp, Mus musculus
tggagtgaggacaagggtcttctat

SEQ ID NO: 980335 - DNA, 25 bp, Mus musculus
tggagtgaggagaagaaacactgcc

SEQ ID NO: 980336 - DNA, 25 bp, Mus musculus
tggagtgaggtaaatggcacaccat

SEQ ID NO: 980337 - DNA, 25 bp, Mus musculus
tggagtgaggtcaagggtcttctat

SEQ ID NO: 980338 - DNA, 25 bp, Mus musculus
tggagtgaggtgaagaaacactgcc

SEQ ID NO: 980339 - DNA, 25 bp, Mus musculus
tggagtgcctcagtcaagaaactga

SEQ ID NO: 980340 - DNA, 25 bp, Mus musculus
tggagtgcctcagtcgtggtgagct

SEQ ID NO: 980341 - DNA, 25 bp, Mus musculus
tggagtgcctcagtgaagaaactga

SEQ ID NO: 980342 - DNA, 25 bp, Mus musculus
tggagtgcctcagtggtggtgagct

SEQ ID NO: 980343 - DNA, 25 bp, Mus musculus
tggagtgcgtggacgtggatgagtg

SEQ ID NO: 980344 - DNA, 25 bp, Mus musculus
tggagtgcgtggtcgtggatgagtg

SEQ ID NO: 980345 - DNA, 25 bp, Mus musculus
tggagtgggatgcccatgacttccg

SEQ ID NO: 980346 - DNA, 25 bp, Mus musculus
tggagtgggatgccgatgacttccg

SEQ ID NO: 980347 - DNA, 25 bp, Mus musculus
tggagttaagaggctaaaagccaag

SEQ ID NO: 980348 - DNA, 25 bp, Mus musculus
tggagttaagcacggaaataaccag

SEQ ID NO: 980349 - DNA, 25 bp, Mus musculus
tggagttaaggacggaaataaccag

SEQ ID NO: 980350 - DNA, 25 bp, Mus musculus
tggagttaagtggctaaaagccaag

SEQ ID NO: 980351 - DNA, 25 bp, Mus musculus
tggagttagccacaatggagaatgg

SEQ ID NO: 980352 - DNA, 25 bp, Mus musculus
tggagttagccagaatggagaatgg

SEQ ID NO: 980353 - DNA, 25 bp, Mus musculus
tggagttatttacacaagatcctga

SEQ ID NO: 980354 - DNA, 25 bp, Mus musculus
tggagttatttagacaagatcctga

SEQ ID NO: 980355 - DNA, 25 bp, Mus musculus
tggagttcatggctcctgagatggt

SEQ ID NO: 980356 - DNA, 25 bp, Mus musculus
tggagttcatgggtcctgagatggt

SEQ ID NO: 980357 - DNA, 25 bp, Mus musculus
tggagttccgcgaaaggcaggcgat

SEQ ID NO: 980358 - DNA, 25 bp, Mus musculus
tggagttccgggaaaggcaggcgat

SEQ ID NO: 980359 - DNA, 25 bp, Mus musculus
tggataaacaattgctgtgtctaat

SEQ ID NO: 980360 - DNA, 25 bp, Mus musculus
tggataaacatttgctgtgtctaat

SEQ ID NO: 980361 - DNA, 25 bp, Mus musculus
tggataacagagcctccggagccag

SEQ ID NO: 980362 - DNA, 25 bp, Mus musculus
tggataacagtgcctccggagccag

SEQ ID NO: 980363 - DNA, 25 bp, Mus musculus
tggataagattgttattcagaaata

SEQ ID NO: 980364 - DNA, 25 bp, Mus musculus
tggataagattgtttttcagaaata

SEQ ID NO: 980365 - DNA, 25 bp, Mus musculus
tggataattccaatcatgttgcaaa

SEQ ID NO: 980366 - DNA, 25 bp, Mus musculus
tggataattccaatgatgttgcaaa

SEQ ID NO: 980367 - DNA, 25 bp, Mus musculus
tggatacagagaatcttcaccattg

SEQ ID NO: 980368 - DNA, 25 bp, Mus musculus
tggatacagagattcttcaccattg

SEQ ID NO: 980369 - DNA, 25 bp, Mus musculus
tggataccacagccaccttcaagat

SEQ ID NO: 980370 - DNA, 25 bp, Mus musculus
tggataccacaggcaccttcaagat

SEQ ID NO: 980371 - DNA, 25 bp, Mus musculus
tggataccagtgcgcttcccgagga

SEQ ID NO: 980372 - DNA, 25 bp, Mus musculus
tggataccagtgggcttcccgagga

SEQ ID NO: 980373 - DNA, 25 bp, Mus musculus
tggatactaaagagtcttgtcctgt

SEQ ID NO: 980374 - DNA, 25 bp, Mus musculus
tggatactaaagtgtcttgtcctgt

SEQ ID NO: 980375 - DNA, 25 bp, Mus musculus
tggatatactcaaacggcagcacat

SEQ ID NO: 980376 - DNA, 25 bp, Mus musculus
tggatatactcaaacgtgttggggc

SEQ ID NO: 980377 - DNA, 25 bp, Mus musculus
tggatatactcaaagggcagcacat

SEQ ID NO: 980378 - DNA, 25 bp, Mus musculus
tggatatactcaaaggtgttggggc

SEQ ID NO: 980379 - DNA, 25 bp, Mus musculus
tggatatatgccggtgataacttat

SEQ ID NO: 980380 - DNA, 25 bp, Mus musculus
tggatatatggcggtgataacttat

SEQ ID NO: 980381 - DNA, 25 bp, Mus musculus
tggatatcaacgccctgcaccagga

SEQ ID NO: 980382 - DNA, 25 bp, Mus musculus
tggatatcaaggccctgcaccagga

SEQ ID NO: 980383 - DNA, 25 bp, Mus musculus
tggatatgagcaaacgtatgcagag

SEQ ID NO: 980384 - DNA, 25 bp, Mus musculus
tggatatgagcaaaggtatgcagag

SEQ ID NO: 980385 - DNA, 25 bp, Mus musculus
tggatatgagctccagagattcatt

SEQ ID NO: 980386 - DNA, 25 bp, Mus musculus
tggatatgaggtccagagattcatt

SEQ ID NO: 980387 - DNA, 25 bp, Mus musculus
tggatattagaaatgctacaaagct

SEQ ID NO: 980388 - DNA, 25 bp, Mus musculus
tggatattagaattgctacaaagct

SEQ ID NO: 980389 - DNA, 25 bp, Mus musculus
tggatcaataaacaagagatgatct

SEQ ID NO: 980390 - DNA, 25 bp, Mus musculus
tggatcaataaagaagagatgatct

SEQ ID NO: 980391 - DNA, 25 bp, Mus musculus
tggatcacactgcatgcagcctacc

SEQ ID NO: 980392 - DNA, 25 bp, Mus musculus
tggatcacactggatgcagcctacc

SEQ ID NO: 980393 - DNA, 25 bp, Mus musculus
tggatcacagcagaaaataatgaat

SEQ ID NO: 980394 - DNA, 25 bp, Mus musculus
tggatcacagctacctggaactgga

SEQ ID NO: 980395 - DNA, 25 bp, Mus musculus
tggatcacagctgcgaccgagggcc

SEQ ID NO: 980396 - DNA, 25 bp, Mus musculus
tggatcacaggagaaaataatgaat

SEQ ID NO: 980397 - DNA, 25 bp, Mus musculus
tggatcacaggtacctggaactgga

SEQ ID NO: 980398 - DNA, 25 bp, Mus musculus
tggatcacaggtgcgaccgagggcc

SEQ ID NO: 980399 - DNA, 25 bp, Mus musculus
tggatcacatggagggcctagagca

SEQ ID NO: 980400 - DNA, 25 bp, Mus musculus
tggatcacatggtgggcctagagca

SEQ ID NO: 980401 - DNA, 25 bp, Mus musculus
tggatcagaccacacgttctcccct

SEQ ID NO: 980402 - DNA, 25 bp, Mus musculus
tggatcagaccacacgtttgtccag

SEQ ID NO: 980403 - DNA, 25 bp, Mus musculus
tggatcagaccacaggttctcccct

SEQ ID NO: 980404 - DNA, 25 bp, Mus musculus
tggatcagaccacaggtttgtccag

SEQ ID NO: 980405 - DNA, 25 bp, Mus musculus
tggatcagcccatgacagagattgt

SEQ ID NO: 980406 - DNA, 25 bp, Mus musculus
tggatcagccgatgacagagattgt

SEQ ID NO: 980407 - DNA, 25 bp, Mus musculus
tggatcagtgattctagatggcaaa

SEQ ID NO: 980408 - DNA, 25 bp, Mus musculus
tggatcagtgtttctagatggcaaa

SEQ ID NO: 980409 - DNA, 25 bp, Mus musculus
tggatcatataatagagaagaagcg

SEQ ID NO: 980410 - DNA, 25 bp, Mus musculus
tggatcatattatagagaagaagcg

SEQ ID NO: 980411 - DNA, 25 bp, Mus musculus
tggatcatcactgcccctggctaaa

SEQ ID NO: 980412 - DNA, 25 bp, Mus musculus
tggatcatcactgcgcctggctaaa

SEQ ID NO: 980413 - DNA, 25 bp, Mus musculus
tggatccacattgacggccggaatg

SEQ ID NO: 980414 - DNA, 25 bp, Mus musculus
tggatccacattgagggccggaatg

SEQ ID NO: 980415 - DNA, 25 bp, Mus musculus
tggatccagcaactggaccagagtt

SEQ ID NO: 980416 - DNA, 25 bp, Mus musculus
tggatccagcaagtggaccagagtt

SEQ ID NO: 980417 - DNA, 25 bp, Mus musculus
tggatccagcagctggaccagagct

SEQ ID NO: 980418 - DNA, 25 bp, Mus musculus
tggatccagcaggtggaccagagct

SEQ ID NO: 980419 - DNA, 25 bp, Mus musculus
tggatccagccgctggtcccaaacg

SEQ ID NO: 980420 - DNA, 25 bp, Mus musculus
tggatccagccggtggtcccaaacg

SEQ ID NO: 980421 - DNA, 25 bp, Mus musculus
tggatccagggacgaaaggatatgt

SEQ ID NO: 980422 - DNA, 25 bp, Mus musculus
tggatccagggaggaaaggatatgt

SEQ ID NO: 980423 - DNA, 25 bp, Mus musculus
tggatccctagataagaaagtctgg

SEQ ID NO: 980424 - DNA, 25 bp, Mus musculus
tggatccctagatatgaaagtctgg

SEQ ID NO: 980425 - DNA, 25 bp, Mus musculus
tggatcctctcaatcaattcctgga

SEQ ID NO: 980426 - DNA, 25 bp, Mus musculus
tggatcctctcaatgaattcctgga

SEQ ID NO: 980427 - DNA, 25 bp, Mus musculus
tggatccttgatcttagaatctttt

SEQ ID NO: 980428 - DNA, 25 bp, Mus musculus
tggatccttgcgggcaggtcctaac

SEQ ID NO: 980429 - DNA, 25 bp, Mus musculus
tggatccttgggggcaggtcctaac

SEQ ID NO: 980430 - DNA, 25 bp, Mus musculus
tggatccttgttcttagaatctttt

SEQ ID NO: 980431 - DNA, 25 bp, Mus musculus
tggatcgaaaactccgatttgttga

SEQ ID NO: 980432 - DNA, 25 bp, Mus musculus
tggatcgaaaactcggatttgttga

SEQ ID NO: 980433 - DNA, 25 bp, Mus musculus
tggatcgaagccacggagggagttg

SEQ ID NO: 980434 - DNA, 25 bp, Mus musculus
tggatcgaaggcacggagggagttg

SEQ ID NO: 980435 - DNA, 25 bp, Mus musculus
tggatcgctgtccacctcgtagtgc

SEQ ID NO: 980436 - DNA, 25 bp, Mus musculus
tggatcgctgtccacgagctggaga

SEQ ID NO: 980437 - DNA, 25 bp, Mus musculus
tggatcgctgtccagctcgtagtgc

SEQ ID NO: 980438 - DNA, 25 bp, Mus musculus
tggatcgctgtccaggagctggaga

SEQ ID NO: 980439 - DNA, 25 bp, Mus musculus
tggatctcataacagaggagccaaa

SEQ ID NO: 980440 - DNA, 25 bp, Mus musculus
tggatctcataagagaggagccaaa

SEQ ID NO: 980441 - DNA, 25 bp, Mus musculus
tggatctgaataagtgcggacctat

SEQ ID NO: 980442 - DNA, 25 bp, Mus musculus
tggatctgaatatgtgcggacctat

SEQ ID NO: 980443 - DNA, 25 bp, Mus musculus
tggatctggataaacagttcaggaa

SEQ ID NO: 980444 - DNA, 25 bp, Mus musculus
tggatctggataaagagttcaggaa

SEQ ID NO: 980445 - DNA, 25 bp, Mus musculus
tggatcttcagaaatactgggactt

SEQ ID NO: 980446 - DNA, 25 bp, Mus musculus
tggatcttcagatatactgggactt

SEQ ID NO: 980447 - DNA, 25 bp, Mus musculus
tggatgaaagataagcagtccctgc

SEQ ID NO: 980448 - DNA, 25 bp, Mus musculus
tggatgaaagctcgagatttcaggt

SEQ ID NO: 980449 - DNA, 25 bp, Mus musculus
tggatgaaaggtcgagatttcaggt

SEQ ID NO: 980450 - DNA, 25 bp, Mus musculus
tggatgaaagttaagcagtccctgc

SEQ ID NO: 980451 - DNA, 25 bp, Mus musculus
tggatgaaattgatcaggctcgtgt

SEQ ID NO: 980452 - DNA, 25 bp, Mus musculus
tggatgaaattgatgaggctcgtgt

SEQ ID NO: 980453 - DNA, 25 bp, Mus musculus
tggatgaaggctagctacagtttct

SEQ ID NO: 980454 - DNA, 25 bp, Mus musculus
tggatgaaggcttgctacagtttct

SEQ ID NO: 980455 - DNA, 25 bp, Mus musculus
tggatgaatattcagttagaacaca

SEQ ID NO: 980456 - DNA, 25 bp, Mus musculus
tggatgaatattgagttagaacaca

SEQ ID NO: 980457 - DNA, 25 bp, Mus musculus
tggatgaattagctggactcttggc

SEQ ID NO: 980458 - DNA, 25 bp, Mus musculus
tggatgaattcaagccccacaggaa

SEQ ID NO: 980459 - DNA, 25 bp, Mus musculus
tggatgaattgaagccccacaggaa

SEQ ID NO: 980460 - DNA, 25 bp, Mus musculus
tggatgaatttgctggactcttggc

SEQ ID NO: 980461 - DNA, 25 bp, Mus musculus
tggatgaccagacagtgatgtggag

SEQ ID NO: 980462 - DNA, 25 bp, Mus musculus
tggatgaccagacccccgggcctct

SEQ ID NO: 980463 - DNA, 25 bp, Mus musculus
tggatgaccagagagtgatgtggag

SEQ ID NO: 980464 - DNA, 25 bp, Mus musculus
tggatgaccagagccccgggcctct

SEQ ID NO: 980465 - DNA, 25 bp, Mus musculus
tggatgacctagccaagtcggcttt

SEQ ID NO: 980466 - DNA, 25 bp, Mus musculus
tggatgacctaggcaagtcggcttt

SEQ ID NO: 980467 - DNA, 25 bp, Mus musculus
tggatgacctggaacccctcgtcaa

SEQ ID NO: 980468 - DNA, 25 bp, Mus musculus
tggatgacctggaagccctcgtcaa

SEQ ID NO: 980469 - DNA, 25 bp, Mus musculus
tggatgactgaagctggccccgttt

SEQ ID NO: 980470 - DNA, 25 bp, Mus musculus
tggatgactgcgcagccacgccccg

SEQ ID NO: 980471 - DNA, 25 bp, Mus musculus
tggatgactgggcagccacgccccg

SEQ ID NO: 980472 - DNA, 25 bp, Mus musculus
tggatgactgtagctggccccgttt

SEQ ID NO: 980473 - DNA, 25 bp, Mus musculus
tggatgagaatgaatgcagagtcat

SEQ ID NO: 980474 - DNA, 25 bp, Mus musculus
tggatgagaatgtatgcagagtcat

SEQ ID NO: 980475 - DNA, 25 bp, Mus musculus
tggatgagcgcaggctgtactacga

SEQ ID NO: 980476 - DNA, 25 bp, Mus musculus
tggatgagcgcagggtgtactacga

SEQ ID NO: 980477 - DNA, 25 bp, Mus musculus
tggatgaggcctcacgcacctgcga

SEQ ID NO: 980478 - DNA, 25 bp, Mus musculus
tggatgaggcctcaggcacctgcga

SEQ ID NO: 980479 - DNA, 25 bp, Mus musculus
tggatgaggtcacatatgggggctt

SEQ ID NO: 980480 - DNA, 25 bp, Mus musculus
tggatgaggtcagatatgggggctt

SEQ ID NO: 980481 - DNA, 25 bp, Mus musculus
tggatgataagaatctgtatgttct

SEQ ID NO: 980482 - DNA, 25 bp, Mus musculus
tggatgataagaatgtgtatgttct

SEQ ID NO: 980483 - DNA, 25 bp, Mus musculus
tggatgatacctcgaaaaatggtga

SEQ ID NO: 980484 - DNA, 25 bp, Mus musculus
tggatgatacctggaaaaatggtga

SEQ ID NO: 980485 - DNA, 25 bp, Mus musculus
tggatgatgccaacatgtgcattgc

SEQ ID NO: 980486 - DNA, 25 bp, Mus musculus
tggatgatgccatcatgtgcattgc

SEQ ID NO: 980487 - DNA, 25 bp, Mus musculus
tggatgatgtcttcctgcgggtgct

SEQ ID NO: 980488 - DNA, 25 bp, Mus musculus
tggatgatgtgttcctgcgggtgct

SEQ ID NO: 980489 - DNA, 25 bp, Mus musculus
tggatgccactgctaagaccacact

SEQ ID NO: 980490 - DNA, 25 bp, Mus musculus
tggatgccactgctactggcatagc

SEQ ID NO: 980491 - DNA, 25 bp, Mus musculus
tggatgccactggtaagaccacact

SEQ ID NO: 980492 - DNA, 25 bp, Mus musculus
tggatgccactggtactggcatagc

SEQ ID NO: 980493 - DNA, 25 bp, Mus musculus
tggatgccagatgacgatcatggct

SEQ ID NO: 980494 - DNA, 25 bp, Mus musculus
tggatgccagatgaggatcatggct

SEQ ID NO: 980495 - DNA, 25 bp, Mus musculus
tggatgccatcacgtctctggcttc

SEQ ID NO: 980496 - DNA, 25 bp, Mus musculus
tggatgccatcaggtctctggcttc

SEQ ID NO: 980497 - DNA, 25 bp, Mus musculus
tggatgccccagatttataggcaat

SEQ ID NO: 980498 - DNA, 25 bp, Mus musculus
tggatgccccagcaactggatgcct

SEQ ID NO: 980499 - DNA, 25 bp, Mus musculus
tggatgccccaggaactggatgcct

SEQ ID NO: 980500 - DNA, 25 bp, Mus musculus
tggatgccccagttttataggcaat

SEQ ID NO: 980501 - DNA, 25 bp, Mus musculus
tggatgcgtctacgtcttccaagtt

SEQ ID NO: 980502 - DNA, 25 bp, Mus musculus
tggatgcgtctaggtcttccaagtt

SEQ ID NO: 980503 - DNA, 25 bp, Mus musculus
tggatgctcctgaacgctgggtggt

SEQ ID NO: 980504 - DNA, 25 bp, Mus musculus
tggatgctcctgaaggctgggtggt

SEQ ID NO: 980505 - DNA, 25 bp, Mus musculus
tggatgctgaaactctatgccatgt

SEQ ID NO: 980506 - DNA, 25 bp, Mus musculus
tggatgctgaaactgtatgccatgt

SEQ ID NO: 980507 - DNA, 25 bp, Mus musculus
tggatgctgactcggacaccaagca

SEQ ID NO: 980508 - DNA, 25 bp, Mus musculus
tggatgctgactgggacaccaagca

SEQ ID NO: 980509 - DNA, 25 bp, Mus musculus
tggatgctgaggacatcgtgaacac

SEQ ID NO: 980510 - DNA, 25 bp, Mus musculus
tggatgctgaggatattgtaggcac

SEQ ID NO: 980511 - DNA, 25 bp, Mus musculus
tggatgctgaggccactctgaggcc

SEQ ID NO: 980512 - DNA, 25 bp, Mus musculus
tggatgctgagggcactctgaggcc

SEQ ID NO: 980513 - DNA, 25 bp, Mus musculus
tggatgctgaggtcatcgtgaacac

SEQ ID NO: 980514 - DNA, 25 bp, Mus musculus
tggatgctgaggttattgtaggcac

SEQ ID NO: 980515 - DNA, 25 bp, Mus musculus
tggatgctgatgagttcttgaccat

SEQ ID NO: 980516 - DNA, 25 bp, Mus musculus
tggatgctgatgccaatggcaccat

SEQ ID NO: 980517 - DNA, 25 bp, Mus musculus
tggatgctgatgccaatgggaccat

SEQ ID NO: 980518 - DNA, 25 bp, Mus musculus
tggatgctgatggcaatggcaccat

SEQ ID NO: 980519 - DNA, 25 bp, Mus musculus
tggatgctgatggcaatgggaccat

SEQ ID NO: 980520 - DNA, 25 bp, Mus musculus
tggatgctgatgtgttcttgaccat

SEQ ID NO: 980521 - DNA, 25 bp, Mus musculus
tggatgctgattcgatttgctatct

SEQ ID NO: 980522 - DNA, 25 bp, Mus musculus
tggatgctgattggatttgctatct

SEQ ID NO: 980523 - DNA, 25 bp, Mus musculus
tggatgctgtgacacatgcaagaaa

SEQ ID NO: 980524 - DNA, 25 bp, Mus musculus
tggatgctgtgagacatgcaagaaa

SEQ ID NO: 980525 - DNA, 25 bp, Mus musculus
tggatggaagcacaactcttcctaa

SEQ ID NO: 980526 - DNA, 25 bp, Mus musculus
tggatggaagcagaactcttcctaa

SEQ ID NO: 980527 - DNA, 25 bp, Mus musculus
tggatggagccttgcatgaagttgt

SEQ ID NO: 980528 - DNA, 25 bp, Mus musculus
tggatggagccttggatgaagttgt

SEQ ID NO: 980529 - DNA, 25 bp, Mus musculus
tggatggagtcacggatgacgactc

SEQ ID NO: 980530 - DNA, 25 bp, Mus musculus
tggatggagtgacggatgacgactc

SEQ ID NO: 980531 - DNA, 25 bp, Mus musculus
tggatggagtgtaactggcggcccc

SEQ ID NO: 980532 - DNA, 25 bp, Mus musculus
tggatggagtgtaagtggcggcccc

SEQ ID NO: 980533 - DNA, 25 bp, Mus musculus
tggatggccgagccaaagcaacaat

SEQ ID NO: 980534 - DNA, 25 bp, Mus musculus
tggatggccgaggcaaagcaacaat

SEQ ID NO: 980535 - DNA, 25 bp, Mus musculus
tggatgggatcgtctcgctggctga

SEQ ID NO: 980536 - DNA, 25 bp, Mus musculus
tggatgggatggtctcgctggctga

SEQ ID NO: 980537 - DNA, 25 bp, Mus musculus
tggatgggggctgtgccagccttcc

SEQ ID NO: 980538 - DNA, 25 bp, Mus musculus
tggatggggggtgtgccagccttcc

SEQ ID NO: 980539 - DNA, 25 bp, Mus musculus
tggatgggtcctaactgtctgctac

SEQ ID NO: 980540 - DNA, 25 bp, Mus musculus
tggatgggtccttactgtctgctac

SEQ ID NO: 980541 - DNA, 25 bp, Mus musculus
tggatgtctatgaacttgatcctaa

SEQ ID NO: 980542 - DNA, 25 bp, Mus musculus
tggatgtctatgtacttgatcctaa

SEQ ID NO: 980543 - DNA, 25 bp, Mus musculus
tggatgtgctggagcgctccccaca

SEQ ID NO: 980544 - DNA, 25 bp, Mus musculus
tggatgtgctggagcggtccccgca

SEQ ID NO: 980545 - DNA, 25 bp, Mus musculus
tggatgtgctggtgcgctccccaca

SEQ ID NO: 980546 - DNA, 25 bp, Mus musculus
tggatgtgctggtgcggtccccgca

SEQ ID NO: 980547 - DNA, 25 bp, Mus musculus
tggatgtgtatgcggagaagaaaca

SEQ ID NO: 980548 - DNA, 25 bp, Mus musculus
tggatgtgtatggggagaagaaaca

SEQ ID NO: 980549 - DNA, 25 bp, Mus musculus
tggatgttgtggcataccccttcat

SEQ ID NO: 980550 - DNA, 25 bp, Mus musculus
tggatgttgtgggataccccttcat

SEQ ID NO: 980551 - DNA, 25 bp, Mus musculus
tggatgtttgcacgcgagctataga

SEQ ID NO: 980552 - DNA, 25 bp, Mus musculus
tggatgtttgcaggcgagctataga

SEQ ID NO: 980553 - DNA, 25 bp, Mus musculus
tggattacagctgaccaggactgtc

SEQ ID NO: 980554 - DNA, 25 bp, Mus musculus
tggattacagctggtgctctgggtc

SEQ ID NO: 980555 - DNA, 25 bp, Mus musculus
tggattacaggtgaccaggactgtc

SEQ ID NO: 980556 - DNA, 25 bp, Mus musculus
tggattacaggtggtgctctgggtc

SEQ ID NO: 980557 - DNA, 25 bp, Mus musculus
tggattcaaacacgacctacatcag

SEQ ID NO: 980558 - DNA, 25 bp, Mus musculus
tggattcaaacaggacctacatcag

SEQ ID NO: 980559 - DNA, 25 bp, Mus musculus
tggattcactcacggtgatgttggg

SEQ ID NO: 980560 - DNA, 25 bp, Mus musculus
tggattcactcagggtgatgttggg

SEQ ID NO: 980561 - DNA, 25 bp, Mus musculus
tggattccagatgagaagactgaga

SEQ ID NO: 980562 - DNA, 25 bp, Mus musculus
tggattccagttgagaagactgaga

SEQ ID NO: 980563 - DNA, 25 bp, Mus musculus
tggattgaagaaaacgctaaagatc

SEQ ID NO: 980564 - DNA, 25 bp, Mus musculus
tggattgaagaaaaggctaaagatc

SEQ ID NO: 980565 - DNA, 25 bp, Mus musculus
tggattggaactcgtatgatgtcct

SEQ ID NO: 980566 - DNA, 25 bp, Mus musculus
tggattggaactggtatgatgtcct

SEQ ID NO: 980567 - DNA, 25 bp, Mus musculus
tggatttaaccacagctgtctgtct

SEQ ID NO: 980568 - DNA, 25 bp, Mus musculus
tggatttaaccagagctgtctgtct

SEQ ID NO: 980569 - DNA, 25 bp, Mus musculus
tggatttatcagaaacatacaagaa

SEQ ID NO: 980570 - DNA, 25 bp, Mus musculus
tggatttatcagtaacatacaagaa

SEQ ID NO: 980571 - DNA, 25 bp, Mus musculus
tggatttatccacgtgtgaaattga

SEQ ID NO: 980572 - DNA, 25 bp, Mus musculus
tggatttatccaggtgtgaaattga

SEQ ID NO: 980573 - DNA, 25 bp, Mus musculus
tggatttatgaccactgatgctgct

SEQ ID NO: 980574 - DNA, 25 bp, Mus musculus
tggatttatgacgactgatgctgct

SEQ ID NO: 980575 - DNA, 25 bp, Mus musculus
tggatttccacgcagtagaggcccg

SEQ ID NO: 980576 - DNA, 25 bp, Mus musculus
tggatttccacgccgtggtattcca

SEQ ID NO: 980577 - DNA, 25 bp, Mus musculus
tggatttccaggcagtagaggcccg

SEQ ID NO: 980578 - DNA, 25 bp, Mus musculus
tggatttccaggccgtggtattcca

SEQ ID NO: 980579 - DNA, 25 bp, Mus musculus
tggattttggaacacgcaacaatat

SEQ ID NO: 980580 - DNA, 25 bp, Mus musculus
tggattttggaacaggcaacaatat

SEQ ID NO: 980581 - DNA, 25 bp, Mus musculus
tggatttttgaacccatatgaaaat

SEQ ID NO: 980582 - DNA, 25 bp, Mus musculus
tggatttttgaagccatatgaaaat

SEQ ID NO: 980583 - DNA, 25 bp, Mus musculus
tggcaaaaagctatgtggacagcca

SEQ ID NO: 980584 - DNA, 25 bp, Mus musculus
tggcaaaaaggtatgtggacagcca

SEQ ID NO: 980585 - DNA, 25 bp, Mus musculus
tggcaaaagcactcagatcaccgag

SEQ ID NO: 980586 - DNA, 25 bp, Mus musculus
tggcaaaagctctcagatcaccgag

SEQ ID NO: 980587 - DNA, 25 bp, Mus musculus
tggcaaacctaaagcgtatgcattt

SEQ ID NO: 980588 - DNA, 25 bp, Mus musculus
tggcaaacctaaagggtatgcattt

SEQ ID NO: 980589 - DNA, 25 bp, Mus musculus
tggcaaacggcagagcaaacgaagc

SEQ ID NO: 980590 - DNA, 25 bp, Mus musculus
tggcaaacgggagagcaaacgaagc

SEQ ID NO: 980591 - DNA, 25 bp, Mus musculus
tggcaaactcagatccaatctcatg

SEQ ID NO: 980592 - DNA, 25 bp, Mus musculus
tggcaaactcagttccaatctcatg

SEQ ID NO: 980593 - DNA, 25 bp, Mus musculus
tggcaaaggaggcacctgcgattgg

SEQ ID NO: 980594 - DNA, 25 bp, Mus musculus
tggcaaaggaggcagctgcgattgg

SEQ ID NO: 980595 - DNA, 25 bp, Mus musculus
tggcaaaggatctacatgagaatga

SEQ ID NO: 980596 - DNA, 25 bp, Mus musculus
tggcaaaggatctagatgagaatga

SEQ ID NO: 980597 - DNA, 25 bp, Mus musculus
tggcaaaggcagcatctattcccag

SEQ ID NO: 980598 - DNA, 25 bp, Mus musculus
tggcaaaggcaggatctattcccag

SEQ ID NO: 980599 - DNA, 25 bp, Mus musculus
tggcaaaggcttttcgggcaggggc

SEQ ID NO: 980600 - DNA, 25 bp, Mus musculus
tggcaaaggcttttcgggctgactt

SEQ ID NO: 980601 - DNA, 25 bp, Mus musculus
tggcaaaggcttttggggcaggggc

SEQ ID NO: 980602 - DNA, 25 bp, Mus musculus
tggcaaaggcttttggggctgactt

SEQ ID NO: 980603 - DNA, 25 bp, Mus musculus
tggcaaatgatgagagttctagaag

SEQ ID NO: 980604 - DNA, 25 bp, Mus musculus
tggcaaatgatgtgagttctagaag

SEQ ID NO: 980605 - DNA, 25 bp, Mus musculus
tggcaacaggctctctgtgatgagc

SEQ ID NO: 980606 - DNA, 25 bp, Mus musculus
tggcaacagggtctctgtgatgagc

SEQ ID NO: 980607 - DNA, 25 bp, Mus musculus
tggcaacattccacctccacctcct

SEQ ID NO: 980608 - DNA, 25 bp, Mus musculus
tggcaacattcctcctccacctcct

SEQ ID NO: 980609 - DNA, 25 bp, Mus musculus
tggcaacccacgtctcccgggagag

SEQ ID NO: 980610 - DNA, 25 bp, Mus musculus
tggcaacccaggtctcccgggagag

SEQ ID NO: 980611 - DNA, 25 bp, Mus musculus
tggcaacctgagcgtggccaggaac

SEQ ID NO: 980612 - DNA, 25 bp, Mus musculus
tggcaacctgagggtggccaggaac

SEQ ID NO: 980613 - DNA, 25 bp, Mus musculus
tggcaacctgcctaaaaccagcagc

SEQ ID NO: 980614 - DNA, 25 bp, Mus musculus
tggcaacctgcctataaccagcagc

SEQ ID NO: 980615 - DNA, 25 bp, Mus musculus
tggcaacgaccctgatattgaaatg

SEQ ID NO: 980616 - DNA, 25 bp, Mus musculus
tggcaacgacgctgatattgaaatg

SEQ ID NO: 980617 - DNA, 25 bp, Mus musculus
tggcaacgattcaacctcttgcttc

SEQ ID NO: 980618 - DNA, 25 bp, Mus musculus
tggcaacgattcaacgaggagcccc

SEQ ID NO: 980619 - DNA, 25 bp, Mus musculus
tggcaacgattcaagctcttgcttc

SEQ ID NO: 980620 - DNA, 25 bp, Mus musculus
tggcaacgattcaaggaggagcccc

SEQ ID NO: 980621 - DNA, 25 bp, Mus musculus
tggcaactcaggattgcagcaggag

SEQ ID NO: 980622 - DNA, 25 bp, Mus musculus
tggcaactcaggtttgcagcaggag

SEQ ID NO: 980623 - DNA, 25 bp, Mus musculus
tggcaactcttattcggctgtgcct

SEQ ID NO: 980624 - DNA, 25 bp, Mus musculus
tggcaactcttattcttggaaatct

SEQ ID NO: 980625 - DNA, 25 bp, Mus musculus
tggcaactcttattgggctgtgcct

SEQ ID NO: 980626 - DNA, 25 bp, Mus musculus
tggcaactcttattgttggaaatct

SEQ ID NO: 980627 - DNA, 25 bp, Mus musculus
tggcaactttcactgctgcttaagt

SEQ ID NO: 980628 - DNA, 25 bp, Mus musculus
tggcaactttcagtgctgcttaagt

SEQ ID NO: 980629 - DNA, 25 bp, Mus musculus
tggcaagagactgctaacagccaaa

SEQ ID NO: 980630 - DNA, 25 bp, Mus musculus
tggcaagagagtgctaacagccaaa

SEQ ID NO: 980631 - DNA, 25 bp, Mus musculus
tggcaagaggaacgctgttgtccct

SEQ ID NO: 980632 - DNA, 25 bp, Mus musculus
tggcaagaggaaggctgttgtccct

SEQ ID NO: 980633 - DNA, 25 bp, Mus musculus
tggcaagaggcgatcactatttatg

SEQ ID NO: 980634 - DNA, 25 bp, Mus musculus
tggcaagaggggatcactatttatg

SEQ ID NO: 980635 - DNA, 25 bp, Mus musculus
tggcaagcaaatcaatgatgagaag

SEQ ID NO: 980636 - DNA, 25 bp, Mus musculus
tggcaagcaaatgaatgatgagaag

SEQ ID NO: 980637 - DNA, 25 bp, Mus musculus
tggcaagcaagaacaaggatgagag

SEQ ID NO: 980638 - DNA, 25 bp, Mus musculus
tggcaagcaagatcaaggatgagag

SEQ ID NO: 980639 - DNA, 25 bp, Mus musculus
tggcaagcagctggagctggctctg

SEQ ID NO: 980640 - DNA, 25 bp, Mus musculus
tggcaagcaggtggagctggctctg

SEQ ID NO: 980641 - DNA, 25 bp, Mus musculus
tggcaagccgaacggcctggcgtat

SEQ ID NO: 980642 - DNA, 25 bp, Mus musculus
tggcaagccgaagggcctggcgtat

SEQ ID NO: 980643 - DNA, 25 bp, Mus musculus
tggcaataagctgagccagctcaag

SEQ ID NO: 980644 - DNA, 25 bp, Mus musculus
tggcaataaggtgagccagctcaag

SEQ ID NO: 980645 - DNA, 25 bp, Mus musculus
tggcaatatgatgccaacccctttc

SEQ ID NO: 980646 - DNA, 25 bp, Mus musculus
tggcaatatgttgccaacccctttc

SEQ ID NO: 980647 - DNA, 25 bp, Mus musculus
tggcaatcaagacgatgaagagaaa

SEQ ID NO: 980648 - DNA, 25 bp, Mus musculus
tggcaatcaagaggatgaagagaaa

SEQ ID NO: 980649 - DNA, 25 bp, Mus musculus
tggcaatccagtcccccagcagtac

SEQ ID NO: 980650 - DNA, 25 bp, Mus musculus
tggcaatccagtgccccagcagtac

SEQ ID NO: 980651 - DNA, 25 bp, Mus musculus
tggcaatctgaaatagtgattggac

SEQ ID NO: 980652 - DNA, 25 bp, Mus musculus
tggcaatctgaaattgtgattggac

SEQ ID NO: 980653 - DNA, 25 bp, Mus musculus
tggcaatgccagctggcccagagtg

SEQ ID NO: 980654 - DNA, 25 bp, Mus musculus
tggcaatgccagcttgaacgacatg

SEQ ID NO: 980655 - DNA, 25 bp, Mus musculus
tggcaatgccaggtggcccagagtg

SEQ ID NO: 980656 - DNA, 25 bp, Mus musculus
tggcaatgccaggttgaacgacatg

SEQ ID NO: 980657 - DNA, 25 bp, Mus musculus
tggcaattgccaaggaactgaaata

SEQ ID NO: 980658 - DNA, 25 bp, Mus musculus
tggcaattgccatggaactgaaata

SEQ ID NO: 980659 - DNA, 25 bp, Mus musculus
tggcacagacatcatggtgggcatt

SEQ ID NO: 980660 - DNA, 25 bp, Mus musculus
tggcacagacatgatggtgggcatt

SEQ ID NO: 980661 - DNA, 25 bp, Mus musculus
tggcacccagacctccctccatgaa

SEQ ID NO: 980662 - DNA, 25 bp, Mus musculus
tggcacccagacctgcctccatgaa

SEQ ID NO: 980663 - DNA, 25 bp, Mus musculus
tggcacccagccacggagggagttg

SEQ ID NO: 980664 - DNA, 25 bp, Mus musculus
tggcacccagccgcgaagggagctg

SEQ ID NO: 980665 - DNA, 25 bp, Mus musculus
tggcacccaggcacggagggagttg

SEQ ID NO: 980666 - DNA, 25 bp, Mus musculus
tggcacccaggcgcgaagggagctg

SEQ ID NO: 980667 - DNA, 25 bp, Mus musculus
tggcacccgagctacgggaagacac

SEQ ID NO: 980668 - DNA, 25 bp, Mus musculus
tggcacccgagctaggggaagacac

SEQ ID NO: 980669 - DNA, 25 bp, Mus musculus
tggcaccctcagcaccgcgtccacc

SEQ ID NO: 980670 - DNA, 25 bp, Mus musculus
tggcaccctcaggaccgcgtccacc

SEQ ID NO: 980671 - DNA, 25 bp, Mus musculus
tggcaccgcgaactcagtacacaac

SEQ ID NO: 980672 - DNA, 25 bp, Mus musculus
tggcaccgcgaagtcagtacacaac

SEQ ID NO: 980673 - DNA, 25 bp, Mus musculus
tggcaccgctcacagactctgggag

SEQ ID NO: 980674 - DNA, 25 bp, Mus musculus
tggcaccgctcagagactctgggag

SEQ ID NO: 980675 - DNA, 25 bp, Mus musculus
tggcacctgaggacaaagtctggag

SEQ ID NO: 980676 - DNA, 25 bp, Mus musculus
tggcacctgaggtcaaagtctggag

SEQ ID NO: 980677 - DNA, 25 bp, Mus musculus
tggcaccttgcgttaagactcctgt

SEQ ID NO: 980678 - DNA, 25 bp, Mus musculus
tggcaccttgcgtttagactcctgt

SEQ ID NO: 980679 - DNA, 25 bp, Mus musculus
tggcacgaaaacctagtttcgtcct

SEQ ID NO: 980680 - DNA, 25 bp, Mus musculus
tggcacgaaatcctagtttcgtcct

SEQ ID NO: 980681 - DNA, 25 bp, Mus musculus
tggcactaagcctggtgttcccggc

SEQ ID NO: 980682 - DNA, 25 bp, Mus musculus
tggcactaaggctggtgttcccggc

SEQ ID NO: 980683 - DNA, 25 bp, Mus musculus
tggcactcagcgagcatggcactct

SEQ ID NO: 980684 - DNA, 25 bp, Mus musculus
tggcactcagggagcatggcactct

SEQ ID NO: 980685 - DNA, 25 bp, Mus musculus
tggcactgattgctgctgtcagatg

SEQ ID NO: 980686 - DNA, 25 bp, Mus musculus
tggcactgattggtgctgtcagatg

SEQ ID NO: 980687 - DNA, 25 bp, Mus musculus
tggcactgtcagatcaaacctggac

SEQ ID NO: 980688 - DNA, 25 bp, Mus musculus
tggcactgtcagttcaaacctggac

SEQ ID NO: 980689 - DNA, 25 bp, Mus musculus
tggcactgtgtgcatcaactgctac

SEQ ID NO: 980690 - DNA, 25 bp, Mus musculus
tggcactgtgtggatcaactgctac

SEQ ID NO: 980691 - DNA, 25 bp, Mus musculus
tggcagaaggatctctctcttgcct

SEQ ID NO: 980692 - DNA, 25 bp, Mus musculus
tggcagaaggcacacatggacagat

SEQ ID NO: 980693 - DNA, 25 bp, Mus musculus
tggcagaaggcacacgtgaaggaga

SEQ ID NO: 980694 - DNA, 25 bp, Mus musculus
tggcagaaggcacagatggacagat

SEQ ID NO: 980695 - DNA, 25 bp, Mus musculus
tggcagaaggcacaggtgaaggaga

SEQ ID NO: 980696 - DNA, 25 bp, Mus musculus
tggcagaaggttctctctcttgcct

SEQ ID NO: 980697 - DNA, 25 bp, Mus musculus
tggcagagaactaggagaatatgct

SEQ ID NO: 980698 - DNA, 25 bp, Mus musculus
tggcagagaacttggagaatatgct

SEQ ID NO: 980699 - DNA, 25 bp, Mus musculus
tggcagagctgtgacgccttgagag

SEQ ID NO: 980700 - DNA, 25 bp, Mus musculus
tggcagagctgtgaggccttgagag

SEQ ID NO: 980701 - DNA, 25 bp, Mus musculus
tggcagaggacaagtcttcgttgag

SEQ ID NO: 980702 - DNA, 25 bp, Mus musculus
tggcagaggacatgtcttcgttgag

SEQ ID NO: 980703 - DNA, 25 bp, Mus musculus
tggcagagtcaaagtgttctgagct

SEQ ID NO: 980704 - DNA, 25 bp, Mus musculus
tggcagagtcccgttgccgagagat

SEQ ID NO: 980705 - DNA, 25 bp, Mus musculus
tggcagagtcctcgttgtgttagtc

SEQ ID NO: 980706 - DNA, 25 bp, Mus musculus
tggcagagtcctggttgtgttagtc

SEQ ID NO: 980707 - DNA, 25 bp, Mus musculus
tggcagagtcgcgttgccgagagat

SEQ ID NO: 980708 - DNA, 25 bp, Mus musculus
tggcagagtctaagtgttctgagct

SEQ ID NO: 980709 - DNA, 25 bp, Mus musculus
tggcagatgacacgctgctcaggat

SEQ ID NO: 980710 - DNA, 25 bp, Mus musculus
tggcagatgacaggctgctcaggat

SEQ ID NO: 980711 - DNA, 25 bp, Mus musculus
tggcagatttcgctctggcaagagc

SEQ ID NO: 980712 - DNA, 25 bp, Mus musculus
tggcagatttcggtctggcaagagc

SEQ ID NO: 980713 - DNA, 25 bp, Mus musculus
tggcagcaccggcctaaagaagccc

SEQ ID NO: 980714 - DNA, 25 bp, Mus musculus
tggcagcaccgggctaaagaagccc

SEQ ID NO: 980715 - DNA, 25 bp, Mus musculus
tggcagccaaccgaatctatgagat

SEQ ID NO: 980716 - DNA, 25 bp, Mus musculus
tggcagccaagcgaatctatgagat

SEQ ID NO: 980717 - DNA, 25 bp, Mus musculus
tggcagccagactcagtcctctgag

SEQ ID NO: 980718 - DNA, 25 bp, Mus musculus
tggcagccagtctcagtcctctgag

SEQ ID NO: 980719 - DNA, 25 bp, Mus musculus
tggcagccccttgactatggcaaga

SEQ ID NO: 980720 - DNA, 25 bp, Mus musculus
tggcagccccttgagtatggcaaga

SEQ ID NO: 980721 - DNA, 25 bp, Mus musculus
tggcagctactccggacccgcagga

SEQ ID NO: 980722 - DNA, 25 bp, Mus musculus
tggcagctactcgggacccgcagga

SEQ ID NO: 980723 - DNA, 25 bp, Mus musculus
tggcagctggtacacgggctgtgaa

SEQ ID NO: 980724 - DNA, 25 bp, Mus musculus
tggcagctggtacaggggctgtgaa

SEQ ID NO: 980725 - DNA, 25 bp, Mus musculus
tggcagcttcagattcccttcaggg

SEQ ID NO: 980726 - DNA, 25 bp, Mus musculus
tggcagcttcagtttcccttcaggg

SEQ ID NO: 980727 - DNA, 25 bp, Mus musculus
tggcaggaatgaaccttggctccag

SEQ ID NO: 980728 - DNA, 25 bp, Mus musculus
tggcaggaatgatccttggctccag

SEQ ID NO: 980729 - DNA, 25 bp, Mus musculus
tggcaggacctaaacgattacatgc

SEQ ID NO: 980730 - DNA, 25 bp, Mus musculus
tggcaggacctaaaggattacatgc

SEQ ID NO: 980731 - DNA, 25 bp, Mus musculus
tggcaggaggcacaaaggatgagcg

SEQ ID NO: 980732 - DNA, 25 bp, Mus musculus
tggcaggaggcacgtcattcattca

SEQ ID NO: 980733 - DNA, 25 bp, Mus musculus
tggcaggaggcagaaaggatgagcg

SEQ ID NO: 980734 - DNA, 25 bp, Mus musculus
tggcaggaggcaggtcattcattca

SEQ ID NO: 980735 - DNA, 25 bp, Mus musculus
tggcaggatgcgagcctcctgccta

SEQ ID NO: 980736 - DNA, 25 bp, Mus musculus
tggcaggatgcgccaccgctgactg

SEQ ID NO: 980737 - DNA, 25 bp, Mus musculus
tggcaggatgggagcctcctgccta

SEQ ID NO: 980738 - DNA, 25 bp, Mus musculus
tggcaggatgggccaccgctgactg

SEQ ID NO: 980739 - DNA, 25 bp, Mus musculus
tggcaggccacaacgtggcccagga

SEQ ID NO: 980740 - DNA, 25 bp, Mus musculus
tggcaggccacatcgtggcccagga

SEQ ID NO: 980741 - DNA, 25 bp, Mus musculus
tggcaggctgcacgtaactagttct

SEQ ID NO: 980742 - DNA, 25 bp, Mus musculus
tggcaggctgcaggtaactagttct

SEQ ID NO: 980743 - DNA, 25 bp, Mus musculus
tggcaggggctcaacgcagacacgc

SEQ ID NO: 980744 - DNA, 25 bp, Mus musculus
tggcaggggctcaaggcagacacgc

SEQ ID NO: 980745 - DNA, 25 bp, Mus musculus
tggcagtaactgccaagaagacagc

SEQ ID NO: 980746 - DNA, 25 bp, Mus musculus
tggcagtaactggcaagaagacagc

SEQ ID NO: 980747 - DNA, 25 bp, Mus musculus
tggcagtagccaccccatggaagta

SEQ ID NO: 980748 - DNA, 25 bp, Mus musculus
tggcagtagccagcccatggaagta

SEQ ID NO: 980749 - DNA, 25 bp, Mus musculus
tggcagtgagatccgccatcgcgat

SEQ ID NO: 980750 - DNA, 25 bp, Mus musculus
tggcagtgagttccgccatcgcgat

SEQ ID NO: 980751 - DNA, 25 bp, Mus musculus
tggcatacccgacataaagactatt

SEQ ID NO: 980752 - DNA, 25 bp, Mus musculus
tggcatacccgagataaagactatt

SEQ ID NO: 980753 - DNA, 25 bp, Mus musculus
tggcatagttctttctaaaatgatc

SEQ ID NO: 980754 - DNA, 25 bp, Mus musculus
tggcatagttctttgtaaaatgatc

SEQ ID NO: 980755 - DNA, 25 bp, Mus musculus
tggcatcaagctgtcggccctgcgg

SEQ ID NO: 980756 - DNA, 25 bp, Mus musculus
tggcatcaagctttggatgctaaca

SEQ ID NO: 980757 - DNA, 25 bp, Mus musculus
tggcatcaaggacacatcaacaagg

SEQ ID NO: 980758 - DNA, 25 bp, Mus musculus
tggcatcaaggagacatcaacaagg

SEQ ID NO: 980759 - DNA, 25 bp, Mus musculus
tggcatcaaggtgtcggccctgcgg

SEQ ID NO: 980760 - DNA, 25 bp, Mus musculus
tggcatcaaggtttggatgctaaca

SEQ ID NO: 980761 - DNA, 25 bp, Mus musculus
tggcatcacgcgagacaatgtccga

SEQ ID NO: 980762 - DNA, 25 bp, Mus musculus
tggcatcacgggagacaatgtccga

SEQ ID NO: 980763 - DNA, 25 bp, Mus musculus
tggcatcatacaagattgtgtggcc

SEQ ID NO: 980764 - DNA, 25 bp, Mus musculus
tggcatcatacaagtttgtgtggcc

SEQ ID NO: 980765 - DNA, 25 bp, Mus musculus
tggcatcatgcaaatgacaatgatc

SEQ ID NO: 980766 - DNA, 25 bp, Mus musculus
tggcatcatgctgctcccccggcaa

SEQ ID NO: 980767 - DNA, 25 bp, Mus musculus
tggcatcatggaaatgacaatgatc

SEQ ID NO: 980768 - DNA, 25 bp, Mus musculus
tggcatcatggtgctcccccggcaa

SEQ ID NO: 980769 - DNA, 25 bp, Mus musculus
tggcatccacgacgagatgctgaag

SEQ ID NO: 980770 - DNA, 25 bp, Mus musculus
tggcatccacgaggagatgctgaag

SEQ ID NO: 980771 - DNA, 25 bp, Mus musculus
tggcatccagcacggttttctggct

SEQ ID NO: 980772 - DNA, 25 bp, Mus musculus
tggcatccagcagggttttctggct

SEQ ID NO: 980773 - DNA, 25 bp, Mus musculus
tggcatccagcgaccagagcacccc

SEQ ID NO: 980774 - DNA, 25 bp, Mus musculus
tggcatccagggaccagagcacccc

SEQ ID NO: 980775 - DNA, 25 bp, Mus musculus
tggcatcgagcaccttgtgaatatc

SEQ ID NO: 980776 - DNA, 25 bp, Mus musculus
tggcatcgaggaccttgtgaatatc

SEQ ID NO: 980777 - DNA, 25 bp, Mus musculus
tggcatcgggcatgaagaccgggag

SEQ ID NO: 980778 - DNA, 25 bp, Mus musculus
tggcatcggggatgaagaccgggag

SEQ ID NO: 980779 - DNA, 25 bp, Mus musculus
tggcatctaattcacatcatgattc

SEQ ID NO: 980780 - DNA, 25 bp, Mus musculus
tggcatctaattcagatcatgattc

SEQ ID NO: 980781 - DNA, 25 bp, Mus musculus
tggcatctcagacacgtgtttgccc

SEQ ID NO: 980782 - DNA, 25 bp, Mus musculus
tggcatctcagacaggtgtttgccc

SEQ ID NO: 980783 - DNA, 25 bp, Mus musculus
tggcatctgccccagctgaagaggt

SEQ ID NO: 980784 - DNA, 25 bp, Mus musculus
tggcatctgcccgagctgaagaggt

SEQ ID NO: 980785 - DNA, 25 bp, Mus musculus
tggcatgaaaagccccttgctgctg

SEQ ID NO: 980786 - DNA, 25 bp, Mus musculus
tggcatgaaaaggcccttgctgctg

SEQ ID NO: 980787 - DNA, 25 bp, Mus musculus
tggcatgaagattccctcaggtctc

SEQ ID NO: 980788 - DNA, 25 bp, Mus musculus
tggcatgaagtttccctcaggtctc

SEQ ID NO: 980789 - DNA, 25 bp, Mus musculus
tggcatgaggcacagccgctcagag

SEQ ID NO: 980790 - DNA, 25 bp, Mus musculus
tggcatgagggacagccgctcagag

SEQ ID NO: 980791 - DNA, 25 bp, Mus musculus
tggcatggcacccacgcacggaggg

SEQ ID NO: 980792 - DNA, 25 bp, Mus musculus
tggcatggcacccacgcgcgaaggg

SEQ ID NO: 980793 - DNA, 25 bp, Mus musculus
tggcatggcacccaggcacggaggg

SEQ ID NO: 980794 - DNA, 25 bp, Mus musculus
tggcatggcacccaggcgcgaaggg

SEQ ID NO: 980795 - DNA, 25 bp, Mus musculus
tggcatggcctgtgcggtggagtcc

SEQ ID NO: 980796 - DNA, 25 bp, Mus musculus
tggcatggcctgtggggtggagtcc

SEQ ID NO: 980797 - DNA, 25 bp, Mus musculus
tggcatggctatgtgagtgacatca

SEQ ID NO: 980798 - DNA, 25 bp, Mus musculus
tggcatggctttgtgagtgacatca

SEQ ID NO: 980799 - DNA, 25 bp, Mus musculus
tggcatgggatgcagagtctgtatt

SEQ ID NO: 980800 - DNA, 25 bp, Mus musculus
tggcatgggatgcgggacagctgtt

SEQ ID NO: 980801 - DNA, 25 bp, Mus musculus
tggcatgggatggagagtctgtatt

SEQ ID NO: 980802 - DNA, 25 bp, Mus musculus
tggcatgggatgggggacagctgtt

SEQ ID NO: 980803 - DNA, 25 bp, Mus musculus
tggcatggtagaaacatctaaaggg

SEQ ID NO: 980804 - DNA, 25 bp, Mus musculus
tggcatggtagaaacgcctttgtag

SEQ ID NO: 980805 - DNA, 25 bp, Mus musculus
tggcatggtagaaagatctaaaggg

SEQ ID NO: 980806 - DNA, 25 bp, Mus musculus
tggcatggtagaaaggcctttgtag

SEQ ID NO: 980807 - DNA, 25 bp, Mus musculus
tggcatgtggctcgacatgaacgaa

SEQ ID NO: 980808 - DNA, 25 bp, Mus musculus
tggcatgtggctggacatgaacgaa

SEQ ID NO: 980809 - DNA, 25 bp, Mus musculus
tggcatgttgcaatgaatgatgtcc

SEQ ID NO: 980810 - DNA, 25 bp, Mus musculus
tggcatgttggaatgaatgatgtcc

SEQ ID NO: 980811 - DNA, 25 bp, Mus musculus
tggcattaagcactgaatgcacagg

SEQ ID NO: 980812 - DNA, 25 bp, Mus musculus
tggcattaagcgctccacggggcgg

SEQ ID NO: 980813 - DNA, 25 bp, Mus musculus
tggcattaaggactgaatgcacagg

SEQ ID NO: 980814 - DNA, 25 bp, Mus musculus
tggcattaagggctccacggggcgg

SEQ ID NO: 980815 - DNA, 25 bp, Mus musculus
tggcattcctgacacccgacctctt

SEQ ID NO: 980816 - DNA, 25 bp, Mus musculus
tggcattcctgacagccgacctctt

SEQ ID NO: 980817 - DNA, 25 bp, Mus musculus
tggcattgatcccatttggaacatt

SEQ ID NO: 980818 - DNA, 25 bp, Mus musculus
tggcattgatccgatttggaacatt

SEQ ID NO: 980819 - DNA, 25 bp, Mus musculus
tggcattgatcgtgaccgaggtcca

SEQ ID NO: 980820 - DNA, 25 bp, Mus musculus
tggcattgatggtgaccgaggtcca

SEQ ID NO: 980821 - DNA, 25 bp, Mus musculus
tggcattgtgagggcagctgttgtg

SEQ ID NO: 980822 - DNA, 25 bp, Mus musculus
tggcattgtgagggctgttctgtag

SEQ ID NO: 980823 - DNA, 25 bp, Mus musculus
tggcattgtgaggggagctgttgtg

SEQ ID NO: 980824 - DNA, 25 bp, Mus musculus
tggcattgtgaggggtgttctgtag

SEQ ID NO: 980825 - DNA, 25 bp, Mus musculus
tggccaacactgcgtgctgggacct

SEQ ID NO: 980826 - DNA, 25 bp, Mus musculus
tggccaacactgggtgctgggacct

SEQ ID NO: 980827 - DNA, 25 bp, Mus musculus
tggccaacattgctcgtggcatcag

SEQ ID NO: 980828 - DNA, 25 bp, Mus musculus
tggccaacattgctggtggcatcag

SEQ ID NO: 980829 - DNA, 25 bp, Mus musculus
tggccaagaaactacgactaactga

SEQ ID NO: 980830 - DNA, 25 bp, Mus musculus
tggccaagaaactaggactaactga

SEQ ID NO: 980831 - DNA, 25 bp, Mus musculus
tggccaagaagagtcgaatccttgt

SEQ ID NO: 980832 - DNA, 25 bp, Mus musculus
tggccaagaagagtggaatccttgt

SEQ ID NO: 980833 - DNA, 25 bp, Mus musculus
tggccaagcagacggccctggatct

SEQ ID NO: 980834 - DNA, 25 bp, Mus musculus
tggccaagcagagggccctggatct

SEQ ID NO: 980835 - DNA, 25 bp, Mus musculus
tggccaagcaggcaaaagctgcttt

SEQ ID NO: 980836 - DNA, 25 bp, Mus musculus
tggccaagcagggaaaagctgcttt

SEQ ID NO: 980837 - DNA, 25 bp, Mus musculus
tggccaagggcaagttcccccagac

SEQ ID NO: 980838 - DNA, 25 bp, Mus musculus
tggccaaggggaagttcccccagac

SEQ ID NO: 980839 - DNA, 25 bp, Mus musculus
tggccaagtttacacggattaatac

SEQ ID NO: 980840 - DNA, 25 bp, Mus musculus
tggccaagtttacagggattaatac

SEQ ID NO: 980841 - DNA, 25 bp, Mus musculus
tggccaatagcacacaacttcccag

SEQ ID NO: 980842 - DNA, 25 bp, Mus musculus
tggccaatagcacagaacttcccag

SEQ ID NO: 980843 - DNA, 25 bp, Mus musculus
tggccacaccagccttgatgattcg

SEQ ID NO: 980844 - DNA, 25 bp, Mus musculus
tggccacaccaggcttgatgattcg

SEQ ID NO: 980845 - DNA, 25 bp, Mus musculus
tggccacatctccacatgaagtcct

SEQ ID NO: 980846 - DNA, 25 bp, Mus musculus
tggccacatctccagatgaagtcct

SEQ ID NO: 980847 - DNA, 25 bp, Mus musculus
tggccaccagcacgtgtctccctcc

SEQ ID NO: 980848 - DNA, 25 bp, Mus musculus
tggccaccagcaggtgtctccctcc

SEQ ID NO: 980849 - DNA, 25 bp, Mus musculus
tggccaccagcataaagcatgagtc

SEQ ID NO: 980850 - DNA, 25 bp, Mus musculus
tggccaccagccccactctgccccg

SEQ ID NO: 980851 - DNA, 25 bp, Mus musculus
tggccaccaggataaagcatgagtc

SEQ ID NO: 980852 - DNA, 25 bp, Mus musculus
tggccaccaggcccactctgccccg

SEQ ID NO: 980853 - DNA, 25 bp, Mus musculus
tggccacgttgccgacttcctggtg

SEQ ID NO: 980854 - DNA, 25 bp, Mus musculus
tggccacgttgccgagaacctgcca

SEQ ID NO: 980855 - DNA, 25 bp, Mus musculus
tggccacgttgccgattttgtcctg

SEQ ID NO: 980856 - DNA, 25 bp, Mus musculus
tggccacgttgccgtcttcctggtg

SEQ ID NO: 980857 - DNA, 25 bp, Mus musculus
tggccacgttgccgtgaacctgcca

SEQ ID NO: 980858 - DNA, 25 bp, Mus musculus
tggccacgttgccgtttttgtcctg

SEQ ID NO: 980859 - DNA, 25 bp, Mus musculus
tggccacttaaacggtgcctcagcc

SEQ ID NO: 980860 - DNA, 25 bp, Mus musculus
tggccacttaaagggtgcctcagcc

SEQ ID NO: 980861 - DNA, 25 bp, Mus musculus
tggccacttcagcaagttcattccc

SEQ ID NO: 980862 - DNA, 25 bp, Mus musculus
tggccacttcaggaagttcattccc

SEQ ID NO: 980863 - DNA, 25 bp, Mus musculus
tggccacttgaacgtggacttcatg

SEQ ID NO: 980864 - DNA, 25 bp, Mus musculus
tggccacttgaaggtggacttcatg

SEQ ID NO: 980865 - DNA, 25 bp, Mus musculus
tggccagaaacacatctggagaatt

SEQ ID NO: 980866 - DNA, 25 bp, Mus musculus
tggccagaaacagatctggagaatt

SEQ ID NO: 980867 - DNA, 25 bp, Mus musculus
tggccagaagcatgtcaatgggccc

SEQ ID NO: 980868 - DNA, 25 bp, Mus musculus
tggccagaaggatgtcaatgggccc

SEQ ID NO: 980869 - DNA, 25 bp, Mus musculus
tggccagaccctgacgtctatgacc

SEQ ID NO: 980870 - DNA, 25 bp, Mus musculus
tggccagaccctgaggtctatgacc

SEQ ID NO: 980871 - DNA, 25 bp, Mus musculus
tggccagccaggcctgcagcatcaa

SEQ ID NO: 980872 - DNA, 25 bp, Mus musculus
tggccagccagggctgcagcatcaa

SEQ ID NO: 980873 - DNA, 25 bp, Mus musculus
tggccagctcgactagatgaagttc

SEQ ID NO: 980874 - DNA, 25 bp, Mus musculus
tggccagctcgagtagatgaagttc

SEQ ID NO: 980875 - DNA, 25 bp, Mus musculus
tggccagctttgggcggctggctgt

SEQ ID NO: 980876 - DNA, 25 bp, Mus musculus
tggccagctttggggggctggctgt

SEQ ID NO: 980877 - DNA, 25 bp, Mus musculus
tggccaggagcgcttccactccctg

SEQ ID NO: 980878 - DNA, 25 bp, Mus musculus
tggccaggagcggttccactccctg

SEQ ID NO: 980879 - DNA, 25 bp, Mus musculus
tggccaggagctatatgacacgccc

SEQ ID NO: 980880 - DNA, 25 bp, Mus musculus
tggccaggaggtatatgacacgccc

SEQ ID NO: 980881 - DNA, 25 bp, Mus musculus
tggccaggatttgaccaactacagt

SEQ ID NO: 980882 - DNA, 25 bp, Mus musculus
tggccaggatttgagcaactacagt

SEQ ID NO: 980883 - DNA, 25 bp, Mus musculus
tggccagtacagcgtctgatccgac

SEQ ID NO: 980884 - DNA, 25 bp, Mus musculus
tggccagtacagggtctgatccgac

SEQ ID NO: 980885 - DNA, 25 bp, Mus musculus
tggccagtagatactgccttatagg

SEQ ID NO: 980886 - DNA, 25 bp, Mus musculus
tggccagtagattctgccttatagg

SEQ ID NO: 980887 - DNA, 25 bp, Mus musculus
tggccagtcaagatagccagccctg

SEQ ID NO: 980888 - DNA, 25 bp, Mus musculus
tggccagtcaagttagccagccctg

SEQ ID NO: 980889 - DNA, 25 bp, Mus musculus
tggccagtgcagaagctccacagga

SEQ ID NO: 980890 - DNA, 25 bp, Mus musculus
tggccagtgcagtagctccacagga

SEQ ID NO: 980891 - DNA, 25 bp, Mus musculus
tggccagttcaacagccccaaatgg

SEQ ID NO: 980892 - DNA, 25 bp, Mus musculus
tggccagttcaagagccccaaatgg

SEQ ID NO: 980893 - DNA, 25 bp, Mus musculus
tggccatagcagcactgatggatgt

SEQ ID NO: 980894 - DNA, 25 bp, Mus musculus
tggccatagcaggactgatggatgt

SEQ ID NO: 980895 - DNA, 25 bp, Mus musculus
tggccatcagcgctgtggcagagat

SEQ ID NO: 980896 - DNA, 25 bp, Mus musculus
tggccatcagcggctgtggcagaga

SEQ ID NO: 980897 - DNA, 25 bp, Mus musculus
tggccatcagggctgtggcagagat

SEQ ID NO: 980898 - DNA, 25 bp, Mus musculus
tggccatcaggggctgtggcagaga

SEQ ID NO: 980899 - DNA, 25 bp, Mus musculus
tggccatcccaaagcgtttgcatat

SEQ ID NO: 980900 - DNA, 25 bp, Mus musculus
tggccatcccaaagggtttgcatat

SEQ ID NO: 980901 - DNA, 25 bp, Mus musculus
tggccatcgacagtcgcaaccctcc

SEQ ID NO: 980902 - DNA, 25 bp, Mus musculus
tggccatcgacagtggcaaccctcc

SEQ ID NO: 980903 - DNA, 25 bp, Mus musculus
tggccattctgcacagtaaatccat

SEQ ID NO: 980904 - DNA, 25 bp, Mus musculus
tggccattctgcactgtaaatccat

SEQ ID NO: 980905 - DNA, 25 bp, Mus musculus
tggccattgaagagtggcagaaaac

SEQ ID NO: 980906 - DNA, 25 bp, Mus musculus
tggccattgaagtgtggcagaaaac

SEQ ID NO: 980907 - DNA, 25 bp, Mus musculus
tggccattgcacagagcctcaacac

SEQ ID NO: 980908 - DNA, 25 bp, Mus musculus
tggccattgcacagtgcctcaacac

SEQ ID NO: 980909 - DNA, 25 bp, Mus musculus
tggccattgccagacatccttgtgt

SEQ ID NO: 980910 - DNA, 25 bp, Mus musculus
tggccattgccagagatccttgtgt

SEQ ID NO: 980911 - DNA, 25 bp, Mus musculus
tggcccaatcagacagaagacctca

SEQ ID NO: 980912 - DNA, 25 bp, Mus musculus
tggcccaatcagtcagaagacctca

SEQ ID NO: 980913 - DNA, 25 bp, Mus musculus
tggcccacagcattgcaaatggaaa

SEQ ID NO: 980914 - DNA, 25 bp, Mus musculus
tggcccacaggattgcaaatggaaa

SEQ ID NO: 980915 - DNA, 25 bp, Mus musculus
tggcccacctatcgagtcgccagtg

SEQ ID NO: 980916 - DNA, 25 bp, Mus musculus
tggcccacctatcgtgtcgccagtg

SEQ ID NO: 980917 - DNA, 25 bp, Mus musculus
tggcccacgcacagctctctgaagt

SEQ ID NO: 980918 - DNA, 25 bp, Mus musculus
tggcccacgcactgctctctgaagt

SEQ ID NO: 980919 - DNA, 25 bp, Mus musculus
tggcccagacagagactcaggtgca

SEQ ID NO: 980920 - DNA, 25 bp, Mus musculus
tggcccagacagtgactcaggtgca

SEQ ID NO: 980921 - DNA, 25 bp, Mus musculus
tggcccagattaaactcaaataatt

SEQ ID NO: 980922 - DNA, 25 bp, Mus musculus
tggcccagattaaagtcaaataatt

SEQ ID NO: 980923 - DNA, 25 bp, Mus musculus
tggcccagcatttgcgggagagcac

SEQ ID NO: 980924 - DNA, 25 bp, Mus musculus
tggcccagcatttgggggagagcac

SEQ ID NO: 980925 - DNA, 25 bp, Mus musculus
tggcccagtgcgtagccatggagac

SEQ ID NO: 980926 - DNA, 25 bp, Mus musculus
tggcccagtgggtagccatggagac

SEQ ID NO: 980927 - DNA, 25 bp, Mus musculus
tggcccataaatgctgttggctgct

SEQ ID NO: 980928 - DNA, 25 bp, Mus musculus
tggcccataattgctgttggctgct

SEQ ID NO: 980929 - DNA, 25 bp, Mus musculus
tggcccatgatgcacttcctgcgct

SEQ ID NO: 980930 - DNA, 25 bp, Mus musculus
tggcccatgatggacttcctgcgct

SEQ ID NO: 980931 - DNA, 25 bp, Mus musculus
tggccccaacactacggacaataaa

SEQ ID NO: 980932 - DNA, 25 bp, Mus musculus
tggccccaacactagggacaataaa

SEQ ID NO: 980933 - DNA, 25 bp, Mus musculus
tggccccaagctggccattgaagag

SEQ ID NO: 980934 - DNA, 25 bp, Mus musculus
tggccccaaggtggccattgaagag

SEQ ID NO: 980935 - DNA, 25 bp, Mus musculus
tggccccatttacacggagaagctg

SEQ ID NO: 980936 - DNA, 25 bp, Mus musculus
tggccccatttacagggagaagctg

SEQ ID NO: 980937 - DNA, 25 bp, Mus musculus
tggcccctacataaaatggttccta

SEQ ID NO: 980938 - DNA, 25 bp, Mus musculus
tggcccctacattaaatggttccta

SEQ ID NO: 980939 - DNA, 25 bp, Mus musculus
tggcccgcaaaacaagtctgtggac

SEQ ID NO: 980940 - DNA, 25 bp, Mus musculus
tggcccgcaaaagaagtctgtggac

SEQ ID NO: 980941 - DNA, 25 bp, Mus musculus
tggccctcagagcgtctttggaggc

SEQ ID NO: 980942 - DNA, 25 bp, Mus musculus
tggccctcagagggtctttggaggc

SEQ ID NO: 980943 - DNA, 25 bp, Mus musculus
tggccctcagcctcagcagggaact

SEQ ID NO: 980944 - DNA, 25 bp, Mus musculus
tggccctcagctacaagcagcttat

SEQ ID NO: 980945 - DNA, 25 bp, Mus musculus
tggccctcagcttcaagcagcttat

SEQ ID NO: 980946 - DNA, 25 bp, Mus musculus
tggccctcaggctcagcagggaact

SEQ ID NO: 980947 - DNA, 25 bp, Mus musculus
tggccctcccagcgccagccgcaca

SEQ ID NO: 980948 - DNA, 25 bp, Mus musculus
tggccctcccagggccagccgcaca

SEQ ID NO: 980949 - DNA, 25 bp, Mus musculus
tggccctgttggatggagaacaact

SEQ ID NO: 980950 - DNA, 25 bp, Mus musculus
tggccctgttggttggagaacaact

SEQ ID NO: 980951 - DNA, 25 bp, Mus musculus
tggcccttcaagctctatatacctt

SEQ ID NO: 980952 - DNA, 25 bp, Mus musculus
tggcccttcaaggtctatatacctt

SEQ ID NO: 980953 - DNA, 25 bp, Mus musculus
tggccgacagagtgcttgggatccc

SEQ ID NO: 980954 - DNA, 25 bp, Mus musculus
tggccgacagtgtgcttgggatccc

SEQ ID NO: 980955 - DNA, 25 bp, Mus musculus
tggccgagtataagcaattaaccct

SEQ ID NO: 980956 - DNA, 25 bp, Mus musculus
tggccgagtataaggaattaaccct

SEQ ID NO: 980957 - DNA, 25 bp, Mus musculus
tggccgagtgttcctgaacacaacc

SEQ ID NO: 980958 - DNA, 25 bp, Mus musculus
tggccgagtgttgctgaacacaacc

SEQ ID NO: 980959 - DNA, 25 bp, Mus musculus
tggccgcacagcctcctcttcctcc

SEQ ID NO: 980960 - DNA, 25 bp, Mus musculus
tggccgcacagcctgctcttcctcc

SEQ ID NO: 980961 - DNA, 25 bp, Mus musculus
tggccgccggcccgtgtataagatg

SEQ ID NO: 980962 - DNA, 25 bp, Mus musculus
tggccgccgggccgtgtataagatg

SEQ ID NO: 980963 - DNA, 25 bp, Mus musculus
tggccggcctccatcaacaaataag

SEQ ID NO: 980964 - DNA, 25 bp, Mus musculus
tggccggcctccttcaacaaataag

SEQ ID NO: 980965 - DNA, 25 bp, Mus musculus
tggccggggcgacgttctctccact

SEQ ID NO: 980966 - DNA, 25 bp, Mus musculus
tggccggggcgaggttctctccact

SEQ ID NO: 980967 - DNA, 25 bp, Mus musculus
tggccgtcatcacgcctcctggaca

SEQ ID NO: 980968 - DNA, 25 bp, Mus musculus
tggccgtcatcaggcctcctggaca

SEQ ID NO: 980969 - DNA, 25 bp, Mus musculus
tggccgtggcccccattccagggaa

SEQ ID NO: 980970 - DNA, 25 bp, Mus musculus
tggccgtggcccgcattccagggaa

SEQ ID NO: 980971 - DNA, 25 bp, Mus musculus
tggcctatagcaagtttggtgagcg

SEQ ID NO: 980972 - DNA, 25 bp, Mus musculus
tggcctataggaagtttggtgagcg

SEQ ID NO: 980973 - DNA, 25 bp, Mus musculus
tggcctcaatggctacaagtgtgac

SEQ ID NO: 980974 - DNA, 25 bp, Mus musculus
tggcctcaatgggtacaagtgtgac

SEQ ID NO: 980975 - DNA, 25 bp, Mus musculus
tggcctcacctacaacgacttcctg

SEQ ID NO: 980976 - DNA, 25 bp, Mus musculus
tggcctcacctacatcgacttcctg

SEQ ID NO: 980977 - DNA, 25 bp, Mus musculus
tggcctcatcaacgacgttctctat

SEQ ID NO: 980978 - DNA, 25 bp, Mus musculus
tggcctcatcaaggacgttctctat

SEQ ID NO: 980979 - DNA, 25 bp, Mus musculus
tggcctcatcccagcgtttactcct

SEQ ID NO: 980980 - DNA, 25 bp, Mus musculus
tggcctcatcccagggtttactcct

SEQ ID NO: 980981 - DNA, 25 bp, Mus musculus
tggcctccagaagccaccatggggc

SEQ ID NO: 980982 - DNA, 25 bp, Mus musculus
tggcctccagtagccaccatggggc

SEQ ID NO: 980983 - DNA, 25 bp, Mus musculus
tggcctccggataaagatagagaaa

SEQ ID NO: 980984 - DNA, 25 bp, Mus musculus
tggcctccggctttgtattgagggc

SEQ ID NO: 980985 - DNA, 25 bp, Mus musculus
tggcctccgggtttgtattgagggc

SEQ ID NO: 980986 - DNA, 25 bp, Mus musculus
tggcctccggttaaagatagagaaa

SEQ ID NO: 980987 - DNA, 25 bp, Mus musculus
tggcctcgccaacagttcctccagc

SEQ ID NO: 980988 - DNA, 25 bp, Mus musculus
tggcctcgccaacgtatgtggaccg

SEQ ID NO: 980989 - DNA, 25 bp, Mus musculus
tggcctcgccaagagttcctccagc

SEQ ID NO: 980990 - DNA, 25 bp, Mus musculus
tggcctcgccaaggtatgtggaccg

SEQ ID NO: 980991 - DNA, 25 bp, Mus musculus
tggcctcgctggcattcccatttac

SEQ ID NO: 980992 - DNA, 25 bp, Mus musculus
tggcctcgctgggattcccatttac

SEQ ID NO: 980993 - DNA, 25 bp, Mus musculus
tggcctctaacagacgtaccttaat

SEQ ID NO: 980994 - DNA, 25 bp, Mus musculus
tggcctctaacagaggtaccttaat

SEQ ID NO: 980995 - DNA, 25 bp, Mus musculus
tggcctctaagtagctgactgtcca

SEQ ID NO: 980996 - DNA, 25 bp, Mus musculus
tggcctctaagtcccatcacctgtt

SEQ ID NO: 980997 - DNA, 25 bp, Mus musculus
tggcctctaagtgccatcacctgtt

SEQ ID NO: 980998 - DNA, 25 bp, Mus musculus
tggcctctaagttgctgactgtcca

SEQ ID NO: 980999 - DNA, 25 bp, Mus musculus
tggcctctcaccgccgtgcccagga

SEQ ID NO: 981000 - DNA, 25 bp, Mus musculus
tggcctctcaccgcggtgcccagga

SEQ ID NO: 981001 - DNA, 25 bp, Mus musculus
tggcctctgataaacgcaactgttg

SEQ ID NO: 981002 - DNA, 25 bp, Mus musculus
tggcctctgataaaggcaactgttg

SEQ ID NO: 981003 - DNA, 25 bp, Mus musculus
tggcctctgtaccctggcccgggac

SEQ ID NO: 981004 - DNA, 25 bp, Mus musculus
tggcctctgtacgctggcccgggac

SEQ ID NO: 981005 - DNA, 25 bp, Mus musculus
tggcctgaagatggatcaccaactt

SEQ ID NO: 981006 - DNA, 25 bp, Mus musculus
tggcctgaagcgggagcctggagag

SEQ ID NO: 981007 - DNA, 25 bp, Mus musculus
tggcctgaagggggagcctggagag

SEQ ID NO: 981008 - DNA, 25 bp, Mus musculus
tggcctgaagttggatcaccaactt

SEQ ID NO: 981009 - DNA, 25 bp, Mus musculus
tggcctgacccagacgtctttgacc

SEQ ID NO: 981010 - DNA, 25 bp, Mus musculus
tggcctgacccagaggtctttgacc

SEQ ID NO: 981011 - DNA, 25 bp, Mus musculus
tggcctgcagcctgttgtggtccag

SEQ ID NO: 981012 - DNA, 25 bp, Mus musculus
tggcctgcaggctgttgtggtccag

SEQ ID NO: 981013 - DNA, 25 bp, Mus musculus
tggcctggccaccacccccactctg

SEQ ID NO: 981014 - DNA, 25 bp, Mus musculus
tggcctggccaccacgataaagcat

SEQ ID NO: 981015 - DNA, 25 bp, Mus musculus
tggcctggccaccagccccactctg

SEQ ID NO: 981016 - DNA, 25 bp, Mus musculus
tggcctggccaccaggataaagcat

SEQ ID NO: 981017 - DNA, 25 bp, Mus musculus
tggcctgtgagaaccacctcagtgg

SEQ ID NO: 981018 - DNA, 25 bp, Mus musculus
tggcctgtgagaacgacctcagtgg

SEQ ID NO: 981019 - DNA, 25 bp, Mus musculus
tggcctgtgagactgtggacattga

SEQ ID NO: 981020 - DNA, 25 bp, Mus musculus
tggcctgtgagagtgtggacattga

SEQ ID NO: 981021 - DNA, 25 bp, Mus musculus
tggcctgtggcgtggagtccatgac

SEQ ID NO: 981022 - DNA, 25 bp, Mus musculus
tggcctgtggggtggagtccatgac

SEQ ID NO: 981023 - DNA, 25 bp, Mus musculus
tggcctgtgtggatgtgaacgagtg

SEQ ID NO: 981024 - DNA, 25 bp, Mus musculus
tggcctgtgtggttgtgaacgagtg

SEQ ID NO: 981025 - DNA, 25 bp, Mus musculus
tggccttaccatctgccctgggggg

SEQ ID NO: 981026 - DNA, 25 bp, Mus musculus
tggccttaccatgtgccctgggggg

SEQ ID NO: 981027 - DNA, 25 bp, Mus musculus
tggccttcctgacgattatttgtat

SEQ ID NO: 981028 - DNA, 25 bp, Mus musculus
tggccttcctgaggattatttgtat

SEQ ID NO: 981029 - DNA, 25 bp, Mus musculus
tggccttctacacgatgctggccca

SEQ ID NO: 981030 - DNA, 25 bp, Mus musculus
tggccttctacaggatgctggccca

SEQ ID NO: 981031 - DNA, 25 bp, Mus musculus
tggccttcttgacctgaaaattgag

SEQ ID NO: 981032 - DNA, 25 bp, Mus musculus
tggccttcttgacggccttcttgaa

SEQ ID NO: 981033 - DNA, 25 bp, Mus musculus
tggccttcttgagctgaaaattgag

SEQ ID NO: 981034 - DNA, 25 bp, Mus musculus
tggccttcttgagggccttcttgaa

SEQ ID NO: 981035 - DNA, 25 bp, Mus musculus
tggccttgacaaaatcaacatgaca

SEQ ID NO: 981036 - DNA, 25 bp, Mus musculus
tggccttgacaatatcaacatgaca

SEQ ID NO: 981037 - DNA, 25 bp, Mus musculus
tggccttgcagactatgccgacgat

SEQ ID NO: 981038 - DNA, 25 bp, Mus musculus
tggccttgcagagtatgccgacgat

SEQ ID NO: 981039 - DNA, 25 bp, Mus musculus
tggccttggcaacacaccccaatat

SEQ ID NO: 981040 - DNA, 25 bp, Mus musculus
tggccttggcaacagaccccaatat

SEQ ID NO: 981041 - DNA, 25 bp, Mus musculus
tggccttgggaacgctgctgatctg

SEQ ID NO: 981042 - DNA, 25 bp, Mus musculus
tggccttgggaaggctgctgatctg

SEQ ID NO: 981043 - DNA, 25 bp, Mus musculus
tggcctttctgaagagtcctcacga

SEQ ID NO: 981044 - DNA, 25 bp, Mus musculus
tggcctttctgaagtgtcctcacga

SEQ ID NO: 981045 - DNA, 25 bp, Mus musculus
tggccttttcagaactcaagctctt

SEQ ID NO: 981046 - DNA, 25 bp, Mus musculus
tggccttttcagcgctacagtgcat

SEQ ID NO: 981047 - DNA, 25 bp, Mus musculus
tggccttttcagggctacagtgcat

SEQ ID NO: 981048 - DNA, 25 bp, Mus musculus
tggccttttcagtactcaagctctt

SEQ ID NO: 981049 - DNA, 25 bp, Mus musculus
tggcgaaaccagagcggcaggacac

SEQ ID NO: 981050 - DNA, 25 bp, Mus musculus
tggcgaaaccagaggggcaggacac

SEQ ID NO: 981051 - DNA, 25 bp, Mus musculus
tggcgacatgatatttgaaggaaac

SEQ ID NO: 981052 - DNA, 25 bp, Mus musculus
tggcgacatgttatttgaaggaaac

SEQ ID NO: 981053 - DNA, 25 bp, Mus musculus
tggcgaccttcacggaaaatgccaa

SEQ ID NO: 981054 - DNA, 25 bp, Mus musculus
tggcgaccttcagggaaaatgccaa

SEQ ID NO: 981055 - DNA, 25 bp, Mus musculus
tggcgagaccggcgcatggaacaag

SEQ ID NO: 981056 - DNA, 25 bp, Mus musculus
tggcgagaccggggcatggaacaag

SEQ ID NO: 981057 - DNA, 25 bp, Mus musculus
tggcgagatcatcaaaccagaagat

SEQ ID NO: 981058 - DNA, 25 bp, Mus musculus
tggcgagatcatcataccagaagat

SEQ ID NO: 981059 - DNA, 25 bp, Mus musculus
tggcgaggacgagacctctatttca

SEQ ID NO: 981060 - DNA, 25 bp, Mus musculus
tggcgaggacgagacctctggtgca

SEQ ID NO: 981061 - DNA, 25 bp, Mus musculus
tggcgaggacgagagctctatttca

SEQ ID NO: 981062 - DNA, 25 bp, Mus musculus
tggcgaggacgagagctctggtgca

SEQ ID NO: 981063 - DNA, 25 bp, Mus musculus
tggcgaggagaaagcggtggagaaa

SEQ ID NO: 981064 - DNA, 25 bp, Mus musculus
tggcgaggagcaggtgtagcccatg

SEQ ID NO: 981065 - DNA, 25 bp, Mus musculus
tggcgaggagccatcaagcaaattt

SEQ ID NO: 981066 - DNA, 25 bp, Mus musculus
tggcgaggaggaggtgtagcccatg

SEQ ID NO: 981067 - DNA, 25 bp, Mus musculus
tggcgaggaggcatcaagcaaattt

SEQ ID NO: 981068 - DNA, 25 bp, Mus musculus
tggcgaggagtaagcggtggagaaa

SEQ ID NO: 981069 - DNA, 25 bp, Mus musculus
tggcgagtaaagagatgtttgaaga

SEQ ID NO: 981070 - DNA, 25 bp, Mus musculus
tggcgagtaaagagttgtttgaaga

SEQ ID NO: 981071 - DNA, 25 bp, Mus musculus
tggcgagtagcacgaataaacacgt

SEQ ID NO: 981072 - DNA, 25 bp, Mus musculus
tggcgagtagcaggaataaacacgt

SEQ ID NO: 981073 - DNA, 25 bp, Mus musculus
tggcgagtccttatcacacgtcccc

SEQ ID NO: 981074 - DNA, 25 bp, Mus musculus
tggcgagtccttatgacacgtcccc

SEQ ID NO: 981075 - DNA, 25 bp, Mus musculus
tggcgcaggagcgtcgattggtgac

SEQ ID NO: 981076 - DNA, 25 bp, Mus musculus
tggcgcaggagcgtggattggtgac

SEQ ID NO: 981077 - DNA, 25 bp, Mus musculus
tggcgccagaaacattgttctctgg

SEQ ID NO: 981078 - DNA, 25 bp, Mus musculus
tggcgccagaaagattgttctctgg

SEQ ID NO: 981079 - DNA, 25 bp, Mus musculus
tggcgccgccggcttcaagcgctgt

SEQ ID NO: 981080 - DNA, 25 bp, Mus musculus
tggcgccgccgggttcaagcgctgt

SEQ ID NO: 981081 - DNA, 25 bp, Mus musculus
tggcggaaacctcgtgctgatcttt

SEQ ID NO: 981082 - DNA, 25 bp, Mus musculus
tggcggaaacctggtgctgatcttt

SEQ ID NO: 981083 - DNA, 25 bp, Mus musculus
tggcggacagcctgggccgtcggaa

SEQ ID NO: 981084 - DNA, 25 bp, Mus musculus
tggcggacaggctgggccgtcggaa

SEQ ID NO: 981085 - DNA, 25 bp, Mus musculus
tggcggagagagctgagatggtggt

SEQ ID NO: 981086 - DNA, 25 bp, Mus musculus
tggcggagagaggtgagatggtggt

SEQ ID NO: 981087 - DNA, 25 bp, Mus musculus
tggcggagagagtacccagtattac

SEQ ID NO: 981088 - DNA, 25 bp, Mus musculus
tggcggagagtgtacccagtattac

SEQ ID NO: 981089 - DNA, 25 bp, Mus musculus
tggcggaggaggcgcacgagcaaaa

SEQ ID NO: 981090 - DNA, 25 bp, Mus musculus
tggcggaggaggcggacgagcaaaa

SEQ ID NO: 981091 - DNA, 25 bp, Mus musculus
tggcggaggattcacgtatgggacc

SEQ ID NO: 981092 - DNA, 25 bp, Mus musculus
tggcggaggattcaggtatgggacc

SEQ ID NO: 981093 - DNA, 25 bp, Mus musculus
tggcggcaccagccccgggtggaac

SEQ ID NO: 981094 - DNA, 25 bp, Mus musculus
tggcggcaccaggcccgggtggaac

SEQ ID NO: 981095 - DNA, 25 bp, Mus musculus
tggcggcgctggcgcgtgatgaagc

SEQ ID NO: 981096 - DNA, 25 bp, Mus musculus
tggcggcgctggcgcgtgttccgaa

SEQ ID NO: 981097 - DNA, 25 bp, Mus musculus
tggcggcgctggcgggtgatgaagc

SEQ ID NO: 981098 - DNA, 25 bp, Mus musculus
tggcggcgctggcgggtgttccgaa

SEQ ID NO: 981099 - DNA, 25 bp, Mus musculus
tggcggcgtgagcccagatcatgca

SEQ ID NO: 981100 - DNA, 25 bp, Mus musculus
tggcggcgtgaggccagatcatgca

SEQ ID NO: 981101 - DNA, 25 bp, Mus musculus
tggcgggacacacacgttatctgtc

SEQ ID NO: 981102 - DNA, 25 bp, Mus musculus
tggcgggacacacaggttatctgtc

SEQ ID NO: 981103 - DNA, 25 bp, Mus musculus
tggcgggcaaaggtgaatgagaatg

SEQ ID NO: 981104 - DNA, 25 bp, Mus musculus
tggcgggcaaatatcgtcagattct

SEQ ID NO: 981105 - DNA, 25 bp, Mus musculus
tggcgggcaatggtgaatgagaatg

SEQ ID NO: 981106 - DNA, 25 bp, Mus musculus
tggcgggcaattatcgtcagattct

SEQ ID NO: 981107 - DNA, 25 bp, Mus musculus
tggcgggcgctacgtccgtctccca

SEQ ID NO: 981108 - DNA, 25 bp, Mus musculus
tggcgggcgctaggtccgtctccca

SEQ ID NO: 981109 - DNA, 25 bp, Mus musculus
tggcggggcttgcaccaggtggttg

SEQ ID NO: 981110 - DNA, 25 bp, Mus musculus
tggcggggcttgcacgtggttgcat

SEQ ID NO: 981111 - DNA, 25 bp, Mus musculus
tggcggggcttgcagcaggtggttg

SEQ ID NO: 981112 - DNA, 25 bp, Mus musculus
tggcggggcttgcaggtggttgcat

SEQ ID NO: 981113 - DNA, 25 bp, Mus musculus
tggcggtaacagagtactgtttggc

SEQ ID NO: 981114 - DNA, 25 bp, Mus musculus
tggcggtaacagtgtactgtttggc

SEQ ID NO: 981115 - DNA, 25 bp, Mus musculus
tggcgtcaccagagtgggcagagaa

SEQ ID NO: 981116 - DNA, 25 bp, Mus musculus
tggcgtcaccagtgtgggcagagaa

SEQ ID NO: 981117 - DNA, 25 bp, Mus musculus
tggcgtccagccaatcctgaacacc

SEQ ID NO: 981118 - DNA, 25 bp, Mus musculus
tggcgtccaggcaatcctgaacacc

SEQ ID NO: 981119 - DNA, 25 bp, Mus musculus
tggcgtgctgggcagctccaaggtg

SEQ ID NO: 981120 - DNA, 25 bp, Mus musculus
tggcgtgctggggagctccaaggtg

SEQ ID NO: 981121 - DNA, 25 bp, Mus musculus
tggcgttcatctgaacataggtatc

SEQ ID NO: 981122 - DNA, 25 bp, Mus musculus
tggcgttcatgtgaacataggtatc

SEQ ID NO: 981123 - DNA, 25 bp, Mus musculus
tggcgttggatgcttacatccaggc

SEQ ID NO: 981124 - DNA, 25 bp, Mus musculus
tggcgttggatggttacatccaggc

SEQ ID NO: 981125 - DNA, 25 bp, Mus musculus
tggctaatggctcacctttcaacat

SEQ ID NO: 981126 - DNA, 25 bp, Mus musculus
tggctaatggctcagctttcaacat

SEQ ID NO: 981127 - DNA, 25 bp, Mus musculus
tggctacaatactctgctttctatt

SEQ ID NO: 981128 - DNA, 25 bp, Mus musculus
tggctacaattctctgctttctatt

SEQ ID NO: 981129 - DNA, 25 bp, Mus musculus
tggctacatcagcgtgcggttctat

SEQ ID NO: 981130 - DNA, 25 bp, Mus musculus
tggctacatcagggtgcggttctat

SEQ ID NO: 981131 - DNA, 25 bp, Mus musculus
tggctaccacaaccagctgctgaac

SEQ ID NO: 981132 - DNA, 25 bp, Mus musculus
tggctaccacaacctgctgctgaac

SEQ ID NO: 981133 - DNA, 25 bp, Mus musculus
tggctactcaagctgacctgatgga

SEQ ID NO: 981134 - DNA, 25 bp, Mus musculus
tggctactcaaggtgacctgatgga

SEQ ID NO: 981135 - DNA, 25 bp, Mus musculus
tggctagaactgatccactgggccc

SEQ ID NO: 981136 - DNA, 25 bp, Mus musculus
tggctagaactgttccactgggccc

SEQ ID NO: 981137 - DNA, 25 bp, Mus musculus
tggctatggaagctctatcctgaca

SEQ ID NO: 981138 - DNA, 25 bp, Mus musculus
tggctatggaaggtctatcctgaca

SEQ ID NO: 981139 - DNA, 25 bp, Mus musculus
tggctattcgcagaataatgttttt

SEQ ID NO: 981140 - DNA, 25 bp, Mus musculus
tggctattcggagaataatgttttt

SEQ ID NO: 981141 - DNA, 25 bp, Mus musculus
tggctattggctcttatgttggcgc

SEQ ID NO: 981142 - DNA, 25 bp, Mus musculus
tggctattggctgttatgttggcgc

SEQ ID NO: 981143 - DNA, 25 bp, Mus musculus
tggctatttcagcctttgatgggac

SEQ ID NO: 981144 - DNA, 25 bp, Mus musculus
tggctatttcaggctttgatgggac

SEQ ID NO: 981145 - DNA, 25 bp, Mus musculus
tggctattttaacggaataatgcag

SEQ ID NO: 981146 - DNA, 25 bp, Mus musculus
tggctattttaagggaataatgcag

SEQ ID NO: 981147 - DNA, 25 bp, Mus musculus
tggctcaaactaagtggcctgcttg

SEQ ID NO: 981148 - DNA, 25 bp, Mus musculus
tggctcaaactatgtggcctgcttg

SEQ ID NO: 981149 - DNA, 25 bp, Mus musculus
tggctcaaagccaataataaatagc

SEQ ID NO: 981150 - DNA, 25 bp, Mus musculus
tggctcaaaggcaataataaatagc

SEQ ID NO: 981151 - DNA, 25 bp, Mus musculus
tggctcaatgaacccaagtttgtca

SEQ ID NO: 981152 - DNA, 25 bp, Mus musculus
tggctcaatgatccttccttcatac

SEQ ID NO: 981153 - DNA, 25 bp, Mus musculus
tggctcaatgtacccaagtttgtca

SEQ ID NO: 981154 - DNA, 25 bp, Mus musculus
tggctcaatgttccttccttcatac

SEQ ID NO: 981155 - DNA, 25 bp, Mus musculus
tggctcagagctgtctgccttattg

SEQ ID NO: 981156 - DNA, 25 bp, Mus musculus
tggctcagaggtgtctgccttattg

SEQ ID NO: 981157 - DNA, 25 bp, Mus musculus
tggctcagctaaagcggtggtgcta

SEQ ID NO: 981158 - DNA, 25 bp, Mus musculus
tggctcagctaatgcggtggtgcta

SEQ ID NO: 981159 - DNA, 25 bp, Mus musculus
tggctccaactgccgtccctacagc

SEQ ID NO: 981160 - DNA, 25 bp, Mus musculus
tggctccaactggcgtccctacagc

SEQ ID NO: 981161 - DNA, 25 bp, Mus musculus
tggctcccggctcatccactctcta

SEQ ID NO: 981162 - DNA, 25 bp, Mus musculus
tggctcccgggagccgggcagccac

SEQ ID NO: 981163 - DNA, 25 bp, Mus musculus
tggctcccgggagccgtcgagctag

SEQ ID NO: 981164 - DNA, 25 bp, Mus musculus
tggctcccgggagcggggcagccac

SEQ ID NO: 981165 - DNA, 25 bp, Mus musculus
tggctcccgggagcggtcgagctag

SEQ ID NO: 981166 - DNA, 25 bp, Mus musculus
tggctcccgggtcatccactctcta

SEQ ID NO: 981167 - DNA, 25 bp, Mus musculus
tggctccgactgcaagaatgcctgt

SEQ ID NO: 981168 - DNA, 25 bp, Mus musculus
tggctccgactggaagaatgcctgt

SEQ ID NO: 981169 - DNA, 25 bp, Mus musculus
tggctccggcagcgaagcccagccc

SEQ ID NO: 981170 - DNA, 25 bp, Mus musculus
tggctccggcagggaagcccagccc

SEQ ID NO: 981171 - DNA, 25 bp, Mus musculus
tggctcctccagcgtccggtactgg

SEQ ID NO: 981172 - DNA, 25 bp, Mus musculus
tggctcctccagctgtttgtggtag

SEQ ID NO: 981173 - DNA, 25 bp, Mus musculus
tggctcctccagggtccggtactgg

SEQ ID NO: 981174 - DNA, 25 bp, Mus musculus
tggctcctccaggtgtttgtggtag

SEQ ID NO: 981175 - DNA, 25 bp, Mus musculus
tggctcctgcttcccgtgttccgaa

SEQ ID NO: 981176 - DNA, 25 bp, Mus musculus
tggctcctgcttccggtgttccgaa

SEQ ID NO: 981177 - DNA, 25 bp, Mus musculus
tggctcgcagaacctcaggtaccgg

SEQ ID NO: 981178 - DNA, 25 bp, Mus musculus
tggctcgcagaagctcaggtaccgg

SEQ ID NO: 981179 - DNA, 25 bp, Mus musculus
tggctcggaatgctgatatcgataa

SEQ ID NO: 981180 - DNA, 25 bp, Mus musculus
tggctcggaatggtgatatcgataa

SEQ ID NO: 981181 - DNA, 25 bp, Mus musculus
tggctcggtgtgacccttagaagat

SEQ ID NO: 981182 - DNA, 25 bp, Mus musculus
tggctcggtgtgagctgcttttgat

SEQ ID NO: 981183 - DNA, 25 bp, Mus musculus
tggctcggtgtgtcccttagaagat

SEQ ID NO: 981184 - DNA, 25 bp, Mus musculus
tggctcggtgtgtgctgcttttgat

SEQ ID NO: 981185 - DNA, 25 bp, Mus musculus
tggctctataatcgttaactttgtg

SEQ ID NO: 981186 - DNA, 25 bp, Mus musculus
tggctctataatggttaactttgtg

SEQ ID NO: 981187 - DNA, 25 bp, Mus musculus
tggctctatcgtcacttgtgggcac

SEQ ID NO: 981188 - DNA, 25 bp, Mus musculus
tggctctatcgtgacttgtgggcac

SEQ ID NO: 981189 - DNA, 25 bp, Mus musculus
tggctctcagaacaccctccaggta

SEQ ID NO: 981190 - DNA, 25 bp, Mus musculus
tggctctcagaacagcctccaggta

SEQ ID NO: 981191 - DNA, 25 bp, Mus musculus
tggctctgagaacacgaagcccagc

SEQ ID NO: 981192 - DNA, 25 bp, Mus musculus
tggctctgagaacaggaagcccagc

SEQ ID NO: 981193 - DNA, 25 bp, Mus musculus
tggctctgtgagtccaccataggat

SEQ ID NO: 981194 - DNA, 25 bp, Mus musculus
tggctctgtgtgtccaccataggat

SEQ ID NO: 981195 - DNA, 25 bp, Mus musculus
tggctctgttcagacgataccacgg

SEQ ID NO: 981196 - DNA, 25 bp, Mus musculus
tggctctgttcagaggataccacgg

SEQ ID NO: 981197 - DNA, 25 bp, Mus musculus
tggctcttgcctgtcccctgttcac

SEQ ID NO: 981198 - DNA, 25 bp, Mus musculus
tggctcttgcctgtgccctgttcac

SEQ ID NO: 981199 - DNA, 25 bp, Mus musculus
tggctgaaagacaaacccgtggtgc

SEQ ID NO: 981200 - DNA, 25 bp, Mus musculus
tggctgaaagtcaaacccgtggtgc

SEQ ID NO: 981201 - DNA, 25 bp, Mus musculus
tggctgaaatggcgtggcaactcaa

SEQ ID NO: 981202 - DNA, 25 bp, Mus musculus
tggctgaaatggggtggcaactcaa

SEQ ID NO: 981203 - DNA, 25 bp, Mus musculus
tggctgaagacacacgggctcctta

SEQ ID NO: 981204 - DNA, 25 bp, Mus musculus
tggctgaagacacaggggctcctta

SEQ ID NO: 981205 - DNA, 25 bp, Mus musculus
tggctgaagtgacgggggtccagcg

SEQ ID NO: 981206 - DNA, 25 bp, Mus musculus
tggctgaagtgactgggcccagcca

SEQ ID NO: 981207 - DNA, 25 bp, Mus musculus
tggctgaagtgaggggggtccagcg

SEQ ID NO: 981208 - DNA, 25 bp, Mus musculus
tggctgaagtgagtgggcccagcca

SEQ ID NO: 981209 - DNA, 25 bp, Mus musculus
tggctgacactgccaccactcgccc

SEQ ID NO: 981210 - DNA, 25 bp, Mus musculus
tggctgacactggcaccactcgccc

SEQ ID NO: 981211 - DNA, 25 bp, Mus musculus
tggctgaccaagagtcatgcaaggg

SEQ ID NO: 981212 - DNA, 25 bp, Mus musculus
tggctgaccaagtgtcatgcaaggg

SEQ ID NO: 981213 - DNA, 25 bp, Mus musculus
tggctgacccgaccggtgctcgccg

SEQ ID NO: 981214 - DNA, 25 bp, Mus musculus
tggctgacccgagcggtgctcgccg

SEQ ID NO: 981215 - DNA, 25 bp, Mus musculus
tggctgactgcacatctgatttgta

SEQ ID NO: 981216 - DNA, 25 bp, Mus musculus
tggctgactgcagatctgatttgta

SEQ ID NO: 981217 - DNA, 25 bp, Mus musculus
tggctgagagacaacacaggccagc

SEQ ID NO: 981218 - DNA, 25 bp, Mus musculus
tggctgagagacaagacaggccagc

SEQ ID NO: 981219 - DNA, 25 bp, Mus musculus
tggctgaggacgctcctgtgtcccc

SEQ ID NO: 981220 - DNA, 25 bp, Mus musculus
tggctgaggacggtcctgtgtcccc

SEQ ID NO: 981221 - DNA, 25 bp, Mus musculus
tggctgagtacacggcctcagaggg

SEQ ID NO: 981222 - DNA, 25 bp, Mus musculus
tggctgagtacagggcctcagaggg

SEQ ID NO: 981223 - DNA, 25 bp, Mus musculus
tggctgagtcagctcctggcttggc

SEQ ID NO: 981224 - DNA, 25 bp, Mus musculus
tggctgagtcaggtcctggcttggc

SEQ ID NO: 981225 - DNA, 25 bp, Mus musculus
tggctgcaaaaacgtcctggtctct

SEQ ID NO: 981226 - DNA, 25 bp, Mus musculus
tggctgcaaaaacttgagaattaca

SEQ ID NO: 981227 - DNA, 25 bp, Mus musculus
tggctgcaaaaaggtcctggtctct

SEQ ID NO: 981228 - DNA, 25 bp, Mus musculus
tggctgcaaaaagttgagaattaca

SEQ ID NO: 981229 - DNA, 25 bp, Mus musculus
tggctgcacaccaggtgtgcaagga

SEQ ID NO: 981230 - DNA, 25 bp, Mus musculus
tggctgcacagcaggtgtgcaagga

SEQ ID NO: 981231 - DNA, 25 bp, Mus musculus
tggctgcactgccgcccttggtgaa

SEQ ID NO: 981232 - DNA, 25 bp, Mus musculus
tggctgcactgccggccttggtgaa

SEQ ID NO: 981233 - DNA, 25 bp, Mus musculus
tggctgcagctggacgtgtggaaca

SEQ ID NO: 981234 - DNA, 25 bp, Mus musculus
tggctgcagctggaggtgtggaaca

SEQ ID NO: 981235 - DNA, 25 bp, Mus musculus
tggctgcatcagcatctctgctgtg

SEQ ID NO: 981236 - DNA, 25 bp, Mus musculus
tggctgcatcaggatctctgctgtg

SEQ ID NO: 981237 - DNA, 25 bp, Mus musculus
tggctgcatccagacgtctggtagc

SEQ ID NO: 981238 - DNA, 25 bp, Mus musculus
tggctgcatccagaggtctggtagc

SEQ ID NO: 981239 - DNA, 25 bp, Mus musculus
tggctgcctcagagtactggctgac

SEQ ID NO: 981240 - DNA, 25 bp, Mus musculus
tggctgcctcagtgtactggctgac

SEQ ID NO: 981241 - DNA, 25 bp, Mus musculus
tggctgccttcgcaacgtaagctca

SEQ ID NO: 981242 - DNA, 25 bp, Mus musculus
tggctgccttcggaacgtaagctca

SEQ ID NO: 981243 - DNA, 25 bp, Mus musculus
tggctgctgtgttaactttttctac

SEQ ID NO: 981244 - DNA, 25 bp, Mus musculus
tggctgctgtgttatctttttctac

SEQ ID NO: 981245 - DNA, 25 bp, Mus musculus
tggctgcttcaacgacaccaccccc

SEQ ID NO: 981246 - DNA, 25 bp, Mus musculus
tggctgcttcaaggacaccaccccc

SEQ ID NO: 981247 - DNA, 25 bp, Mus musculus
tggctgcttccacgcttttatttgt

SEQ ID NO: 981248 - DNA, 25 bp, Mus musculus
tggctgcttccaggcttttatttgt

SEQ ID NO: 981249 - DNA, 25 bp, Mus musculus
tggctggaccagatgcggtgagcac

SEQ ID NO: 981250 - DNA, 25 bp, Mus musculus
tggctggaccagttgcggtgagcac

SEQ ID NO: 981251 - DNA, 25 bp, Mus musculus
tggctggagcagcttcatccctgag

SEQ ID NO: 981252 - DNA, 25 bp, Mus musculus
tggctggagcaggttcatccctgag

SEQ ID NO: 981253 - DNA, 25 bp, Mus musculus
tggctggaggaggactgtggcaaca

SEQ ID NO: 981254 - DNA, 25 bp, Mus musculus
tggctggaggaggagtgtggcaaca

SEQ ID NO: 981255 - DNA, 25 bp, Mus musculus
tggctggatccgaaccccaagtacc

SEQ ID NO: 981256 - DNA, 25 bp, Mus musculus
tggctggatccgaattcttgttcct

SEQ ID NO: 981257 - DNA, 25 bp, Mus musculus
tggctggatccgctggacacaccac

SEQ ID NO: 981258 - DNA, 25 bp, Mus musculus
tggctggatccggtggacacaccac

SEQ ID NO: 981259 - DNA, 25 bp, Mus musculus
tggctggatccgtaccccaagtacc

SEQ ID NO: 981260 - DNA, 25 bp, Mus musculus
tggctggatccgtattcttgttcct

SEQ ID NO: 981261 - DNA, 25 bp, Mus musculus
tggctggcacaggacagggaggcct

SEQ ID NO: 981262 - DNA, 25 bp, Mus musculus
tggctggcacaggacgcctggagga

SEQ ID NO: 981263 - DNA, 25 bp, Mus musculus
tggctggcacaggagagggaggcct

SEQ ID NO: 981264 - DNA, 25 bp, Mus musculus
tggctggcacaggaggcctggagga

SEQ ID NO: 981265 - DNA, 25 bp, Mus musculus
tggctggcccagaagctagaggaag

SEQ ID NO: 981266 - DNA, 25 bp, Mus musculus
tggctggcccagtagctagaggaag

SEQ ID NO: 981267 - DNA, 25 bp, Mus musculus
tggctggcgtaaaaatggctacaaa

SEQ ID NO: 981268 - DNA, 25 bp, Mus musculus
tggctggcgtcagaaaaatggctac

SEQ ID NO: 981269 - DNA, 25 bp, Mus musculus
tggctggcgtgagaaaaatggctac

SEQ ID NO: 981270 - DNA, 25 bp, Mus musculus
tggctggcgttaaaatggctacaaa

SEQ ID NO: 981271 - DNA, 25 bp, Mus musculus
tggctggctatgcccccatcgagca

SEQ ID NO: 981272 - DNA, 25 bp, Mus musculus
tggctggctatggccccatcgagca

SEQ ID NO: 981273 - DNA, 25 bp, Mus musculus
tggctgggccttggcggcctgggct

SEQ ID NO: 981274 - DNA, 25 bp, Mus musculus
tggctgggccttgggggcctgggct

SEQ ID NO: 981275 - DNA, 25 bp, Mus musculus
tggctggtacccctgctgatgtacc

SEQ ID NO: 981276 - DNA, 25 bp, Mus musculus
tggctggtacccgtgctgatgtacc

SEQ ID NO: 981277 - DNA, 25 bp, Mus musculus
tggctggtggagagttctccagttt

SEQ ID NO: 981278 - DNA, 25 bp, Mus musculus
tggctggtggagtgttctccagttt

SEQ ID NO: 981279 - DNA, 25 bp, Mus musculus
tggctgtacaatggtatcaacacct

SEQ ID NO: 981280 - DNA, 25 bp, Mus musculus
tggctgtacattggtatcaacacct

SEQ ID NO: 981281 - DNA, 25 bp, Mus musculus
tggctgtagtgaaacgtgccgagga

SEQ ID NO: 981282 - DNA, 25 bp, Mus musculus
tggctgtagtgaaaggtgccgagga

SEQ ID NO: 981283 - DNA, 25 bp, Mus musculus
tggctgtatggccatgagaatgaag

SEQ ID NO: 981284 - DNA, 25 bp, Mus musculus
tggctgtatggccgcccgtgggacg

SEQ ID NO: 981285 - DNA, 25 bp, Mus musculus
tggctgtatggcgatgagaatgaag

SEQ ID NO: 981286 - DNA, 25 bp, Mus musculus
tggctgtatggcggcccgtgggacg

SEQ ID NO: 981287 - DNA, 25 bp, Mus musculus
tggctgtctgaccaagtaacttagc

SEQ ID NO: 981288 - DNA, 25 bp, Mus musculus
tggctgtctgctttaacttgcacag

SEQ ID NO: 981289 - DNA, 25 bp, Mus musculus
tggctgtctggtttaacttgcacag

SEQ ID NO: 981290 - DNA, 25 bp, Mus musculus
tggctgtctgtccaagtaacttagc

SEQ ID NO: 981291 - DNA, 25 bp, Mus musculus
tggctgtgacgacctgatattcagc

SEQ ID NO: 981292 - DNA, 25 bp, Mus musculus
tggctgtgacgagctgatattcagc

SEQ ID NO: 981293 - DNA, 25 bp, Mus musculus
tggctgtgagacctcgcggctccac

SEQ ID NO: 981294 - DNA, 25 bp, Mus musculus
tggctgtgagacctggcggctccac

SEQ ID NO: 981295 - DNA, 25 bp, Mus musculus
tggctgtgagcccacactcgtccca

SEQ ID NO: 981296 - DNA, 25 bp, Mus musculus
tggctgtgagcccagactcgtccca

SEQ ID NO: 981297 - DNA, 25 bp, Mus musculus
tggctgtgccagcagtggaggggaa

SEQ ID NO: 981298 - DNA, 25 bp, Mus musculus
tggctgtgccaggagtggaggggaa

SEQ ID NO: 981299 - DNA, 25 bp, Mus musculus
tggctgtgtgattgatcctgttaca

SEQ ID NO: 981300 - DNA, 25 bp, Mus musculus
tggctgtgtgcgctctgttcctgcg

SEQ ID NO: 981301 - DNA, 25 bp, Mus musculus
tggctgtgtgcggtctgttcctgcg

SEQ ID NO: 981302 - DNA, 25 bp, Mus musculus
tggctgtgtgtttgatcctgttaca

SEQ ID NO: 981303 - DNA, 25 bp, Mus musculus
tggctgttcgcgaacaatcgagatc

SEQ ID NO: 981304 - DNA, 25 bp, Mus musculus
tggctgttcgcgaactgcgtcccca

SEQ ID NO: 981305 - DNA, 25 bp, Mus musculus
tggctgttcgcgaagaatcgagatc

SEQ ID NO: 981306 - DNA, 25 bp, Mus musculus
tggctgttcgcgaagtgcgtcccca

SEQ ID NO: 981307 - DNA, 25 bp, Mus musculus
tggctgttctaacacccacctgcct

SEQ ID NO: 981308 - DNA, 25 bp, Mus musculus
tggctgttctaagacccacctgcct

SEQ ID NO: 981309 - DNA, 25 bp, Mus musculus
tggctgttggcacttctggcaggtg

SEQ ID NO: 981310 - DNA, 25 bp, Mus musculus
tggctgttggcagttctggcaggtg

SEQ ID NO: 981311 - DNA, 25 bp, Mus musculus
tggctgttttcacacgaactggtga

SEQ ID NO: 981312 - DNA, 25 bp, Mus musculus
tggctgttttcacaggaactggtga

SEQ ID NO: 981313 - DNA, 25 bp, Mus musculus
tggctgttttgcccaaaacacggca

SEQ ID NO: 981314 - DNA, 25 bp, Mus musculus
tggctgttttgcgcaaaacacggca

SEQ ID NO: 981315 - DNA, 25 bp, Mus musculus
tggcttaacagaacaggagtgtgtg

SEQ ID NO: 981316 - DNA, 25 bp, Mus musculus
tggcttaacagatcaggagtgtgtg

SEQ ID NO: 981317 - DNA, 25 bp, Mus musculus
tggcttacagacaaagcctatttct

SEQ ID NO: 981318 - DNA, 25 bp, Mus musculus
tggcttacagtcaaagcctatttct

SEQ ID NO: 981319 - DNA, 25 bp, Mus musculus
tggcttacagtgcaatgggcctgct

SEQ ID NO: 981320 - DNA, 25 bp, Mus musculus
tggcttacagtgcgaagacatggga

SEQ ID NO: 981321 - DNA, 25 bp, Mus musculus
tggcttacagtggaatgggcctgct

SEQ ID NO: 981322 - DNA, 25 bp, Mus musculus
tggcttacagtgggaagacatggga

SEQ ID NO: 981323 - DNA, 25 bp, Mus musculus
tggcttatctgacgtggggaaagat

SEQ ID NO: 981324 - DNA, 25 bp, Mus musculus
tggcttatctgaggtggggaaagat

SEQ ID NO: 981325 - DNA, 25 bp, Mus musculus
tggcttcaatatcgaatctttctga

SEQ ID NO: 981326 - DNA, 25 bp, Mus musculus
tggcttcaatatggaatctttctga

SEQ ID NO: 981327 - DNA, 25 bp, Mus musculus
tggcttcaatgccacgtacaagatg

SEQ ID NO: 981328 - DNA, 25 bp, Mus musculus
tggcttcaatgccaggtacaagatg

SEQ ID NO: 981329 - DNA, 25 bp, Mus musculus
tggcttcactgccctggcattgacc

SEQ ID NO: 981330 - DNA, 25 bp, Mus musculus
tggcttcactgcgctggcattgacc

SEQ ID NO: 981331 - DNA, 25 bp, Mus musculus
tggcttcagcagctatgatgaaggt

SEQ ID NO: 981332 - DNA, 25 bp, Mus musculus
tggcttcagcaggtatgatgaaggt

SEQ ID NO: 981333 - DNA, 25 bp, Mus musculus
tggcttccaacaaactgcagggttg

SEQ ID NO: 981334 - DNA, 25 bp, Mus musculus
tggcttccaacatactgcagggttg

SEQ ID NO: 981335 - DNA, 25 bp, Mus musculus
tggcttcccagaagaatgcactgat

SEQ ID NO: 981336 - DNA, 25 bp, Mus musculus
tggcttcccagatgaatgcactgat

SEQ ID NO: 981337 - DNA, 25 bp, Mus musculus
tggcttccggaacgaactggtgagc

SEQ ID NO: 981338 - DNA, 25 bp, Mus musculus
tggcttccggaacgcctctggattc

SEQ ID NO: 981339 - DNA, 25 bp, Mus musculus
tggcttccggaaggaactggtgagc

SEQ ID NO: 981340 - DNA, 25 bp, Mus musculus
tggcttccggaaggcctctggattc

SEQ ID NO: 981341 - DNA, 25 bp, Mus musculus
tggcttcctcagcaacctcagctca

SEQ ID NO: 981342 - DNA, 25 bp, Mus musculus
tggcttcctcaggaacctcagctca

SEQ ID NO: 981343 - DNA, 25 bp, Mus musculus
tggcttcctggaagtccagaaggat

SEQ ID NO: 981344 - DNA, 25 bp, Mus musculus
tggcttcctggatgtccagaaggat

SEQ ID NO: 981345 - DNA, 25 bp, Mus musculus
tggcttctgccaacaatgacgggat

SEQ ID NO: 981346 - DNA, 25 bp, Mus musculus
tggcttctgccaactatgacgggat

SEQ ID NO: 981347 - DNA, 25 bp, Mus musculus
tggcttctggagctggtgtccccac

SEQ ID NO: 981348 - DNA, 25 bp, Mus musculus
tggcttctggaggtggtgtccccac

SEQ ID NO: 981349 - DNA, 25 bp, Mus musculus
tggcttctttggctctgaacccaag

SEQ ID NO: 981350 - DNA, 25 bp, Mus musculus
tggcttctttgggtctgaacccaag

SEQ ID NO: 981351 - DNA, 25 bp, Mus musculus
tggcttctttgtgtcgccttcacca

SEQ ID NO: 981352 - DNA, 25 bp, Mus musculus
tggcttctttgtgtggccttcacca

SEQ ID NO: 981353 - DNA, 25 bp, Mus musculus
tggcttgaagcatgctcagattgca

SEQ ID NO: 981354 - DNA, 25 bp, Mus musculus
tggcttgaaggatgctcagattgca

SEQ ID NO: 981355 - DNA, 25 bp, Mus musculus
tggcttgaggaacaaaagaatcggt

SEQ ID NO: 981356 - DNA, 25 bp, Mus musculus
tggcttgaggtacaaaagaatcggt

SEQ ID NO: 981357 - DNA, 25 bp, Mus musculus
tggcttgcagacgcatagcctgggg

SEQ ID NO: 981358 - DNA, 25 bp, Mus musculus
tggcttgcagataaaaatatatacc

SEQ ID NO: 981359 - DNA, 25 bp, Mus musculus
tggcttgcagcggtcaagtcatgtg

SEQ ID NO: 981360 - DNA, 25 bp, Mus musculus
tggcttgcaggggtcaagtcatgtg

SEQ ID NO: 981361 - DNA, 25 bp, Mus musculus
tggcttgcagtcgcatagcctgggg

SEQ ID NO: 981362 - DNA, 25 bp, Mus musculus
tggcttgcagttaaaaatatatacc

SEQ ID NO: 981363 - DNA, 25 bp, Mus musculus
tggcttgcggattattgcagccaac

SEQ ID NO: 981364 - DNA, 25 bp, Mus musculus
tggcttgcggtttattgcagccaac

SEQ ID NO: 981365 - DNA, 25 bp, Mus musculus
tggcttggactgaacgtacgcaggg

SEQ ID NO: 981366 - DNA, 25 bp, Mus musculus
tggcttggactgaaggtacgcaggg

SEQ ID NO: 981367 - DNA, 25 bp, Mus musculus
tggcttggatcgaacgcacggaggg

SEQ ID NO: 981368 - DNA, 25 bp, Mus musculus
tggcttggatcgaaggcacggaggg

SEQ ID NO: 981369 - DNA, 25 bp, Mus musculus
tggcttgtggactatgttcagaacc

SEQ ID NO: 981370 - DNA, 25 bp, Mus musculus
tggcttgtggtctatgttcagaacc

SEQ ID NO: 981371 - DNA, 25 bp, Mus musculus
tggctttagcaacagcatggtcaat

SEQ ID NO: 981372 - DNA, 25 bp, Mus musculus
tggctttagcaacgcccgcggccat

SEQ ID NO: 981373 - DNA, 25 bp, Mus musculus
tggctttagcaagagcatggtcaat

SEQ ID NO: 981374 - DNA, 25 bp, Mus musculus
tggctttagcaaggcccgcggccat

SEQ ID NO: 981375 - DNA, 25 bp, Mus musculus
tggctttatcagccgttctgtcaaa

SEQ ID NO: 981376 - DNA, 25 bp, Mus musculus
tggctttatcagcggcgttcaattt

SEQ ID NO: 981377 - DNA, 25 bp, Mus musculus
tggctttatcaggcgttctgtcaaa

SEQ ID NO: 981378 - DNA, 25 bp, Mus musculus
tggctttatcaggggcgttcaattt

SEQ ID NO: 981379 - DNA, 25 bp, Mus musculus
tggctttcaccatacagccaatcat

SEQ ID NO: 981380 - DNA, 25 bp, Mus musculus
tggctttcaccatagagccaatcat

SEQ ID NO: 981381 - DNA, 25 bp, Mus musculus
tggctttcagagccagaaggcttgt

SEQ ID NO: 981382 - DNA, 25 bp, Mus musculus
tggctttcagaggcagaaggcttgt

SEQ ID NO: 981383 - DNA, 25 bp, Mus musculus
tggctttcagcatgcggtacacagg

SEQ ID NO: 981384 - DNA, 25 bp, Mus musculus
tggctttcaggatgcggtacacagg

SEQ ID NO: 981385 - DNA, 25 bp, Mus musculus
tggctttgagccctacgagggtgtg

SEQ ID NO: 981386 - DNA, 25 bp, Mus musculus
tggctttgaggcctacgagggtgtg

SEQ ID NO: 981387 - DNA, 25 bp, Mus musculus
tggctttgccagcatggaatcaacg

SEQ ID NO: 981388 - DNA, 25 bp, Mus musculus
tggctttgccaggatggaatcaacg

SEQ ID NO: 981389 - DNA, 25 bp, Mus musculus
tggctttgtgcgccctgtcgtcgga

SEQ ID NO: 981390 - DNA, 25 bp, Mus musculus
tggctttgtgggccctgtcgtcgga

SEQ ID NO: 981391 - DNA, 25 bp, Mus musculus
tggcttttaatgatctagtgaagcc

SEQ ID NO: 981392 - DNA, 25 bp, Mus musculus
tggcttttaatgttctagtgaagcc

SEQ ID NO: 981393 - DNA, 25 bp, Mus musculus
tggcttttagagctttgtgaagtat

SEQ ID NO: 981394 - DNA, 25 bp, Mus musculus
tggcttttagaggtttgtgaagtat

SEQ ID NO: 981395 - DNA, 25 bp, Mus musculus
tgggaaaacagaataataacaattg

SEQ ID NO: 981396 - DNA, 25 bp, Mus musculus
tgggaaaacagaattataacaattg

SEQ ID NO: 981397 - DNA, 25 bp, Mus musculus
tgggaaaagggcgtccacagtggta

SEQ ID NO: 981398 - DNA, 25 bp, Mus musculus
tgggaaaagggcgtgcacagtggta

SEQ ID NO: 981399 - DNA, 25 bp, Mus musculus
tgggaaaagtaaagcgattgcttat

SEQ ID NO: 981400 - DNA, 25 bp, Mus musculus
tgggaaaagtaaagggattgcttat

SEQ ID NO: 981401 - DNA, 25 bp, Mus musculus
tgggaaaatggctcagggggagcac

SEQ ID NO: 981402 - DNA, 25 bp, Mus musculus
tgggaaaatggctctgggggagcac

SEQ ID NO: 981403 - DNA, 25 bp, Mus musculus
tgggaaagaccaccccatcattctt

SEQ ID NO: 981404 - DNA, 25 bp, Mus musculus
tgggaaagaccagcccatcattctt

SEQ ID NO: 981405 - DNA, 25 bp, Mus musculus
tgggaaagtgaacgactttctcaga

SEQ ID NO: 981406 - DNA, 25 bp, Mus musculus
tgggaaagtgaaggactttctcaga

SEQ ID NO: 981407 - DNA, 25 bp, Mus musculus
tgggaacgctcaaaatgaggaaaat

SEQ ID NO: 981408 - DNA, 25 bp, Mus musculus
tgggaacgctgaaaatgaggaaaat

SEQ ID NO: 981409 - DNA, 25 bp, Mus musculus
tgggaagaagctcaatgtgactgtg

SEQ ID NO: 981410 - DNA, 25 bp, Mus musculus
tgggaagaaggtcaatgtgactgtg

SEQ ID NO: 981411 - DNA, 25 bp, Mus musculus
tgggaagactccaattcattgcttc

SEQ ID NO: 981412 - DNA, 25 bp, Mus musculus
tgggaagactcctattcattgcttc

SEQ ID NO: 981413 - DNA, 25 bp, Mus musculus
tgggaagagtttgacacgctccagc

SEQ ID NO: 981414 - DNA, 25 bp, Mus musculus
tgggaagagtttgagacgctccagc

SEQ ID NO: 981415 - DNA, 25 bp, Mus musculus
tgggaagcaaagcctcaagtcattc

SEQ ID NO: 981416 - DNA, 25 bp, Mus musculus
tgggaagcaaaggctcaagtcattc

SEQ ID NO: 981417 - DNA, 25 bp, Mus musculus
tgggaagcacagctggctttggcca

SEQ ID NO: 981418 - DNA, 25 bp, Mus musculus
tgggaagcacaggtggctttggcca

SEQ ID NO: 981419 - DNA, 25 bp, Mus musculus
tgggaagccagagacggtctgcgag

SEQ ID NO: 981420 - DNA, 25 bp, Mus musculus
tgggaagccagagagggtctgcgag

SEQ ID NO: 981421 - DNA, 25 bp, Mus musculus
tgggaagcccagatttgccatggag

SEQ ID NO: 981422 - DNA, 25 bp, Mus musculus
tgggaagcccagttttgccatggag

SEQ ID NO: 981423 - DNA, 25 bp, Mus musculus
tgggaaggaaggatcgtctgttttc

SEQ ID NO: 981424 - DNA, 25 bp, Mus musculus
tgggaaggaaggatggtctgttttc

SEQ ID NO: 981425 - DNA, 25 bp, Mus musculus
tgggaagtatggccgagggcttcca

SEQ ID NO: 981426 - DNA, 25 bp, Mus musculus
tgggaagtatgggcgagggcttcca

SEQ ID NO: 981427 - DNA, 25 bp, Mus musculus
tgggaagtcaaaggcgaaggatgtg

SEQ ID NO: 981428 - DNA, 25 bp, Mus musculus
tgggaagtcaaaggggaaggatgtg

SEQ ID NO: 981429 - DNA, 25 bp, Mus musculus
tgggaagtgtcgccagagaaacaat

SEQ ID NO: 981430 - DNA, 25 bp, Mus musculus
tgggaagtgtcgcttccaacagtgt

SEQ ID NO: 981431 - DNA, 25 bp, Mus musculus
tgggaagtgtcggcagagaaacaat

SEQ ID NO: 981432 - DNA, 25 bp, Mus musculus
tgggaagtgtcggttccaacagtgt

SEQ ID NO: 981433 - DNA, 25 bp, Mus musculus
tgggaagttctttccttgcggaata

SEQ ID NO: 981434 - DNA, 25 bp, Mus musculus
tgggaagttctttcgttgcggaata

SEQ ID NO: 981435 - DNA, 25 bp, Mus musculus
tgggaatcatacatgacgcctttga

SEQ ID NO: 981436 - DNA, 25 bp, Mus musculus
tgggaatcatacttgacgcctttga

SEQ ID NO: 981437 - DNA, 25 bp, Mus musculus
tgggaatccttgaaagccctctggg

SEQ ID NO: 981438 - DNA, 25 bp, Mus musculus
tgggaatccttgaatgccctctggg

SEQ ID NO: 981439 - DNA, 25 bp, Mus musculus
tgggaatgagagcgtcttcgtgcgt

SEQ ID NO: 981440 - DNA, 25 bp, Mus musculus
tgggaatgagtgcgtcttcgtgcgt

SEQ ID NO: 981441 - DNA, 25 bp, Mus musculus
tgggaatgcacaccagcagtgcaca

SEQ ID NO: 981442 - DNA, 25 bp, Mus musculus
tgggaatgcacaccagtgcacaaac

SEQ ID NO: 981443 - DNA, 25 bp, Mus musculus
tgggaatgcacagcagcagtgcaca

SEQ ID NO: 981444 - DNA, 25 bp, Mus musculus
tgggaatgcacagcagtgcacaaac

SEQ ID NO: 981445 - DNA, 25 bp, Mus musculus
tgggaattggtcctcgctctgtctg

SEQ ID NO: 981446 - DNA, 25 bp, Mus musculus
tgggaattggtcctggctctgtctg

SEQ ID NO: 981447 - DNA, 25 bp, Mus musculus
tgggacaacggatccagaaagctac

SEQ ID NO: 981448 - DNA, 25 bp, Mus musculus
tgggacaacggatccgtcttggaaa

SEQ ID NO: 981449 - DNA, 25 bp, Mus musculus
tgggacaacggatcgagaaagctac

SEQ ID NO: 981450 - DNA, 25 bp, Mus musculus
tgggacaacggatcggtcttggaaa

SEQ ID NO: 981451 - DNA, 25 bp, Mus musculus
tgggacaattgaacaattgcctata

SEQ ID NO: 981452 - DNA, 25 bp, Mus musculus
tgggacaattgactggctgtgtttt

SEQ ID NO: 981453 - DNA, 25 bp, Mus musculus
tgggacaattgagtggctgtgtttt

SEQ ID NO: 981454 - DNA, 25 bp, Mus musculus
tgggacaattgatcaattgcctata

SEQ ID NO: 981455 - DNA, 25 bp, Mus musculus
tgggacacaaacgacgtataagtat

SEQ ID NO: 981456 - DNA, 25 bp, Mus musculus
tgggacacaaacgaggtataagtat

SEQ ID NO: 981457 - DNA, 25 bp, Mus musculus
tgggacagagccgagcaacaaggcg

SEQ ID NO: 981458 - DNA, 25 bp, Mus musculus
tgggacagaggcgagcaacaaggcg

SEQ ID NO: 981459 - DNA, 25 bp, Mus musculus
tgggacagcaagagcctactttggt

SEQ ID NO: 981460 - DNA, 25 bp, Mus musculus
tgggacagcaagtgcctactttggt

SEQ ID NO: 981461 - DNA, 25 bp, Mus musculus
tgggacatccgtggcctagcccatg

SEQ ID NO: 981462 - DNA, 25 bp, Mus musculus
tgggacatccgtgggctagcccatg

SEQ ID NO: 981463 - DNA, 25 bp, Mus musculus
tgggaccaactccgtacctgagccc

SEQ ID NO: 981464 - DNA, 25 bp, Mus musculus
tgggaccaactcggtacctgagccc

SEQ ID NO: 981465 - DNA, 25 bp, Mus musculus
tgggaccatcacaacatctgatact

SEQ ID NO: 981466 - DNA, 25 bp, Mus musculus
tgggaccatcacaagatctgatact

SEQ ID NO: 981467 - DNA, 25 bp, Mus musculus
tgggaccatccgctccaagctctct

SEQ ID NO: 981468 - DNA, 25 bp, Mus musculus
tgggaccatccggtccaagctctct

SEQ ID NO: 981469 - DNA, 25 bp, Mus musculus
tgggacccaggacacacagctgcag

SEQ ID NO: 981470 - DNA, 25 bp, Mus musculus
tgggacccaggacagacagctgcag

SEQ ID NO: 981471 - DNA, 25 bp, Mus musculus
tgggacccagttcgttcatctggct

SEQ ID NO: 981472 - DNA, 25 bp, Mus musculus
tgggacccagttggttcatctggct

SEQ ID NO: 981473 - DNA, 25 bp, Mus musculus
tgggacccatcgcagcaaatggctt

SEQ ID NO: 981474 - DNA, 25 bp, Mus musculus
tgggacccatcggagcaaatggctt

SEQ ID NO: 981475 - DNA, 25 bp, Mus musculus
tgggacctacctatcacaaggctgc

SEQ ID NO: 981476 - DNA, 25 bp, Mus musculus
tgggacctacctgaactacctgggg

SEQ ID NO: 981477 - DNA, 25 bp, Mus musculus
tgggacctacgtatcacaaggctgc

SEQ ID NO: 981478 - DNA, 25 bp, Mus musculus
tgggacctacgtgaactacctgggg

SEQ ID NO: 981479 - DNA, 25 bp, Mus musculus
tgggacctcaggctgactgctgtcc

SEQ ID NO: 981480 - DNA, 25 bp, Mus musculus
tgggacctcagggtgactgctgtcc

SEQ ID NO: 981481 - DNA, 25 bp, Mus musculus
tgggacgtgaagagcctggagtcag

SEQ ID NO: 981482 - DNA, 25 bp, Mus musculus
tgggacgtgaagtgcctggagtcag

SEQ ID NO: 981483 - DNA, 25 bp, Mus musculus
tgggacgtttcccacatctgtctcg

SEQ ID NO: 981484 - DNA, 25 bp, Mus musculus
tgggacgtttcccagatctgtctcg

SEQ ID NO: 981485 - DNA, 25 bp, Mus musculus
tgggactaccagccctgtacggaga

SEQ ID NO: 981486 - DNA, 25 bp, Mus musculus
tgggactaccaggcctgtacggaga

SEQ ID NO: 981487 - DNA, 25 bp, Mus musculus
tgggactccaggcattgtaatggcg

SEQ ID NO: 981488 - DNA, 25 bp, Mus musculus
tgggactccagggattgtaatggcg

SEQ ID NO: 981489 - DNA, 25 bp, Mus musculus
tgggactgcagaatcacagatttga

SEQ ID NO: 981490 - DNA, 25 bp, Mus musculus
tgggactgcagaatgacagatttga

SEQ ID NO: 981491 - DNA, 25 bp, Mus musculus
tgggacttactacacctgggcatgg

SEQ ID NO: 981492 - DNA, 25 bp, Mus musculus
tgggacttactacacgtggctgcgg

SEQ ID NO: 981493 - DNA, 25 bp, Mus musculus
tgggacttactacagctgggcatgg

SEQ ID NO: 981494 - DNA, 25 bp, Mus musculus
tgggacttactacaggtggctgcgg

SEQ ID NO: 981495 - DNA, 25 bp, Mus musculus
tgggacttactgcgtttgaatgccg

SEQ ID NO: 981496 - DNA, 25 bp, Mus musculus
tgggacttactgggtttgaatgccg

SEQ ID NO: 981497 - DNA, 25 bp, Mus musculus
tgggagaaagaacgcatgtcatgtt

SEQ ID NO: 981498 - DNA, 25 bp, Mus musculus
tgggagaaagaaggcatgtcatgtt

SEQ ID NO: 981499 - DNA, 25 bp, Mus musculus
tgggagaaatgtgtcgcttcaggga

SEQ ID NO: 981500 - DNA, 25 bp, Mus musculus
tgggagaaatgtgtggcttcaggga

SEQ ID NO: 981501 - DNA, 25 bp, Mus musculus
tgggagaactagcacgtgacttaag

SEQ ID NO: 981502 - DNA, 25 bp, Mus musculus
tgggagaactagcaggtgacttaag

SEQ ID NO: 981503 - DNA, 25 bp, Mus musculus
tgggagacagaaagatgtagacaaa

SEQ ID NO: 981504 - DNA, 25 bp, Mus musculus
tgggagacagtaagatgtagacaaa

SEQ ID NO: 981505 - DNA, 25 bp, Mus musculus
tgggagaccacaatttccatccagt

SEQ ID NO: 981506 - DNA, 25 bp, Mus musculus
tgggagaccacattttccatccagt

SEQ ID NO: 981507 - DNA, 25 bp, Mus musculus
tgggagacgaggctctttcacgagg

SEQ ID NO: 981508 - DNA, 25 bp, Mus musculus
tgggagacgagggtctttcacgagg

SEQ ID NO: 981509 - DNA, 25 bp, Mus musculus
tgggagagagccaccatgacaaccc

SEQ ID NO: 981510 - DNA, 25 bp, Mus musculus
tgggagagaggcaccatgacaaccc

SEQ ID NO: 981511 - DNA, 25 bp, Mus musculus
tgggagagatctggttgctccttat

SEQ ID NO: 981512 - DNA, 25 bp, Mus musculus
tgggagagatgtggttgctccttat

SEQ ID NO: 981513 - DNA, 25 bp, Mus musculus
tgggagagcagagccttggaaagac

SEQ ID NO: 981514 - DNA, 25 bp, Mus musculus
tgggagagcagagcgttggaaagac

SEQ ID NO: 981515 - DNA, 25 bp, Mus musculus
tgggagaggacgcgtgagcatgcca

SEQ ID NO: 981516 - DNA, 25 bp, Mus musculus
tgggagaggacgggtgagcatgcca

SEQ ID NO: 981517 - DNA, 25 bp, Mus musculus
tgggagatacagcgcatggatgggc

SEQ ID NO: 981518 - DNA, 25 bp, Mus musculus
tgggagatacagggcatggatgggc

SEQ ID NO: 981519 - DNA, 25 bp, Mus musculus
tgggagatgcctatgctgccagaga

SEQ ID NO: 981520 - DNA, 25 bp, Mus musculus
tgggagatgcgtatgctgccagaga

SEQ ID NO: 981521 - DNA, 25 bp, Mus musculus
tgggagcagaaagcaggaattactt

SEQ ID NO: 981522 - DNA, 25 bp, Mus musculus
tgggagcagaaagctggaattactt

SEQ ID NO: 981523 - DNA, 25 bp, Mus musculus
tgggagcatgaacaatgagatgctc

SEQ ID NO: 981524 - DNA, 25 bp, Mus musculus
tgggagcatgtacaatgagatgctc

SEQ ID NO: 981525 - DNA, 25 bp, Mus musculus
tgggagccaacaatcctatgatggg

SEQ ID NO: 981526 - DNA, 25 bp, Mus musculus
tgggagccaacattcctatgatggg

SEQ ID NO: 981527 - DNA, 25 bp, Mus musculus
tgggagccaccgtggagttcacagt

SEQ ID NO: 981528 - DNA, 25 bp, Mus musculus
tgggagccacggtggagttcacagt

SEQ ID NO: 981529 - DNA, 25 bp, Mus musculus
tgggagctaccccacgtcccgatcc

SEQ ID NO: 981530 - DNA, 25 bp, Mus musculus
tgggagctaccccaggtcccgatcc

SEQ ID NO: 981531 - DNA, 25 bp, Mus musculus
tgggagctgaaagacgtgacagtga

SEQ ID NO: 981532 - DNA, 25 bp, Mus musculus
tgggagctgaaagaggtgacagtga

SEQ ID NO: 981533 - DNA, 25 bp, Mus musculus
tgggagctgacagaccttttcttca

SEQ ID NO: 981534 - DNA, 25 bp, Mus musculus
tgggagctgacagagcttttcttca

SEQ ID NO: 981535 - DNA, 25 bp, Mus musculus
tgggagcttgccaaacgcggagcgt

SEQ ID NO: 981536 - DNA, 25 bp, Mus musculus
tgggagcttgcctaacgcggagcgt

SEQ ID NO: 981537 - DNA, 25 bp, Mus musculus
tgggaggagaagctcctgttgagtc

SEQ ID NO: 981538 - DNA, 25 bp, Mus musculus
tgggaggagaaggtcctgttgagtc

SEQ ID NO: 981539 - DNA, 25 bp, Mus musculus
tgggaggagcagatattcagtgaac

SEQ ID NO: 981540 - DNA, 25 bp, Mus musculus
tgggaggagcagttattcagtgaac

SEQ ID NO: 981541 - DNA, 25 bp, Mus musculus
tgggaggagctgaacctcacatgtc

SEQ ID NO: 981542 - DNA, 25 bp, Mus musculus
tgggaggagctgaagctcacatgtc

SEQ ID NO: 981543 - DNA, 25 bp, Mus musculus
tgggaggcaggacgagtttcggacg

SEQ ID NO: 981544 - DNA, 25 bp, Mus musculus
tgggaggcaggaggagtttcggacg

SEQ ID NO: 981545 - DNA, 25 bp, Mus musculus
tgggaggtacagagagtgcaaacgc

SEQ ID NO: 981546 - DNA, 25 bp, Mus musculus
tgggaggtacagtgagtgcaaacgc

SEQ ID NO: 981547 - DNA, 25 bp, Mus musculus
tgggagtaagatccttggaggagag

SEQ ID NO: 981548 - DNA, 25 bp, Mus musculus
tgggagtaagttccttggaggagag

SEQ ID NO: 981549 - DNA, 25 bp, Mus musculus
tgggagtactatcactcagtgtaca

SEQ ID NO: 981550 - DNA, 25 bp, Mus musculus
tgggagtactatgactcagtgtaca

SEQ ID NO: 981551 - DNA, 25 bp, Mus musculus
tgggagtgatcgccctgtggtcagg

SEQ ID NO: 981552 - DNA, 25 bp, Mus musculus
tgggagtgatcggcctgtggtcagg

SEQ ID NO: 981553 - DNA, 25 bp, Mus musculus
tgggagtgatttctcactggctgct

SEQ ID NO: 981554 - DNA, 25 bp, Mus musculus
tgggagtgatttctgactggctgct

SEQ ID NO: 981555 - DNA, 25 bp, Mus musculus
tgggagtgtgttcatgtgaacgagt

SEQ ID NO: 981556 - DNA, 25 bp, Mus musculus
tgggagtgtgttgatgtgaacgagt

SEQ ID NO: 981557 - DNA, 25 bp, Mus musculus
tgggagttggtaaaagtttatggag

SEQ ID NO: 981558 - DNA, 25 bp, Mus musculus
tgggagttggtaaatgtttatggag

SEQ ID NO: 981559 - DNA, 25 bp, Mus musculus
tgggagtttgatactatttgcaaac

SEQ ID NO: 981560 - DNA, 25 bp, Mus musculus
tgggagtttgttactatttgcaaac

SEQ ID NO: 981561 - DNA, 25 bp, Mus musculus
tgggataaagcattccagcagattt

SEQ ID NO: 981562 - DNA, 25 bp, Mus musculus
tgggataaaggattccagcagattt

SEQ ID NO: 981563 - DNA, 25 bp, Mus musculus
tgggatacaaagtcctctcagcagg

SEQ ID NO: 981564 - DNA, 25 bp, Mus musculus
tgggatacaacaacaatttttattc

SEQ ID NO: 981565 - DNA, 25 bp, Mus musculus
tgggatacaagaacaatttttattc

SEQ ID NO: 981566 - DNA, 25 bp, Mus musculus
tgggatacaatgtcctctcagcagg

SEQ ID NO: 981567 - DNA, 25 bp, Mus musculus
tgggatacagtgcactgccattttt

SEQ ID NO: 981568 - DNA, 25 bp, Mus musculus
tgggatacagtggactgccattttt

SEQ ID NO: 981569 - DNA, 25 bp, Mus musculus
tgggataccgcaaactgcaacaggt

SEQ ID NO: 981570 - DNA, 25 bp, Mus musculus
tgggataccgcaaagtgcaacaggt

SEQ ID NO: 981571 - DNA, 25 bp, Mus musculus
tgggatatccgtggactgggtcacg

SEQ ID NO: 981572 - DNA, 25 bp, Mus musculus
tgggatatccgtggtctgggtcacg

SEQ ID NO: 981573 - DNA, 25 bp, Mus musculus
tgggatcaatgcagtgttctattac

SEQ ID NO: 981574 - DNA, 25 bp, Mus musculus
tgggatcaatgctgtgttctattac

SEQ ID NO: 981575 - DNA, 25 bp, Mus musculus
tgggatcagtattgatgatattgac

SEQ ID NO: 981576 - DNA, 25 bp, Mus musculus
tgggatcagttttgatgatattgac

SEQ ID NO: 981577 - DNA, 25 bp, Mus musculus
tgggatcattctctgcgtggtggct

SEQ ID NO: 981578 - DNA, 25 bp, Mus musculus
tgggatcattgtctgcgtggtggct

SEQ ID NO: 981579 - DNA, 25 bp, Mus musculus
tgggatccaacgacaatcagcgcct

SEQ ID NO: 981580 - DNA, 25 bp, Mus musculus
tgggatccaacgacattgatacact

SEQ ID NO: 981581 - DNA, 25 bp, Mus musculus
tgggatccaacgactatcagcgcct

SEQ ID NO: 981582 - DNA, 25 bp, Mus musculus
tgggatccaacgactttgatacact

SEQ ID NO: 981583 - DNA, 25 bp, Mus musculus
tgggatcgggcacgttggtggaaag

SEQ ID NO: 981584 - DNA, 25 bp, Mus musculus
tgggatcgggcaggttggtggaaag

SEQ ID NO: 981585 - DNA, 25 bp, Mus musculus
tgggatctcagacggatttgaccca

SEQ ID NO: 981586 - DNA, 25 bp, Mus musculus
tgggatctcagagggatttgaccca

SEQ ID NO: 981587 - DNA, 25 bp, Mus musculus
tgggatgaaacgcttctgtgatgac

SEQ ID NO: 981588 - DNA, 25 bp, Mus musculus
tgggatgaaacggttctgtgatgac

SEQ ID NO: 981589 - DNA, 25 bp, Mus musculus
tgggatgaagctgaccaagatggca

SEQ ID NO: 981590 - DNA, 25 bp, Mus musculus
tgggatgaagctgagcaagatggca

SEQ ID NO: 981591 - DNA, 25 bp, Mus musculus
tgggatgaagcttggccttgccatc

SEQ ID NO: 981592 - DNA, 25 bp, Mus musculus
tgggatgaaggttggccttgccatc

SEQ ID NO: 981593 - DNA, 25 bp, Mus musculus
tgggatgataacacagaagtaatcc

SEQ ID NO: 981594 - DNA, 25 bp, Mus musculus
tgggatgataacactgaagtaatcc

SEQ ID NO: 981595 - DNA, 25 bp, Mus musculus
tgggatgccgatgacttccggatct

SEQ ID NO: 981596 - DNA, 25 bp, Mus musculus
tgggatgccgttgacttccggatct

SEQ ID NO: 981597 - DNA, 25 bp, Mus musculus
tgggatgctactcacggccacgtgg

SEQ ID NO: 981598 - DNA, 25 bp, Mus musculus
tgggatgctactcacgggcagttgg

SEQ ID NO: 981599 - DNA, 25 bp, Mus musculus
tgggatgctactcagggccacgtgg

SEQ ID NO: 981600 - DNA, 25 bp, Mus musculus
tgggatgctactcaggggcagttgg

SEQ ID NO: 981601 - DNA, 25 bp, Mus musculus
tgggatgtatctctcagtgaaaggt

SEQ ID NO: 981602 - DNA, 25 bp, Mus musculus
tgggatgtatgtctcagtgaaaggt

SEQ ID NO: 981603 - DNA, 25 bp, Mus musculus
tgggatgtcacgaagttaaagtctg

SEQ ID NO: 981604 - DNA, 25 bp, Mus musculus
tgggatgtcacgtagttaaagtctg

SEQ ID NO: 981605 - DNA, 25 bp, Mus musculus
tgggatgttaagctgcatggcggcc

SEQ ID NO: 981606 - DNA, 25 bp, Mus musculus
tgggatgttaaggtgcatggcggcc

SEQ ID NO: 981607 - DNA, 25 bp, Mus musculus
tgggattattatcctttctcccaga

SEQ ID NO: 981608 - DNA, 25 bp, Mus musculus
tgggattattatgctttctcccaga

SEQ ID NO: 981609 - DNA, 25 bp, Mus musculus
tgggattcagaagataattggagaa

SEQ ID NO: 981610 - DNA, 25 bp, Mus musculus
tgggattcagacattaggattggac

SEQ ID NO: 981611 - DNA, 25 bp, Mus musculus
tgggattcagtagataattggagaa

SEQ ID NO: 981612 - DNA, 25 bp, Mus musculus
tgggattcagtcattaggattggac

SEQ ID NO: 981613 - DNA, 25 bp, Mus musculus
tgggatttcaagaccctagagtctt

SEQ ID NO: 981614 - DNA, 25 bp, Mus musculus
tgggatttcaagtccctagagtctt

SEQ ID NO: 981615 - DNA, 25 bp, Mus musculus
tgggatttgtcgccagagagacaag

SEQ ID NO: 981616 - DNA, 25 bp, Mus musculus
tgggatttgtcggcagagagacaag

SEQ ID NO: 981617 - DNA, 25 bp, Mus musculus
tgggcaaaatggcggagcaacctat

SEQ ID NO: 981618 - DNA, 25 bp, Mus musculus
tgggcaaaatgggggagcaacctat

SEQ ID NO: 981619 - DNA, 25 bp, Mus musculus
tgggcaaagagtcacacatttacat

SEQ ID NO: 981620 - DNA, 25 bp, Mus musculus
tgggcaaagagtcagacatttacat

SEQ ID NO: 981621 - DNA, 25 bp, Mus musculus
tgggcaaaggcgtcctgatccccac

SEQ ID NO: 981622 - DNA, 25 bp, Mus musculus
tgggcaaaggcgtcgtgatccccac

SEQ ID NO: 981623 - DNA, 25 bp, Mus musculus
tgggcacaagccgacccaagctcca

SEQ ID NO: 981624 - DNA, 25 bp, Mus musculus
tgggcacaagcgtgtggactgcgat

SEQ ID NO: 981625 - DNA, 25 bp, Mus musculus
tgggcacaaggcgacccaagctcca

SEQ ID NO: 981626 - DNA, 25 bp, Mus musculus
tgggcacaagggtgtggactgcgat

SEQ ID NO: 981627 - DNA, 25 bp, Mus musculus
tgggcacgggagaccgggtttgcac

SEQ ID NO: 981628 - DNA, 25 bp, Mus musculus
tgggcacgggagcctatgggaaggt

SEQ ID NO: 981629 - DNA, 25 bp, Mus musculus
tgggcacgggaggctatgggaaggt

SEQ ID NO: 981630 - DNA, 25 bp, Mus musculus
tgggcacgggagtccgggtttgcac

SEQ ID NO: 981631 - DNA, 25 bp, Mus musculus
tgggcagaatgctacagtacagtga

SEQ ID NO: 981632 - DNA, 25 bp, Mus musculus
tgggcagaatgctagagtacagtga

SEQ ID NO: 981633 - DNA, 25 bp, Mus musculus
tgggcagaggtgctgctctctgatc

SEQ ID NO: 981634 - DNA, 25 bp, Mus musculus
tgggcagaggtggtgctctctgatc

SEQ ID NO: 981635 - DNA, 25 bp, Mus musculus
tgggcagagtatcccagtggcggtc

SEQ ID NO: 981636 - DNA, 25 bp, Mus musculus
tgggcagagtttcccagtggcggtc

SEQ ID NO: 981637 - DNA, 25 bp, Mus musculus
tgggcagcccacaacttaactggcc

SEQ ID NO: 981638 - DNA, 25 bp, Mus musculus
tgggcagcccacaagttaactggcc

SEQ ID NO: 981639 - DNA, 25 bp, Mus musculus
tgggcagctgagattcctgctgctt

SEQ ID NO: 981640 - DNA, 25 bp, Mus musculus
tgggcagctgagctgtgactttgag

SEQ ID NO: 981641 - DNA, 25 bp, Mus musculus
tgggcagctgaggtgtgactttgag

SEQ ID NO: 981642 - DNA, 25 bp, Mus musculus
tgggcagctgagtttcctgctgctt

SEQ ID NO: 981643 - DNA, 25 bp, Mus musculus
tgggcaggagatgcagtgggactgt

SEQ ID NO: 981644 - DNA, 25 bp, Mus musculus
tgggcaggagttgcagtgggactgt

SEQ ID NO: 981645 - DNA, 25 bp, Mus musculus
tgggcaggcctgcccagcgcagact

SEQ ID NO: 981646 - DNA, 25 bp, Mus musculus
tgggcaggcctgcgcagacttaatg

SEQ ID NO: 981647 - DNA, 25 bp, Mus musculus
tgggcaggcctggccagcgcagact

SEQ ID NO: 981648 - DNA, 25 bp, Mus musculus
tgggcaggcctgggcagacttaatg

SEQ ID NO: 981649 - DNA, 25 bp, Mus musculus
tgggcagggggcggcatccagagca

SEQ ID NO: 981650 - DNA, 25 bp, Mus musculus
tgggcagggggcgggatccagagca

SEQ ID NO: 981651 - DNA, 25 bp, Mus musculus
tgggcaggtaatcacctacaagcag

SEQ ID NO: 981652 - DNA, 25 bp, Mus musculus
tgggcaggtattcacctacaagcag

SEQ ID NO: 981653 - DNA, 25 bp, Mus musculus
tgggcatatgctgcccaaccctgca

SEQ ID NO: 981654 - DNA, 25 bp, Mus musculus
tgggcatatggtgcccaaccctgca

SEQ ID NO: 981655 - DNA, 25 bp, Mus musculus
tgggcatcacagacagtacaggcta

SEQ ID NO: 981656 - DNA, 25 bp, Mus musculus
tgggcatcacagtcagtacaggcta

SEQ ID NO: 981657 - DNA, 25 bp, Mus musculus
tgggcatccttgcgccaccaattca

SEQ ID NO: 981658 - DNA, 25 bp, Mus musculus
tgggcatccttgggccaccaattca

SEQ ID NO: 981659 - DNA, 25 bp, Mus musculus
tgggcatgcaacatactgctggctg

SEQ ID NO: 981660 - DNA, 25 bp, Mus musculus
tgggcatgcaacattctgctggctg

SEQ ID NO: 981661 - DNA, 25 bp, Mus musculus
tgggcatggagcaacttcattccct

SEQ ID NO: 981662 - DNA, 25 bp, Mus musculus
tgggcatggagcaagttcattccct

SEQ ID NO: 981663 - DNA, 25 bp, Mus musculus
tgggcatttttgcgtccccatggat

SEQ ID NO: 981664 - DNA, 25 bp, Mus musculus
tgggcatttttgggtccccatggat

SEQ ID NO: 981665 - DNA, 25 bp, Mus musculus
tgggccaaagctgacaaggaagaag

SEQ ID NO: 981666 - DNA, 25 bp, Mus musculus
tgggccaaagctgagaaggaagaag

SEQ ID NO: 981667 - DNA, 25 bp, Mus musculus
tgggccaagagacccaagcagaggc

SEQ ID NO: 981668 - DNA, 25 bp, Mus musculus
tgggccaagagagccaagcagaggc

SEQ ID NO: 981669 - DNA, 25 bp, Mus musculus
tgggccacacagcggaatatgggtc

SEQ ID NO: 981670 - DNA, 25 bp, Mus musculus
tgggccacacaggggaatatgggtc

SEQ ID NO: 981671 - DNA, 25 bp, Mus musculus
tgggccacaggatgcccaggcagac

SEQ ID NO: 981672 - DNA, 25 bp, Mus musculus
tgggccacaggatgcgcagactcag

SEQ ID NO: 981673 - DNA, 25 bp, Mus musculus
tgggccacaggatggccaggcagac

SEQ ID NO: 981674 - DNA, 25 bp, Mus musculus
tgggccacaggatgggcagactcag

SEQ ID NO: 981675 - DNA, 25 bp, Mus musculus
tgggccagccggcctctactccttt

SEQ ID NO: 981676 - DNA, 25 bp, Mus musculus
tgggccagccgggctctactccttt

SEQ ID NO: 981677 - DNA, 25 bp, Mus musculus
tgggccagtatggacacacggacta

SEQ ID NO: 981678 - DNA, 25 bp, Mus musculus
tgggccagtatggacatcctcacca

SEQ ID NO: 981679 - DNA, 25 bp, Mus musculus
tgggccagtatggagacacggacta

SEQ ID NO: 981680 - DNA, 25 bp, Mus musculus
tgggccagtatggagatcctcacca

SEQ ID NO: 981681 - DNA, 25 bp, Mus musculus
tgggccatggagcgaggcacagacc

SEQ ID NO: 981682 - DNA, 25 bp, Mus musculus
tgggccatggagggaggcacagacc

SEQ ID NO: 981683 - DNA, 25 bp, Mus musculus
tgggcccaccaacctgcagctgaac

SEQ ID NO: 981684 - DNA, 25 bp, Mus musculus
tgggcccaccaagctgcagctgaac

SEQ ID NO: 981685 - DNA, 25 bp, Mus musculus
tgggccccaacagccggccacagat

SEQ ID NO: 981686 - DNA, 25 bp, Mus musculus
tgggccccaacagccggtctggagg

SEQ ID NO: 981687 - DNA, 25 bp, Mus musculus
tgggccccaacagcgggccacagat

SEQ ID NO: 981688 - DNA, 25 bp, Mus musculus
tgggccccaacagcgggtctggagg

SEQ ID NO: 981689 - DNA, 25 bp, Mus musculus
tgggccccagcgctatggaactggc

SEQ ID NO: 981690 - DNA, 25 bp, Mus musculus
tgggccccagggctatggaactggc

SEQ ID NO: 981691 - DNA, 25 bp, Mus musculus
tgggccccttggcatcatgcaggct

SEQ ID NO: 981692 - DNA, 25 bp, Mus musculus
tgggccccttgggatcatgcaggct

SEQ ID NO: 981693 - DNA, 25 bp, Mus musculus
tgggccctgcagcactgttcccgac

SEQ ID NO: 981694 - DNA, 25 bp, Mus musculus
tgggccctgcaggactgttcccgac

SEQ ID NO: 981695 - DNA, 25 bp, Mus musculus
tgggcctcaactccccaagacttcc

SEQ ID NO: 981696 - DNA, 25 bp, Mus musculus
tgggcctcaagtccccaagacttcc

SEQ ID NO: 981697 - DNA, 25 bp, Mus musculus
tgggcctgccagagcgcctgtttgc

SEQ ID NO: 981698 - DNA, 25 bp, Mus musculus
tgggcctgccagagggcctgtttgc

SEQ ID NO: 981699 - DNA, 25 bp, Mus musculus
tgggcctgctacaacgtgcagcaga

SEQ ID NO: 981700 - DNA, 25 bp, Mus musculus
tgggcctgctacaaggtgcagcaga

SEQ ID NO: 981701 - DNA, 25 bp, Mus musculus
tgggccttcctattcgccaacacat

SEQ ID NO: 981702 - DNA, 25 bp, Mus musculus
tgggccttcctattggccaacacat

SEQ ID NO: 981703 - DNA, 25 bp, Mus musculus
tgggcgaccgctcacttcatgggca

SEQ ID NO: 981704 - DNA, 25 bp, Mus musculus
tgggcgaccggtcacttcatgggca

SEQ ID NO: 981705 - DNA, 25 bp, Mus musculus
tgggcgataaagcatcccttccctg

SEQ ID NO: 981706 - DNA, 25 bp, Mus musculus
tgggcgataaaggatcccttccctg

SEQ ID NO: 981707 - DNA, 25 bp, Mus musculus
tgggcgcaccaacgccatggtggcg

SEQ ID NO: 981708 - DNA, 25 bp, Mus musculus
tgggcgcaccaaggccatggtggcg

SEQ ID NO: 981709 - DNA, 25 bp, Mus musculus
tgggcgcccgccgcagcaagcacac

SEQ ID NO: 981710 - DNA, 25 bp, Mus musculus
tgggcgcccggcgcagcaagcacac

SEQ ID NO: 981711 - DNA, 25 bp, Mus musculus
tgggcggctcaacgtggcccagctg

SEQ ID NO: 981712 - DNA, 25 bp, Mus musculus
tgggcggctcaaggtggcccagctg

SEQ ID NO: 981713 - DNA, 25 bp, Mus musculus
tgggcgtctgcagacgaatctggga

SEQ ID NO: 981714 - DNA, 25 bp, Mus musculus
tgggcgtctgcagaggaatctggga

SEQ ID NO: 981715 - DNA, 25 bp, Mus musculus
tgggcgtgcctggacaataggtgct

SEQ ID NO: 981716 - DNA, 25 bp, Mus musculus
tgggcgtgcctggacgtgctcctat

SEQ ID NO: 981717 - DNA, 25 bp, Mus musculus
tgggcgtgcctggagaataggtgct

SEQ ID NO: 981718 - DNA, 25 bp, Mus musculus
tgggcgtgcctggaggtgctcctat

SEQ ID NO: 981719 - DNA, 25 bp, Mus musculus
tgggcgttggacatatggcagatac

SEQ ID NO: 981720 - DNA, 25 bp, Mus musculus
tgggcgttggacttatggcagatac

SEQ ID NO: 981721 - DNA, 25 bp, Mus musculus
tgggctaaagagatttgaaagtgac

SEQ ID NO: 981722 - DNA, 25 bp, Mus musculus
tgggctaaagagttttgaaagtgac

SEQ ID NO: 981723 - DNA, 25 bp, Mus musculus
tgggctacagaggtcggcttactgt

SEQ ID NO: 981724 - DNA, 25 bp, Mus musculus
tgggctacagaggtctccaacaggc

SEQ ID NO: 981725 - DNA, 25 bp, Mus musculus
tgggctacagaggtgggcttactgt

SEQ ID NO: 981726 - DNA, 25 bp, Mus musculus
tgggctacagaggtgtccaacaggc

SEQ ID NO: 981727 - DNA, 25 bp, Mus musculus
tgggctatggagacccaacaggagg

SEQ ID NO: 981728 - DNA, 25 bp, Mus musculus
tgggctatggagctggtgctgtccg

SEQ ID NO: 981729 - DNA, 25 bp, Mus musculus
tgggctatggaggtggtgctgtccg

SEQ ID NO: 981730 - DNA, 25 bp, Mus musculus
tgggctatggagtcccaacaggagg

SEQ ID NO: 981731 - DNA, 25 bp, Mus musculus
tgggctcagcgacacattccggtat

SEQ ID NO: 981732 - DNA, 25 bp, Mus musculus
tgggctcagcgacagattccggtat

SEQ ID NO: 981733 - DNA, 25 bp, Mus musculus
tgggctccaactgcctgtggacata

SEQ ID NO: 981734 - DNA, 25 bp, Mus musculus
tgggctccaagtgcctgtggacata

SEQ ID NO: 981735 - DNA, 25 bp, Mus musculus
tgggctcgggttgacgctcgcctgt

SEQ ID NO: 981736 - DNA, 25 bp, Mus musculus
tgggctcgggttgaggctcgcctgt

SEQ ID NO: 981737 - DNA, 25 bp, Mus musculus
tgggctctacggctgacaccaggtc

SEQ ID NO: 981738 - DNA, 25 bp, Mus musculus
tgggctctacgggtgacaccaggtc

SEQ ID NO: 981739 - DNA, 25 bp, Mus musculus
tgggctctgaagcgtacaccatgag

SEQ ID NO: 981740 - DNA, 25 bp, Mus musculus
tgggctctgaagcgtggaataagca

SEQ ID NO: 981741 - DNA, 25 bp, Mus musculus
tgggctctgaagggtacaccatgag

SEQ ID NO: 981742 - DNA, 25 bp, Mus musculus
tgggctctgaagggtggaataagca

SEQ ID NO: 981743 - DNA, 25 bp, Mus musculus
tgggctctggagccttcattggtta

SEQ ID NO: 981744 - DNA, 25 bp, Mus musculus
tgggctctggaggcttcattggtta

SEQ ID NO: 981745 - DNA, 25 bp, Mus musculus
tgggctctgtagcacgtctagtgac

SEQ ID NO: 981746 - DNA, 25 bp, Mus musculus
tgggctctgtagcaggtctagtgac

SEQ ID NO: 981747 - DNA, 25 bp, Mus musculus
tgggctgaagagatttgaaagtgac

SEQ ID NO: 981748 - DNA, 25 bp, Mus musculus
tgggctgaagagttttgaaagtgac

SEQ ID NO: 981749 - DNA, 25 bp, Mus musculus
tgggctgatgacccagtcttatctc

SEQ ID NO: 981750 - DNA, 25 bp, Mus musculus
tgggctgatgaccctgtcttatctc

SEQ ID NO: 981751 - DNA, 25 bp, Mus musculus
tgggctgcatctctgaagaggacaa

SEQ ID NO: 981752 - DNA, 25 bp, Mus musculus
tgggctgcatctgtgaagaggacaa

SEQ ID NO: 981753 - DNA, 25 bp, Mus musculus
tgggctgccgacaaggatgaaggac

SEQ ID NO: 981754 - DNA, 25 bp, Mus musculus
tgggctgccgacaggtcaatataga

SEQ ID NO: 981755 - DNA, 25 bp, Mus musculus
tgggctgccgactaggatgaaggac

SEQ ID NO: 981756 - DNA, 25 bp, Mus musculus
tgggctgccgactggtcaatataga

SEQ ID NO: 981757 - DNA, 25 bp, Mus musculus
tgggctgggatcatagtctgcgtgg

SEQ ID NO: 981758 - DNA, 25 bp, Mus musculus
tgggctgggatcattgtctgcgtgg

SEQ ID NO: 981759 - DNA, 25 bp, Mus musculus
tgggctggtcagccgcgtgttccaa

SEQ ID NO: 981760 - DNA, 25 bp, Mus musculus
tgggctggtcaggcgcgtgttccaa

SEQ ID NO: 981761 - DNA, 25 bp, Mus musculus
tgggctgtggctcttaggcaggcgg

SEQ ID NO: 981762 - DNA, 25 bp, Mus musculus
tgggctgtgggtcttaggcaggcgg

SEQ ID NO: 981763 - DNA, 25 bp, Mus musculus
tggggaaaggtgaacgctgctggtt

SEQ ID NO: 981764 - DNA, 25 bp, Mus musculus
tggggaaaggtgaaggctgctggtt

SEQ ID NO: 981765 - DNA, 25 bp, Mus musculus
tggggaacagactttggacttcact

SEQ ID NO: 981766 - DNA, 25 bp, Mus musculus
tggggaacagatccagagctggtac

SEQ ID NO: 981767 - DNA, 25 bp, Mus musculus
tggggaacagtctttggacttcact

SEQ ID NO: 981768 - DNA, 25 bp, Mus musculus
tggggaacagttccagagctggtac

SEQ ID NO: 981769 - DNA, 25 bp, Mus musculus
tggggaacatcacatcattcagttt

SEQ ID NO: 981770 - DNA, 25 bp, Mus musculus
tggggaacatcagatcattcagttt

SEQ ID NO: 981771 - DNA, 25 bp, Mus musculus
tggggaactgctcgttcctgagtgc

SEQ ID NO: 981772 - DNA, 25 bp, Mus musculus
tggggaactgctggttcctgagtgc

SEQ ID NO: 981773 - DNA, 25 bp, Mus musculus
tggggaacttctcatcattcaatgt

SEQ ID NO: 981774 - DNA, 25 bp, Mus musculus
tggggaacttctgatcattcaatgt

SEQ ID NO: 981775 - DNA, 25 bp, Mus musculus
tggggaagagcttcatggaggtaaa

SEQ ID NO: 981776 - DNA, 25 bp, Mus musculus
tggggaagaggttcatggaggtaaa

SEQ ID NO: 981777 - DNA, 25 bp, Mus musculus
tggggaaggaagaagatcaggtttt

SEQ ID NO: 981778 - DNA, 25 bp, Mus musculus
tggggaaggaagtagatcaggtttt

SEQ ID NO: 981779 - DNA, 25 bp, Mus musculus
tggggacccacacgtgtggatcgac

SEQ ID NO: 981780 - DNA, 25 bp, Mus musculus
tggggacccacaggtgtggatcgac

SEQ ID NO: 981781 - DNA, 25 bp, Mus musculus
tggggaccctctcctccatccagga

SEQ ID NO: 981782 - DNA, 25 bp, Mus musculus
tggggaccctgtcctccatccagga

SEQ ID NO: 981783 - DNA, 25 bp, Mus musculus
tggggacctcaacgagcgcgggctg

SEQ ID NO: 981784 - DNA, 25 bp, Mus musculus
tggggacctcaaggagcgcgggctg

SEQ ID NO: 981785 - DNA, 25 bp, Mus musculus
tggggacttgggcacggctgttctc

SEQ ID NO: 981786 - DNA, 25 bp, Mus musculus
tggggacttggggacggctgttctc

SEQ ID NO: 981787 - DNA, 25 bp, Mus musculus
tggggagaagtccgtctttctgtgg

SEQ ID NO: 981788 - DNA, 25 bp, Mus musculus
tggggagaagtcggtctttctgtgg

SEQ ID NO: 981789 - DNA, 25 bp, Mus musculus
tggggagagacacaggaaacaacgt

SEQ ID NO: 981790 - DNA, 25 bp, Mus musculus
tggggagagacagaggaaacaacgt

SEQ ID NO: 981791 - DNA, 25 bp, Mus musculus
tggggagcggcggtcgtgtgccaag

SEQ ID NO: 981792 - DNA, 25 bp, Mus musculus
tggggagcggcggtctgatccattg

SEQ ID NO: 981793 - DNA, 25 bp, Mus musculus
tggggagcggcggtggtgtgccaag

SEQ ID NO: 981794 - DNA, 25 bp, Mus musculus
tggggagcggcggtgtgatccattg

SEQ ID NO: 981795 - DNA, 25 bp, Mus musculus
tggggagggcgacgtgctcctaatg

SEQ ID NO: 981796 - DNA, 25 bp, Mus musculus
tggggagggcgaggtgctcctaatg

SEQ ID NO: 981797 - DNA, 25 bp, Mus musculus
tggggagtctgcaaccatgcttttc

SEQ ID NO: 981798 - DNA, 25 bp, Mus musculus
tggggagtctgcaagcatgcttttc

SEQ ID NO: 981799 - DNA, 25 bp, Mus musculus
tggggagtttgacatcccactgaga

SEQ ID NO: 981800 - DNA, 25 bp, Mus musculus
tggggagtttgagatcccactgaga

SEQ ID NO: 981801 - DNA, 25 bp, Mus musculus
tggggataaagtctactggaattaa

SEQ ID NO: 981802 - DNA, 25 bp, Mus musculus
tggggataaagtgtactggaattaa

SEQ ID NO: 981803 - DNA, 25 bp, Mus musculus
tggggataattgccctgtggaagca

SEQ ID NO: 981804 - DNA, 25 bp, Mus musculus
tggggataattggcctgtggaagca

SEQ ID NO: 981805 - DNA, 25 bp, Mus musculus
tggggatcagcattattactacctg

SEQ ID NO: 981806 - DNA, 25 bp, Mus musculus
tggggatcaggattattactacctg

SEQ ID NO: 981807 - DNA, 25 bp, Mus musculus
tggggatcatgtcggtcacacagca

SEQ ID NO: 981808 - DNA, 25 bp, Mus musculus
tggggatcatgtgggtcacacagca

SEQ ID NO: 981809 - DNA, 25 bp, Mus musculus
tggggatccgcacacagctgagtat

SEQ ID NO: 981810 - DNA, 25 bp, Mus musculus
tggggatccggacacagctgagtat

SEQ ID NO: 981811 - DNA, 25 bp, Mus musculus
tggggcaaagctggtagagaaaacg

SEQ ID NO: 981812 - DNA, 25 bp, Mus musculus
tggggcaaaggtggtagagaaaacg

SEQ ID NO: 981813 - DNA, 25 bp, Mus musculus
tggggcagtttacaaatgcacttag

SEQ ID NO: 981814 - DNA, 25 bp, Mus musculus
tggggcagtttagaaatgcacttag

SEQ ID NO: 981815 - DNA, 25 bp, Mus musculus
tggggccaaggcgtcattaaggttg

SEQ ID NO: 981816 - DNA, 25 bp, Mus musculus
tggggccaaggcgtgattaaggttg

SEQ ID NO: 981817 - DNA, 25 bp, Mus musculus
tggggccatgatcagtacctatacc

SEQ ID NO: 981818 - DNA, 25 bp, Mus musculus
tggggccatgatgagtacctatacc

SEQ ID NO: 981819 - DNA, 25 bp, Mus musculus
tggggccccacgcatgctggtggac

SEQ ID NO: 981820 - DNA, 25 bp, Mus musculus
tggggccccacggatgctggtggac

SEQ ID NO: 981821 - DNA, 25 bp, Mus musculus
tggggccccatccgaagctcagaac

SEQ ID NO: 981822 - DNA, 25 bp, Mus musculus
tggggccccatcggaagctcagaac

SEQ ID NO: 981823 - DNA, 25 bp, Mus musculus
tggggccgagcaaccatgaaggtga

SEQ ID NO: 981824 - DNA, 25 bp, Mus musculus
tggggccgaggaaccatgaaggtga

SEQ ID NO: 981825 - DNA, 25 bp, Mus musculus
tggggcctacagaacaggaggccac

SEQ ID NO: 981826 - DNA, 25 bp, Mus musculus
tggggcctacagaagaggaggccac

SEQ ID NO: 981827 - DNA, 25 bp, Mus musculus
tggggcctggagcacatcatgttca

SEQ ID NO: 981828 - DNA, 25 bp, Mus musculus
tggggcctggaggacatcatgttca

SEQ ID NO: 981829 - DNA, 25 bp, Mus musculus
tggggccttgctgttgggagccctt

SEQ ID NO: 981830 - DNA, 25 bp, Mus musculus
tggggccttggtgttgggagccctt

SEQ ID NO: 981831 - DNA, 25 bp, Mus musculus
tggggcgcacagccctgtgaagcca

SEQ ID NO: 981832 - DNA, 25 bp, Mus musculus
tggggcgcacaggcctgtgaagcca

SEQ ID NO: 981833 - DNA, 25 bp, Mus musculus
tggggctaaaagaacaggtcctaca

SEQ ID NO: 981834 - DNA, 25 bp, Mus musculus
tggggctaaatgaacaggtcctaca

SEQ ID NO: 981835 - DNA, 25 bp, Mus musculus
tggggctatgcacatggctatgaac

SEQ ID NO: 981836 - DNA, 25 bp, Mus musculus
tggggctatgcagatggctatgaac

SEQ ID NO: 981837 - DNA, 25 bp, Mus musculus
tggggctccaaccaattgccggctg

SEQ ID NO: 981838 - DNA, 25 bp, Mus musculus
tggggctccaacgaattgccggctg

SEQ ID NO: 981839 - DNA, 25 bp, Mus musculus
tggggctcgcagcatccctgctgcc

SEQ ID NO: 981840 - DNA, 25 bp, Mus musculus
tggggctcgcaggatccctgctgcc

SEQ ID NO: 981841 - DNA, 25 bp, Mus musculus
tggggctctgctgtgtagatgccac

SEQ ID NO: 981842 - DNA, 25 bp, Mus musculus
tggggctctggtgtgtagatgccac

SEQ ID NO: 981843 - DNA, 25 bp, Mus musculus
tggggctgcccaaacagcatgccac

SEQ ID NO: 981844 - DNA, 25 bp, Mus musculus
tggggctgcccaaacagccccctca

SEQ ID NO: 981845 - DNA, 25 bp, Mus musculus
tggggctgcccaaaccctgagaccc

SEQ ID NO: 981846 - DNA, 25 bp, Mus musculus
tggggctgcccaaagagcatgccac

SEQ ID NO: 981847 - DNA, 25 bp, Mus musculus
tggggctgcccaaagagccccctca

SEQ ID NO: 981848 - DNA, 25 bp, Mus musculus
tggggctgcccaaagcctgagaccc

SEQ ID NO: 981849 - DNA, 25 bp, Mus musculus
tggggctgctgctcaggattaatga

SEQ ID NO: 981850 - DNA, 25 bp, Mus musculus
tggggctgctgctctggattaatga

SEQ ID NO: 981851 - DNA, 25 bp, Mus musculus
tggggctggtcaagctgggaagctg

SEQ ID NO: 981852 - DNA, 25 bp, Mus musculus
tggggctggtgaagctgggaagctg

SEQ ID NO: 981853 - DNA, 25 bp, Mus musculus
tggggcttaaagagcgcttggggca

SEQ ID NO: 981854 - DNA, 25 bp, Mus musculus
tggggcttaaagagggcttggggca

SEQ ID NO: 981855 - DNA, 25 bp, Mus musculus
tgggggaaggaggattcagctatgt

SEQ ID NO: 981856 - DNA, 25 bp, Mus musculus
tgggggaaggtggattcagctatgt

SEQ ID NO: 981857 - DNA, 25 bp, Mus musculus
tgggggacccagcccagagtcctac

SEQ ID NO: 981858 - DNA, 25 bp, Mus musculus
tgggggacccaggccagagtcctac

SEQ ID NO: 981859 - DNA, 25 bp, Mus musculus
tgggggacctcacaaggtctatatg

SEQ ID NO: 981860 - DNA, 25 bp, Mus musculus
tgggggacctcagaaggtctatatg

SEQ ID NO: 981861 - DNA, 25 bp, Mus musculus
tgggggcaccgacgtctccagcaga

SEQ ID NO: 981862 - DNA, 25 bp, Mus musculus
tgggggcaccgactcaaataattta

SEQ ID NO: 981863 - DNA, 25 bp, Mus musculus
tgggggcaccgaggtctccagcaga

SEQ ID NO: 981864 - DNA, 25 bp, Mus musculus
tgggggcaccgagtcaaataattta

SEQ ID NO: 981865 - DNA, 25 bp, Mus musculus
tgggggcatcaacctccggcaccag

SEQ ID NO: 981866 - DNA, 25 bp, Mus musculus
tgggggcatcaagctccggcaccag

SEQ ID NO: 981867 - DNA, 25 bp, Mus musculus
tgggggcattggcgtggacagtgac

SEQ ID NO: 981868 - DNA, 25 bp, Mus musculus
tgggggcattggggtggacagtgac

SEQ ID NO: 981869 - DNA, 25 bp, Mus musculus
tgggggccaagaaacatccgtcgtc

SEQ ID NO: 981870 - DNA, 25 bp, Mus musculus
tgggggccaagaaagatccgtcgtc

SEQ ID NO: 981871 - DNA, 25 bp, Mus musculus
tgggggccagctgatgtacagggtg

SEQ ID NO: 981872 - DNA, 25 bp, Mus musculus
tgggggccaggtgatgtacagggtg

SEQ ID NO: 981873 - DNA, 25 bp, Mus musculus
tgggggccgccgacctgtctcaact

SEQ ID NO: 981874 - DNA, 25 bp, Mus musculus
tgggggccgccgagtcctgtctcaa

SEQ ID NO: 981875 - DNA, 25 bp, Mus musculus
tgggggccgccgtcctgtctcaact

SEQ ID NO: 981876 - DNA, 25 bp, Mus musculus
tgggggccgccgtgtcctgtctcaa

SEQ ID NO: 981877 - DNA, 25 bp, Mus musculus
tgggggctggccggagttcacagct

SEQ ID NO: 981878 - DNA, 25 bp, Mus musculus
tgggggctgggcggagttcacagct

SEQ ID NO: 981879 - DNA, 25 bp, Mus musculus
tggggggaacctcactgggctgttg

SEQ ID NO: 981880 - DNA, 25 bp, Mus musculus
tggggggaacctcagtgggctgttg

SEQ ID NO: 981881 - DNA, 25 bp, Mus musculus
tgggggtatggagacgtgtcatcaa

SEQ ID NO: 981882 - DNA, 25 bp, Mus musculus
tgggggtatggagaggtgtcatcaa

SEQ ID NO: 981883 - DNA, 25 bp, Mus musculus
tggggtactgctgcaggtcctggtg

SEQ ID NO: 981884 - DNA, 25 bp, Mus musculus
tggggtactggtgcaggtcctggtg

SEQ ID NO: 981885 - DNA, 25 bp, Mus musculus
tggggtcctccacggctctttcacc

SEQ ID NO: 981886 - DNA, 25 bp, Mus musculus
tggggtcctccagggctctttcacc

SEQ ID NO: 981887 - DNA, 25 bp, Mus musculus
tggggtcctgtttaaccatcagcag

SEQ ID NO: 981888 - DNA, 25 bp, Mus musculus
tggggtcctgtttaagagttcagat

SEQ ID NO: 981889 - DNA, 25 bp, Mus musculus
tggggtcctgtttatccatcagcag

SEQ ID NO: 981890 - DNA, 25 bp, Mus musculus
tggggtcctgtttatgagttcagat

SEQ ID NO: 981891 - DNA, 25 bp, Mus musculus
tggggtgaaccgatacactgggacc

SEQ ID NO: 981892 - DNA, 25 bp, Mus musculus
tggggtgaaccgttacactgggacc

SEQ ID NO: 981893 - DNA, 25 bp, Mus musculus
tggggtgcagaatttctgaagtgaa

SEQ ID NO: 981894 - DNA, 25 bp, Mus musculus
tggggtgcagtatttctgaagtgaa

SEQ ID NO: 981895 - DNA, 25 bp, Mus musculus
tggggtggtgaccttaaagcagcca

SEQ ID NO: 981896 - DNA, 25 bp, Mus musculus
tggggtggtgtccttaaagcagcca

SEQ ID NO: 981897 - DNA, 25 bp, Mus musculus
tggggtgtgcacagtgtttccctgt

SEQ ID NO: 981898 - DNA, 25 bp, Mus musculus
tggggtgtgcactgtgtttccctgt

SEQ ID NO: 981899 - DNA, 25 bp, Mus musculus
tggggtgttaccaacgctgcagaga

SEQ ID NO: 981900 - DNA, 25 bp, Mus musculus
tggggtgttaccaaggctgcagaga

SEQ ID NO: 981901 - DNA, 25 bp, Mus musculus
tgggtaacacagaagccaccatggg

SEQ ID NO: 981902 - DNA, 25 bp, Mus musculus
tgggtaacacagtagccaccatggg

SEQ ID NO: 981903 - DNA, 25 bp, Mus musculus
tgggtacaagaggttctatagatgg

SEQ ID NO: 981904 - DNA, 25 bp, Mus musculus
tgggtacaagccaaaggtcattcca

SEQ ID NO: 981905 - DNA, 25 bp, Mus musculus
tgggtacaaggcaaaggtcattcca

SEQ ID NO: 981906 - DNA, 25 bp, Mus musculus
tgggtacaagtggttctatagatgg

SEQ ID NO: 981907 - DNA, 25 bp, Mus musculus
tgggtacatgcaatatgcccaagcc

SEQ ID NO: 981908 - DNA, 25 bp, Mus musculus
tgggtacatggaatatgcccaagcc

SEQ ID NO: 981909 - DNA, 25 bp, Mus musculus
tgggtaccccaaaacagaatcgcac

SEQ ID NO: 981910 - DNA, 25 bp, Mus musculus
tgggtaccccaaaagagaatcgcac

SEQ ID NO: 981911 - DNA, 25 bp, Mus musculus
tgggtataaagaccacgtccaagtc

SEQ ID NO: 981912 - DNA, 25 bp, Mus musculus
tgggtataaagagcacgtccaagtc

SEQ ID NO: 981913 - DNA, 25 bp, Mus musculus
tgggtatcaatgcatttggacgcat

SEQ ID NO: 981914 - DNA, 25 bp, Mus musculus
tgggtatcaatggatttggacgcat

SEQ ID NO: 981915 - DNA, 25 bp, Mus musculus
tgggtatttgctgctatacatttgc

SEQ ID NO: 981916 - DNA, 25 bp, Mus musculus
tgggtatttggtgctatacatttgc

SEQ ID NO: 981917 - DNA, 25 bp, Mus musculus
tgggtcaaagagaacgaagctatag

SEQ ID NO: 981918 - DNA, 25 bp, Mus musculus
tgggtcaaagagaaggaagctatag

SEQ ID NO: 981919 - DNA, 25 bp, Mus musculus
tgggtccgacagcatggaaagccta

SEQ ID NO: 981920 - DNA, 25 bp, Mus musculus
tgggtccgacaggatggaaagccta

SEQ ID NO: 981921 - DNA, 25 bp, Mus musculus
tgggtccgccagatcttcattcaca

SEQ ID NO: 981922 - DNA, 25 bp, Mus musculus
tgggtccgccagttcttcattcaca

SEQ ID NO: 981923 - DNA, 25 bp, Mus musculus
tgggtcgagagattcataatcatga

SEQ ID NO: 981924 - DNA, 25 bp, Mus musculus
tgggtcgagagattgataatcatga

SEQ ID NO: 981925 - DNA, 25 bp, Mus musculus
tgggtcggaagaattaggcccgcag

SEQ ID NO: 981926 - DNA, 25 bp, Mus musculus
tgggtcggaagatttaggcccgcag

SEQ ID NO: 981927 - DNA, 25 bp, Mus musculus
tgggtcttgcctttcgtcacctaga

SEQ ID NO: 981928 - DNA, 25 bp, Mus musculus
tgggtcttgcctttggtcacctaga

SEQ ID NO: 981929 - DNA, 25 bp, Mus musculus
tgggtgaagaagaagctgactgcgg

SEQ ID NO: 981930 - DNA, 25 bp, Mus musculus
tgggtgaagaagtagctgactgcgg

SEQ ID NO: 981931 - DNA, 25 bp, Mus musculus
tgggtgaagcagcagtggcatgact

SEQ ID NO: 981932 - DNA, 25 bp, Mus musculus
tgggtgaagcaggagtggcatgact

SEQ ID NO: 981933 - DNA, 25 bp, Mus musculus
tgggtgacctggcatggattcatgg

SEQ ID NO: 981934 - DNA, 25 bp, Mus musculus
tgggtgacctgggatggattcatgg

SEQ ID NO: 981935 - DNA, 25 bp, Mus musculus
tgggtgacgcaaaacgccaaatcat

SEQ ID NO: 981936 - DNA, 25 bp, Mus musculus
tgggtgacgcaaaaggccaaatcat

SEQ ID NO: 981937 - DNA, 25 bp, Mus musculus
tgggtgatgactcagcttctaagga

SEQ ID NO: 981938 - DNA, 25 bp, Mus musculus
tgggtgatgactccccagtgtttcc

SEQ ID NO: 981939 - DNA, 25 bp, Mus musculus
tgggtgatgactcttgctttcacta

SEQ ID NO: 981940 - DNA, 25 bp, Mus musculus
tgggtgatgactgagcttctaagga

SEQ ID NO: 981941 - DNA, 25 bp, Mus musculus
tgggtgatgactgcccagtgtttcc

SEQ ID NO: 981942 - DNA, 25 bp, Mus musculus
tgggtgatgactgttgctttcacta

SEQ ID NO: 981943 - DNA, 25 bp, Mus musculus
tgggtgattctcttcccattcattg

SEQ ID NO: 981944 - DNA, 25 bp, Mus musculus
tgggtgattctcttcgattgttcat

SEQ ID NO: 981945 - DNA, 25 bp, Mus musculus
tgggtgattctcttgccattcattg

SEQ ID NO: 981946 - DNA, 25 bp, Mus musculus
tgggtgattctcttggattgttcat

SEQ ID NO: 981947 - DNA, 25 bp, Mus musculus
tgggtgcaggggagtgccccagaga

SEQ ID NO: 981948 - DNA, 25 bp, Mus musculus
tgggtgcaggggcaacagctgtgcc

SEQ ID NO: 981949 - DNA, 25 bp, Mus musculus
tgggtgcagggggaacagctgtgcc

SEQ ID NO: 981950 - DNA, 25 bp, Mus musculus
tgggtgcaggggtgtgccccagaga

SEQ ID NO: 981951 - DNA, 25 bp, Mus musculus
tgggtgcccgagcagccgatgtcct

SEQ ID NO: 981952 - DNA, 25 bp, Mus musculus
tgggtgcccgagccgatgtcctggt

SEQ ID NO: 981953 - DNA, 25 bp, Mus musculus
tgggtgcccgaggagccgatgtcct

SEQ ID NO: 981954 - DNA, 25 bp, Mus musculus
tgggtgcccgaggcgatgtcctggt

SEQ ID NO: 981955 - DNA, 25 bp, Mus musculus
tgggtgcctacacagaagcggtcag

SEQ ID NO: 981956 - DNA, 25 bp, Mus musculus
tgggtgcctacagagaagcggtcag

SEQ ID NO: 981957 - DNA, 25 bp, Mus musculus
tgggtggaaacaccatgttctcaca

SEQ ID NO: 981958 - DNA, 25 bp, Mus musculus
tgggtggaaacagcatgttctcaca

SEQ ID NO: 981959 - DNA, 25 bp, Mus musculus
tgggtggcttatctcatccctatgt

SEQ ID NO: 981960 - DNA, 25 bp, Mus musculus
tgggtggcttatctgatccctatgt

SEQ ID NO: 981961 - DNA, 25 bp, Mus musculus
tgggtggtccaacggtcaagtatgg

SEQ ID NO: 981962 - DNA, 25 bp, Mus musculus
tgggtggtccaagggtcaagtatgg

SEQ ID NO: 981963 - DNA, 25 bp, Mus musculus
tgggtgtacaagatacttgggggct

SEQ ID NO: 981964 - DNA, 25 bp, Mus musculus
tgggtgtacaagttacttgggggct

SEQ ID NO: 981965 - DNA, 25 bp, Mus musculus
tgggtgtcatcgcgcgactcagtct

SEQ ID NO: 981966 - DNA, 25 bp, Mus musculus
tgggtgtcatcgcgggactcagtct

SEQ ID NO: 981967 - DNA, 25 bp, Mus musculus
tgggtgtgtgaaatgcacttagcga

SEQ ID NO: 981968 - DNA, 25 bp, Mus musculus
tgggtgtgtgcactgtgcagcatgg

SEQ ID NO: 981969 - DNA, 25 bp, Mus musculus
tgggtgtgtggactgtgcagcatgg

SEQ ID NO: 981970 - DNA, 25 bp, Mus musculus
tgggtgtgtgtaatgcacttagcga

SEQ ID NO: 981971 - DNA, 25 bp, Mus musculus
tgggtgttcaaactgaccttcagtc

SEQ ID NO: 981972 - DNA, 25 bp, Mus musculus
tgggtgttcaaagtgaccttcagtc

SEQ ID NO: 981973 - DNA, 25 bp, Mus musculus
tgggtgttgcagacaaatgggtcgg

SEQ ID NO: 981974 - DNA, 25 bp, Mus musculus
tgggtgttgcagtcaaatgggtcgg

SEQ ID NO: 981975 - DNA, 25 bp, Mus musculus
tgggttaccgagagcttttgctggg

SEQ ID NO: 981976 - DNA, 25 bp, Mus musculus
tgggttaccgtgagcttttgctggg

SEQ ID NO: 981977 - DNA, 25 bp, Mus musculus
tgggttcaagatcttggcaaccatg

SEQ ID NO: 981978 - DNA, 25 bp, Mus musculus
tgggttcaagttcttggcaaccatg

SEQ ID NO: 981979 - DNA, 25 bp, Mus musculus
tgggttcacacacgagtgccaggag

SEQ ID NO: 981980 - DNA, 25 bp, Mus musculus
tgggttcacacaggagtgccaggag

SEQ ID NO: 981981 - DNA, 25 bp, Mus musculus
tgggttcctctgcgcttcgtgctgg

SEQ ID NO: 981982 - DNA, 25 bp, Mus musculus
tgggttcctctgggcttcgtgctgg

SEQ ID NO: 981983 - DNA, 25 bp, Mus musculus
tgggttgaggatttgggcagctgaa

SEQ ID NO: 981984 - DNA, 25 bp, Mus musculus
tgggttgaggttttgggcagctgaa

SEQ ID NO: 981985 - DNA, 25 bp, Mus musculus
tgggttgtgcagctggagcagatag

SEQ ID NO: 981986 - DNA, 25 bp, Mus musculus
tgggttgtgcaggtggagcagatag

SEQ ID NO: 981987 - DNA, 25 bp, Mus musculus
tgggttgtggcacgcctgagtcttt

SEQ ID NO: 981988 - DNA, 25 bp, Mus musculus
tgggttgtggcaggcctgagtcttt

SEQ ID NO: 981989 - DNA, 25 bp, Mus musculus
tgggtttatgaacaggaagtcttcg

SEQ ID NO: 981990 - DNA, 25 bp, Mus musculus
tgggtttatgaagaggaagtcttcg

SEQ ID NO: 981991 - DNA, 25 bp, Mus musculus
tgggtttcagaacacagggcaatgc

SEQ ID NO: 981992 - DNA, 25 bp, Mus musculus
tgggtttcagaacagagggcaatgc

SEQ ID NO: 981993 - DNA, 25 bp, Mus musculus
tgggtttcagactttgaatacctct

SEQ ID NO: 981994 - DNA, 25 bp, Mus musculus
tgggtttcagtctttgaatacctct

SEQ ID NO: 981995 - DNA, 25 bp, Mus musculus
tgggtttctgcatcttgggtctttg

SEQ ID NO: 981996 - DNA, 25 bp, Mus musculus
tgggtttctggatcttgggtctttg

SEQ ID NO: 981997 - DNA, 25 bp, Mus musculus
tggtaaaatatccgatgcccgggta

SEQ ID NO: 981998 - DNA, 25 bp, Mus musculus
tggtaaaatatcggatgcccgggta

SEQ ID NO: 981999 - DNA, 25 bp, Mus musculus
tggtaaagacagcacagccccccag

SEQ ID NO: 982000 - DNA, 25 bp, Mus musculus
tggtaaagacagcctaaccatgcca

SEQ ID NO: 982001 - DNA, 25 bp, Mus musculus
tggtaaagacaggacagccccccag

SEQ ID NO: 982002 - DNA, 25 bp, Mus musculus
tggtaaagacaggctaaccatgcca

SEQ ID NO: 982003 - DNA, 25 bp, Mus musculus
tggtaaagagagacatcctgtatcc

SEQ ID NO: 982004 - DNA, 25 bp, Mus musculus
tggtaaagagtgacatcctgtatcc

SEQ ID NO: 982005 - DNA, 25 bp, Mus musculus
tggtaacagcagataccagctcttc

SEQ ID NO: 982006 - DNA, 25 bp, Mus musculus
tggtaacagcagttaccagctcttc

SEQ ID NO: 982007 - DNA, 25 bp, Mus musculus
tggtaaggttcccacgatcaccgac

SEQ ID NO: 982008 - DNA, 25 bp, Mus musculus
tggtaaggttcccaggatcaccgac

SEQ ID NO: 982009 - DNA, 25 bp, Mus musculus
tggtaccaaacgcttcgacagtgaa

SEQ ID NO: 982010 - DNA, 25 bp, Mus musculus
tggtaccaaacggttcgacagtgaa

SEQ ID NO: 982011 - DNA, 25 bp, Mus musculus
tggtaccagaccaactttgagacac

SEQ ID NO: 982012 - DNA, 25 bp, Mus musculus
tggtaccagaccaagtttgagacac

SEQ ID NO: 982013 - DNA, 25 bp, Mus musculus
tggtactcacagagcggtccaacct

SEQ ID NO: 982014 - DNA, 25 bp, Mus musculus
tggtactcacagcgcatgactacat

SEQ ID NO: 982015 - DNA, 25 bp, Mus musculus
tggtactcacagggcatgactacat

SEQ ID NO: 982016 - DNA, 25 bp, Mus musculus
tggtactcacagtgcggtccaacct

SEQ ID NO: 982017 - DNA, 25 bp, Mus musculus
tggtagaaagatctaaaggggtgat

SEQ ID NO: 982018 - DNA, 25 bp, Mus musculus
tggtagaaagccctttgtagatttc

SEQ ID NO: 982019 - DNA, 25 bp, Mus musculus
tggtagaaaggcctttgtagatttc

SEQ ID NO: 982020 - DNA, 25 bp, Mus musculus
tggtagaaagttctaaaggggtgat

SEQ ID NO: 982021 - DNA, 25 bp, Mus musculus
tggtagagagatctgagtgcatcaa

SEQ ID NO: 982022 - DNA, 25 bp, Mus musculus
tggtagagagttctgagtgcatcaa

SEQ ID NO: 982023 - DNA, 25 bp, Mus musculus
tggtagagtgctataccaaatctca

SEQ ID NO: 982024 - DNA, 25 bp, Mus musculus
tggtagagtggtataccaaatctca

SEQ ID NO: 982025 - DNA, 25 bp, Mus musculus
tggtagatctgacactacccaaggt

SEQ ID NO: 982026 - DNA, 25 bp, Mus musculus
tggtagatctgacagtacccaaggt

SEQ ID NO: 982027 - DNA, 25 bp, Mus musculus
tggtagattacgctcacaacaacta

SEQ ID NO: 982028 - DNA, 25 bp, Mus musculus
tggtagattacggtcacaacaacta

SEQ ID NO: 982029 - DNA, 25 bp, Mus musculus
tggtagcccccacctcaattcaccc

SEQ ID NO: 982030 - DNA, 25 bp, Mus musculus
tggtagcccccagctcaattcaccc

SEQ ID NO: 982031 - DNA, 25 bp, Mus musculus
tggtagcgcctcccccggagcccgc

SEQ ID NO: 982032 - DNA, 25 bp, Mus musculus
tggtagcgcctcccgcggagcccgc

SEQ ID NO: 982033 - DNA, 25 bp, Mus musculus
tggtagcttcaaaacggaccgagct

SEQ ID NO: 982034 - DNA, 25 bp, Mus musculus
tggtagcttcaaaagggaccgagct

SEQ ID NO: 982035 - DNA, 25 bp, Mus musculus
tggtagtgattgtaagaatgaagat

SEQ ID NO: 982036 - DNA, 25 bp, Mus musculus
tggtagtgattgtaatctacttttt

SEQ ID NO: 982037 - DNA, 25 bp, Mus musculus
tggtagtgattgtatgaatgaagat

SEQ ID NO: 982038 - DNA, 25 bp, Mus musculus
tggtagtgattgtattctacttttt

SEQ ID NO: 982039 - DNA, 25 bp, Mus musculus
tggtatatggatcctcatctttggt

SEQ ID NO: 982040 - DNA, 25 bp, Mus musculus
tggtatatggatgctcatctttggt

SEQ ID NO: 982041 - DNA, 25 bp, Mus musculus
tggtatattcaacgttggatggagt

SEQ ID NO: 982042 - DNA, 25 bp, Mus musculus
tggtatattcaaggttggatggagt

SEQ ID NO: 982043 - DNA, 25 bp, Mus musculus
tggtatcaactgagtaaggagaagc

SEQ ID NO: 982044 - DNA, 25 bp, Mus musculus
tggtatcaactgtgtaaggagaagc

SEQ ID NO: 982045 - DNA, 25 bp, Mus musculus
tggtatcaagctcccgtcaggcttg

SEQ ID NO: 982046 - DNA, 25 bp, Mus musculus
tggtatcaaggtcccgtcaggcttg

SEQ ID NO: 982047 - DNA, 25 bp, Mus musculus
tggtatctgaagacgctcatgatcc

SEQ ID NO: 982048 - DNA, 25 bp, Mus musculus
tggtatctgaagtcgctcatgatcc

SEQ ID NO: 982049 - DNA, 25 bp, Mus musculus
tggtatcttaagcaactccaggatg

SEQ ID NO: 982050 - DNA, 25 bp, Mus musculus
tggtatcttaaggaactccaggatg

SEQ ID NO: 982051 - DNA, 25 bp, Mus musculus
tggtatgagcagcgcatccttgaga

SEQ ID NO: 982052 - DNA, 25 bp, Mus musculus
tggtatgagcagggcatccttgaga

SEQ ID NO: 982053 - DNA, 25 bp, Mus musculus
tggtatttttagcctgttcatttag

SEQ ID NO: 982054 - DNA, 25 bp, Mus musculus
tggtatttttaggctgttcatttag

SEQ ID NO: 982055 - DNA, 25 bp, Mus musculus
tggtcaagaacaccatgggtacaca

SEQ ID NO: 982056 - DNA, 25 bp, Mus musculus
tggtcaagaacagcatgggtacaca

SEQ ID NO: 982057 - DNA, 25 bp, Mus musculus
tggtcaagaagctgcctaagaagta

SEQ ID NO: 982058 - DNA, 25 bp, Mus musculus
tggtcaagaagctggctaagaagta

SEQ ID NO: 982059 - DNA, 25 bp, Mus musculus
tggtcaagcttgccacactcgaaga

SEQ ID NO: 982060 - DNA, 25 bp, Mus musculus
tggtcaagcttgcctcactcgaaga

SEQ ID NO: 982061 - DNA, 25 bp, Mus musculus
tggtcacacaaacaaacaggtatgt

SEQ ID NO: 982062 - DNA, 25 bp, Mus musculus
tggtcacacaaacgtatgtgatgat

SEQ ID NO: 982063 - DNA, 25 bp, Mus musculus
tggtcacacaaagaaacaggtatgt

SEQ ID NO: 982064 - DNA, 25 bp, Mus musculus
tggtcacacaaaggtatgtgatgat

SEQ ID NO: 982065 - DNA, 25 bp, Mus musculus
tggtcacatacctccccggaggaca

SEQ ID NO: 982066 - DNA, 25 bp, Mus musculus
tggtcacatacctcgccggaggaca

SEQ ID NO: 982067 - DNA, 25 bp, Mus musculus
tggtcaccagcacgttcatcatcga

SEQ ID NO: 982068 - DNA, 25 bp, Mus musculus
tggtcaccaggacgttcatcatcga

SEQ ID NO: 982069 - DNA, 25 bp, Mus musculus
tggtcacgagctaaccatcttggag

SEQ ID NO: 982070 - DNA, 25 bp, Mus musculus
tggtcacgagctcttctgatctcca

SEQ ID NO: 982071 - DNA, 25 bp, Mus musculus
tggtcacgaggtaaccatcttggag

SEQ ID NO: 982072 - DNA, 25 bp, Mus musculus
tggtcacgaggtcttctgatctcca

SEQ ID NO: 982073 - DNA, 25 bp, Mus musculus
tggtcactgccacccgaaggtaagt

SEQ ID NO: 982074 - DNA, 25 bp, Mus musculus
tggtcactgccaccggaaggtaagt

SEQ ID NO: 982075 - DNA, 25 bp, Mus musculus
tggtcagcaatgcggctggagagat

SEQ ID NO: 982076 - DNA, 25 bp, Mus musculus
tggtcagcaatgcgttcagacctcg

SEQ ID NO: 982077 - DNA, 25 bp, Mus musculus
tggtcagcaatggggctggagagat

SEQ ID NO: 982078 - DNA, 25 bp, Mus musculus
tggtcagcaatgggttcagacctcg

SEQ ID NO: 982079 - DNA, 25 bp, Mus musculus
tggtcagccaaaaggtgttgtgtga

SEQ ID NO: 982080 - DNA, 25 bp, Mus musculus
tggtcagccaaaagtctttctgtaa

SEQ ID NO: 982081 - DNA, 25 bp, Mus musculus
tggtcagccaaaatgaggatgccat

SEQ ID NO: 982082 - DNA, 25 bp, Mus musculus
tggtcagccaaatggtgttgtgtga

SEQ ID NO: 982083 - DNA, 25 bp, Mus musculus
tggtcagccaaatgtctttctgtaa

SEQ ID NO: 982084 - DNA, 25 bp, Mus musculus
tggtcagccaaattgaggatgccat

SEQ ID NO: 982085 - DNA, 25 bp, Mus musculus
tggtcagccgctttctctccgtcgg

SEQ ID NO: 982086 - DNA, 25 bp, Mus musculus
tggtcagccggtttctctccgtcgg

SEQ ID NO: 982087 - DNA, 25 bp, Mus musculus
tggtcatcactgcacctccagtgac

SEQ ID NO: 982088 - DNA, 25 bp, Mus musculus
tggtcatcactgcagctccagtgac

SEQ ID NO: 982089 - DNA, 25 bp, Mus musculus
tggtcatcagagctgtactggcgat

SEQ ID NO: 982090 - DNA, 25 bp, Mus musculus
tggtcatcagagtcctcctatcggt

SEQ ID NO: 982091 - DNA, 25 bp, Mus musculus
tggtcatcagtgctgtactggcgat

SEQ ID NO: 982092 - DNA, 25 bp, Mus musculus
tggtcatcagtgtcctcctatcggt

SEQ ID NO: 982093 - DNA, 25 bp, Mus musculus
tggtcatggtgtgacgggtcccaca

SEQ ID NO: 982094 - DNA, 25 bp, Mus musculus
tggtcatggtgtgaggggtcccaca

SEQ ID NO: 982095 - DNA, 25 bp, Mus musculus
tggtcattagagctttggccaagtc

SEQ ID NO: 982096 - DNA, 25 bp, Mus musculus
tggtcattagaggtttggccaagtc

SEQ ID NO: 982097 - DNA, 25 bp, Mus musculus
tggtcattccagaggatgaagagtg

SEQ ID NO: 982098 - DNA, 25 bp, Mus musculus
tggtcattccagtggatgaagagtg

SEQ ID NO: 982099 - DNA, 25 bp, Mus musculus
tggtcattgtgcttcatgttcaaat

SEQ ID NO: 982100 - DNA, 25 bp, Mus musculus
tggtcattgtgcttcgtgcctttat

SEQ ID NO: 982101 - DNA, 25 bp, Mus musculus
tggtcattgtgcttgatgttcaaat

SEQ ID NO: 982102 - DNA, 25 bp, Mus musculus
tggtcattgtgcttggtgcctttat

SEQ ID NO: 982103 - DNA, 25 bp, Mus musculus
tggtccacatgccacgggatgcccc

SEQ ID NO: 982104 - DNA, 25 bp, Mus musculus
tggtccacatgccaggggatgcccc

SEQ ID NO: 982105 - DNA, 25 bp, Mus musculus
tggtccagatgcaacgagtggggaa

SEQ ID NO: 982106 - DNA, 25 bp, Mus musculus
tggtccagatgcaaggagtggggaa

SEQ ID NO: 982107 - DNA, 25 bp, Mus musculus
tggtccagatggcgaaagatgccac

SEQ ID NO: 982108 - DNA, 25 bp, Mus musculus
tggtccagatggggaaagatgccac

SEQ ID NO: 982109 - DNA, 25 bp, Mus musculus
tggtcccacattccttgcccttcaa

SEQ ID NO: 982110 - DNA, 25 bp, Mus musculus
tggtcccacattgcttgcccttcaa

SEQ ID NO: 982111 - DNA, 25 bp, Mus musculus
tggtccccgactttgcaaatgcatc

SEQ ID NO: 982112 - DNA, 25 bp, Mus musculus
tggtccccgagtttgcaaatgcatc

SEQ ID NO: 982113 - DNA, 25 bp, Mus musculus
tggtccgagaagctgagattgccat

SEQ ID NO: 982114 - DNA, 25 bp, Mus musculus
tggtccgagaaggtgagattgccat

SEQ ID NO: 982115 - DNA, 25 bp, Mus musculus
tggtcctcaaagctggccagagccg

SEQ ID NO: 982116 - DNA, 25 bp, Mus musculus
tggtcctcaaaggtggccagagccg

SEQ ID NO: 982117 - DNA, 25 bp, Mus musculus
tggtcctcagccattaacaagtgcc

SEQ ID NO: 982118 - DNA, 25 bp, Mus musculus
tggtcctcaggcattaacaagtgcc

SEQ ID NO: 982119 - DNA, 25 bp, Mus musculus
tggtcctcggcgcataacgagtgtc

SEQ ID NO: 982120 - DNA, 25 bp, Mus musculus
tggtcctcggggcataacgagtgtc

SEQ ID NO: 982121 - DNA, 25 bp, Mus musculus
tggtcctgcctctgcgcggaaaaac

SEQ ID NO: 982122 - DNA, 25 bp, Mus musculus
tggtcctgcctctgcgttaacaatc

SEQ ID NO: 982123 - DNA, 25 bp, Mus musculus
tggtcctgcctctgggcggaaaaac

SEQ ID NO: 982124 - DNA, 25 bp, Mus musculus
tggtcctgcctctgggttaacaatc

SEQ ID NO: 982125 - DNA, 25 bp, Mus musculus
tggtcctggcctcgtgtgcatcggc

SEQ ID NO: 982126 - DNA, 25 bp, Mus musculus
tggtcctggcctggtgtgcatcggc

SEQ ID NO: 982127 - DNA, 25 bp, Mus musculus
tggtcctgggcccatcagctccaga

SEQ ID NO: 982128 - DNA, 25 bp, Mus musculus
tggtcctgggctacaatggtgcttt

SEQ ID NO: 982129 - DNA, 25 bp, Mus musculus
tggtcctggggccatcagctccaga

SEQ ID NO: 982130 - DNA, 25 bp, Mus musculus
tggtcctggggtacaatggtgcttt

SEQ ID NO: 982131 - DNA, 25 bp, Mus musculus
tggtcctgtcagcacttctggggat

SEQ ID NO: 982132 - DNA, 25 bp, Mus musculus
tggtcctgtcaggacttctggggat

SEQ ID NO: 982133 - DNA, 25 bp, Mus musculus
tggtccttctagcacgcctgcctac

SEQ ID NO: 982134 - DNA, 25 bp, Mus musculus
tggtccttctagcaggcctgcctac

SEQ ID NO: 982135 - DNA, 25 bp, Mus musculus
tggtcggggtctgtcgcaattctag

SEQ ID NO: 982136 - DNA, 25 bp, Mus musculus
tggtcggggtctgtggcaattctag

SEQ ID NO: 982137 - DNA, 25 bp, Mus musculus
tggtcgttcgcagttttaatgtggg

SEQ ID NO: 982138 - DNA, 25 bp, Mus musculus
tggtcgttcggagttttaatgtggg

SEQ ID NO: 982139 - DNA, 25 bp, Mus musculus
tggtcgttgtggcaatctgctacac

SEQ ID NO: 982140 - DNA, 25 bp, Mus musculus
tggtcgttgtgggaatctgctacac

SEQ ID NO: 982141 - DNA, 25 bp, Mus musculus
tggtctaccacacagaaaggcccgc

SEQ ID NO: 982142 - DNA, 25 bp, Mus musculus
tggtctaccacagagaaaggcccgc

SEQ ID NO: 982143 - DNA, 25 bp, Mus musculus
tggtctccagttatcgttctccagg

SEQ ID NO: 982144 - DNA, 25 bp, Mus musculus
tggtctccagttatggttctccagg

SEQ ID NO: 982145 - DNA, 25 bp, Mus musculus
tggtctcctaaaccaactgaaccat

SEQ ID NO: 982146 - DNA, 25 bp, Mus musculus
tggtctcctaaagcaactgaaccat

SEQ ID NO: 982147 - DNA, 25 bp, Mus musculus
tggtctcctccggcatgttggaggt

SEQ ID NO: 982148 - DNA, 25 bp, Mus musculus
tggtctcctccggcttgttggaggt

SEQ ID NO: 982149 - DNA, 25 bp, Mus musculus
tggtctctgtggctctttctcatca

SEQ ID NO: 982150 - DNA, 25 bp, Mus musculus
tggtctctgtgggtctttctcatca

SEQ ID NO: 982151 - DNA, 25 bp, Mus musculus
tggtctgagcagcactcggaaccca

SEQ ID NO: 982152 - DNA, 25 bp, Mus musculus
tggtctgagcaggactcggaaccca

SEQ ID NO: 982153 - DNA, 25 bp, Mus musculus
tggtcttaagcccatcgtaccttct

SEQ ID NO: 982154 - DNA, 25 bp, Mus musculus
tggtcttaaggccatcgtaccttct

SEQ ID NO: 982155 - DNA, 25 bp, Mus musculus
tggtcttacgctaccagccagaaca

SEQ ID NO: 982156 - DNA, 25 bp, Mus musculus
tggtcttacggtaccagccagaaca

SEQ ID NO: 982157 - DNA, 25 bp, Mus musculus
tggtcttcaaagacatgaatgttgt

SEQ ID NO: 982158 - DNA, 25 bp, Mus musculus
tggtcttcaaagacttgaatgttgt

SEQ ID NO: 982159 - DNA, 25 bp, Mus musculus
tggtcttcagcgccatgggagccgc

SEQ ID NO: 982160 - DNA, 25 bp, Mus musculus
tggtcttcagcggcatgggagccgc

SEQ ID NO: 982161 - DNA, 25 bp, Mus musculus
tggtcttctatgcccaatatctctg

SEQ ID NO: 982162 - DNA, 25 bp, Mus musculus
tggtcttctatggccaatatctctg

SEQ ID NO: 982163 - DNA, 25 bp, Mus musculus
tggtcttggctccacctttagttgc

SEQ ID NO: 982164 - DNA, 25 bp, Mus musculus
tggtcttggctccagctttagttgc

SEQ ID NO: 982165 - DNA, 25 bp, Mus musculus
tggtgaaaagagcaatccagaagaa

SEQ ID NO: 982166 - DNA, 25 bp, Mus musculus
tggtgaaaagtgcaatccagaagaa

SEQ ID NO: 982167 - DNA, 25 bp, Mus musculus
tggtgaacctcacacatgaaacagg

SEQ ID NO: 982168 - DNA, 25 bp, Mus musculus
tggtgaacctcacagatgaaacagg

SEQ ID NO: 982169 - DNA, 25 bp, Mus musculus
tggtgaagacctacggacatatccc

SEQ ID NO: 982170 - DNA, 25 bp, Mus musculus
tggtgaagacgtacggacatatccc

SEQ ID NO: 982171 - DNA, 25 bp, Mus musculus
tggtgaagagcacgtatctcagacg

SEQ ID NO: 982172 - DNA, 25 bp, Mus musculus
tggtgaagagcaggtatctcagacg

SEQ ID NO: 982173 - DNA, 25 bp, Mus musculus
tggtgaagagctcgtatatccagag

SEQ ID NO: 982174 - DNA, 25 bp, Mus musculus
tggtgaagagctggtatatccagag

SEQ ID NO: 982175 - DNA, 25 bp, Mus musculus
tggtgaaggaagccaagatctcaga

SEQ ID NO: 982176 - DNA, 25 bp, Mus musculus
tggtgaaggaaggcaagatctcaga

SEQ ID NO: 982177 - DNA, 25 bp, Mus musculus
tggtgaatacagcgacagtgatgaa

SEQ ID NO: 982178 - DNA, 25 bp, Mus musculus
tggtgaatacagggacagtgatgaa

SEQ ID NO: 982179 - DNA, 25 bp, Mus musculus
tggtgaatgtcacacatgccatctc

SEQ ID NO: 982180 - DNA, 25 bp, Mus musculus
tggtgaatgtcacagatgccatctc

SEQ ID NO: 982181 - DNA, 25 bp, Mus musculus
tggtgacaagcgttccaaaggagag

SEQ ID NO: 982182 - DNA, 25 bp, Mus musculus
tggtgacaagggttccaaaggagag

SEQ ID NO: 982183 - DNA, 25 bp, Mus musculus
tggtgacaatatctcgcaaaaagga

SEQ ID NO: 982184 - DNA, 25 bp, Mus musculus
tggtgacaatatctggcaaaaagga

SEQ ID NO: 982185 - DNA, 25 bp, Mus musculus
tggtgacatgacacttgaagaattt

SEQ ID NO: 982186 - DNA, 25 bp, Mus musculus
tggtgacatgtcacttgaagaattt

SEQ ID NO: 982187 - DNA, 25 bp, Mus musculus
tggtgacccgcacaaggtgcagcga

SEQ ID NO: 982188 - DNA, 25 bp, Mus musculus
tggtgacccggacaaggtgcagcga

SEQ ID NO: 982189 - DNA, 25 bp, Mus musculus
tggtgactatagctgtggattttgc

SEQ ID NO: 982190 - DNA, 25 bp, Mus musculus
tggtgactataggtgtggattttgc

SEQ ID NO: 982191 - DNA, 25 bp, Mus musculus
tggtgagaagaacagcagtggtgaa

SEQ ID NO: 982192 - DNA, 25 bp, Mus musculus
tggtgagaagtacagcagtggtgaa

SEQ ID NO: 982193 - DNA, 25 bp, Mus musculus
tggtgagcacagctccgtcttccag

SEQ ID NO: 982194 - DNA, 25 bp, Mus musculus
tggtgagcacaggtccgtcttccag

SEQ ID NO: 982195 - DNA, 25 bp, Mus musculus
tggtgaggtacacacgcgcaggtct

SEQ ID NO: 982196 - DNA, 25 bp, Mus musculus
tggtgaggtacacaggcgcaggtct

SEQ ID NO: 982197 - DNA, 25 bp, Mus musculus
tggtgagttcagctactcagttcgt

SEQ ID NO: 982198 - DNA, 25 bp, Mus musculus
tggtgagttcaggtactcagttcgt

SEQ ID NO: 982199 - DNA, 25 bp, Mus musculus
tggtgatgaaagaggctcagctcaa

SEQ ID NO: 982200 - DNA, 25 bp, Mus musculus
tggtgatgaaagtggctcagctcaa

SEQ ID NO: 982201 - DNA, 25 bp, Mus musculus
tggtgatgagagcaagctttgtctc

SEQ ID NO: 982202 - DNA, 25 bp, Mus musculus
tggtgatgagaggaagctttgtctc

SEQ ID NO: 982203 - DNA, 25 bp, Mus musculus
tggtgcaaacaactcaacttcactg

SEQ ID NO: 982204 - DNA, 25 bp, Mus musculus
tggtgcaaacaactgaacttcactg

SEQ ID NO: 982205 - DNA, 25 bp, Mus musculus
tggtgcacagcacgtactaccgcat

SEQ ID NO: 982206 - DNA, 25 bp, Mus musculus
tggtgcacagcaggtactaccgcat

SEQ ID NO: 982207 - DNA, 25 bp, Mus musculus
tggtgcacgctgcacatatgatcat

SEQ ID NO: 982208 - DNA, 25 bp, Mus musculus
tggtgcacgctgcagatatgatcat

SEQ ID NO: 982209 - DNA, 25 bp, Mus musculus
tggtgcacttcacaaggcccgagac

SEQ ID NO: 982210 - DNA, 25 bp, Mus musculus
tggtgcacttcagaaggcccgagac

SEQ ID NO: 982211 - DNA, 25 bp, Mus musculus
tggtgcagaggaaaaagaagccctc

SEQ ID NO: 982212 - DNA, 25 bp, Mus musculus
tggtgcagaggaaatagaagccctc

SEQ ID NO: 982213 - DNA, 25 bp, Mus musculus
tggtgcagcgatcacgtaatagtgc

SEQ ID NO: 982214 - DNA, 25 bp, Mus musculus
tggtgcagcgatcaggtaatagtgc

SEQ ID NO: 982215 - DNA, 25 bp, Mus musculus
tggtgcagctatcgctgggttgcgg

SEQ ID NO: 982216 - DNA, 25 bp, Mus musculus
tggtgcagctatggctgggttgcgg

SEQ ID NO: 982217 - DNA, 25 bp, Mus musculus
tggtgcagctggagagtgtcgcaag

SEQ ID NO: 982218 - DNA, 25 bp, Mus musculus
tggtgcagctggagtgtgtcgcaag

SEQ ID NO: 982219 - DNA, 25 bp, Mus musculus
tggtgcagtgtgctctgcagtagac

SEQ ID NO: 982220 - DNA, 25 bp, Mus musculus
tggtgcagtgtggtctgcagtagac

SEQ ID NO: 982221 - DNA, 25 bp, Mus musculus
tggtgccagaggcatgctaccacgg

SEQ ID NO: 982222 - DNA, 25 bp, Mus musculus
tggtgccagagggatgctaccacgg

SEQ ID NO: 982223 - DNA, 25 bp, Mus musculus
tggtgccatctagtcctcttcctcc

SEQ ID NO: 982224 - DNA, 25 bp, Mus musculus
tggtgccatctagtgctcttcctcc

SEQ ID NO: 982225 - DNA, 25 bp, Mus musculus
tggtgcccaaccacgtgaaaggttt

SEQ ID NO: 982226 - DNA, 25 bp, Mus musculus
tggtgcccaagcacgtgaaaggttt

SEQ ID NO: 982227 - DNA, 25 bp, Mus musculus
tggtgcccagaggacatagtgtatg

SEQ ID NO: 982228 - DNA, 25 bp, Mus musculus
tggtgcccagtggacatagtgtatg

SEQ ID NO: 982229 - DNA, 25 bp, Mus musculus
tggtgcccccaagccacaccctaag

SEQ ID NO: 982230 - DNA, 25 bp, Mus musculus
tggtgcccccaagcgacaccctaag

SEQ ID NO: 982231 - DNA, 25 bp, Mus musculus
tggtgccccgcgtcttgctggccct

SEQ ID NO: 982232 - DNA, 25 bp, Mus musculus
tggtgccccgggtcttgctggccct

SEQ ID NO: 982233 - DNA, 25 bp, Mus musculus
tggtgccctccacctccaccacccc

SEQ ID NO: 982234 - DNA, 25 bp, Mus musculus
tggtgccctccacgccagctccacc

SEQ ID NO: 982235 - DNA, 25 bp, Mus musculus
tggtgccctccagctccaccacccc

SEQ ID NO: 982236 - DNA, 25 bp, Mus musculus
tggtgccctccaggccagctccacc

SEQ ID NO: 982237 - DNA, 25 bp, Mus musculus
tggtgccctcttctccacatcgagt

SEQ ID NO: 982238 - DNA, 25 bp, Mus musculus
tggtgccctcttctgcacatcgagt

SEQ ID NO: 982239 - DNA, 25 bp, Mus musculus
tggtgcctcatgagtggacaactgg

SEQ ID NO: 982240 - DNA, 25 bp, Mus musculus
tggtgcctcatgtgtggacaactgg

SEQ ID NO: 982241 - DNA, 25 bp, Mus musculus
tggtgcgaggagctggagcctacta

SEQ ID NO: 982242 - DNA, 25 bp, Mus musculus
tggtgcgaggaggtggagcctacta

SEQ ID NO: 982243 - DNA, 25 bp, Mus musculus
tggtgcgccgagccctaaagaccaa

SEQ ID NO: 982244 - DNA, 25 bp, Mus musculus
tggtgcgccgaggcctaaagaccaa

SEQ ID NO: 982245 - DNA, 25 bp, Mus musculus
tggtgctatacacacatcaaggtag

SEQ ID NO: 982246 - DNA, 25 bp, Mus musculus
tggtgctatacacagatcaaggtag

SEQ ID NO: 982247 - DNA, 25 bp, Mus musculus
tggtgctatgaagcaacctacagcc

SEQ ID NO: 982248 - DNA, 25 bp, Mus musculus
tggtgctatgaagcactggccatgg

SEQ ID NO: 982249 - DNA, 25 bp, Mus musculus
tggtgctatgaagctacctacagcc

SEQ ID NO: 982250 - DNA, 25 bp, Mus musculus
tggtgctatgaagctctggccatgg

SEQ ID NO: 982251 - DNA, 25 bp, Mus musculus
tggtgctcagaggcagcatggagcc

SEQ ID NO: 982252 - DNA, 25 bp, Mus musculus
tggtgctcagccaagatgggcatat

SEQ ID NO: 982253 - DNA, 25 bp, Mus musculus
tggtgctcagccattgcagctcttt

SEQ ID NO: 982254 - DNA, 25 bp, Mus musculus
tggtgctcaggcaagatgggcatat

SEQ ID NO: 982255 - DNA, 25 bp, Mus musculus
tggtgctcaggcattgcagctcttt

SEQ ID NO: 982256 - DNA, 25 bp, Mus musculus
tggtgctcagtggcagcatggagcc

SEQ ID NO: 982257 - DNA, 25 bp, Mus musculus
tggtgctcattgctattgctaatac

SEQ ID NO: 982258 - DNA, 25 bp, Mus musculus
tggtgctcattggtattgctaatac

SEQ ID NO: 982259 - DNA, 25 bp, Mus musculus
tggtgctccgaggaccctaatgaca

SEQ ID NO: 982260 - DNA, 25 bp, Mus musculus
tggtgctccgcaacgagaagtgtca

SEQ ID NO: 982261 - DNA, 25 bp, Mus musculus
tggtgctccgccattgcagctcttt

SEQ ID NO: 982262 - DNA, 25 bp, Mus musculus
tggtgctccggaacgagaagtgtca

SEQ ID NO: 982263 - DNA, 25 bp, Mus musculus
tggtgctccggcattgcagctcttt

SEQ ID NO: 982264 - DNA, 25 bp, Mus musculus
tggtgctccgtggaccctaatgaca

SEQ ID NO: 982265 - DNA, 25 bp, Mus musculus
tggtgctgccagctgaggaggagct

SEQ ID NO: 982266 - DNA, 25 bp, Mus musculus
tggtgctgccaggtgaggaggagct

SEQ ID NO: 982267 - DNA, 25 bp, Mus musculus
tggtggaaagcatccagtttgtgtg

SEQ ID NO: 982268 - DNA, 25 bp, Mus musculus
tggtggaaaggatccagtttgtgtg

SEQ ID NO: 982269 - DNA, 25 bp, Mus musculus
tggtggaactggaacgtgattatcg

SEQ ID NO: 982270 - DNA, 25 bp, Mus musculus
tggtggaactggaaggtgattatcg

SEQ ID NO: 982271 - DNA, 25 bp, Mus musculus
tggtggaagtcgccctgttatgaga

SEQ ID NO: 982272 - DNA, 25 bp, Mus musculus
tggtggaagtcggcctgttatgaga

SEQ ID NO: 982273 - DNA, 25 bp, Mus musculus
tggtggaatgcatgcagatgtcaac

SEQ ID NO: 982274 - DNA, 25 bp, Mus musculus
tggtggaatggatgcagatgtcaac

SEQ ID NO: 982275 - DNA, 25 bp, Mus musculus
tggtggacaaagatggagaaatcta

SEQ ID NO: 982276 - DNA, 25 bp, Mus musculus
tggtggacaaagttgctaaagatta

SEQ ID NO: 982277 - DNA, 25 bp, Mus musculus
tggtggacaatgatggagaaatcta

SEQ ID NO: 982278 - DNA, 25 bp, Mus musculus
tggtggacaatgttgctaaagatta

SEQ ID NO: 982279 - DNA, 25 bp, Mus musculus
tggtggactccggacgaacctggct

SEQ ID NO: 982280 - DNA, 25 bp, Mus musculus
tggtggactccggaggaacctggct

SEQ ID NO: 982281 - DNA, 25 bp, Mus musculus
tggtggagaaagattgctatgagtc

SEQ ID NO: 982282 - DNA, 25 bp, Mus musculus
tggtggagaaagtttgctatgagtc

SEQ ID NO: 982283 - DNA, 25 bp, Mus musculus
tggtggagacaacgcaaagacgatg

SEQ ID NO: 982284 - DNA, 25 bp, Mus musculus
tggtggagacaacggaaagacgatg

SEQ ID NO: 982285 - DNA, 25 bp, Mus musculus
tggtggagaccaccatgattgggct

SEQ ID NO: 982286 - DNA, 25 bp, Mus musculus
tggtggagaccagcatgattgggct

SEQ ID NO: 982287 - DNA, 25 bp, Mus musculus
tggtggagagagatatgactcctat

SEQ ID NO: 982288 - DNA, 25 bp, Mus musculus
tggtggagagagttatgactcctat

SEQ ID NO: 982289 - DNA, 25 bp, Mus musculus
tggtggagcaagctggccctgtctc

SEQ ID NO: 982290 - DNA, 25 bp, Mus musculus
tggtggagcaaggtggccctgtctc

SEQ ID NO: 982291 - DNA, 25 bp, Mus musculus
tggtggagcgacaacgtaaaagaag

SEQ ID NO: 982292 - DNA, 25 bp, Mus musculus
tggtggagcgacaaggtaaaagaag

SEQ ID NO: 982293 - DNA, 25 bp, Mus musculus
tggtggaggaagcacacttcgctgc

SEQ ID NO: 982294 - DNA, 25 bp, Mus musculus
tggtggaggaaggacacttcgctgc

SEQ ID NO: 982295 - DNA, 25 bp, Mus musculus
tggtggaggccacgcgaatgacgtg

SEQ ID NO: 982296 - DNA, 25 bp, Mus musculus
tggtggaggccacgggaatgacgtg

SEQ ID NO: 982297 - DNA, 25 bp, Mus musculus
tggtggagtgcacctgtcaagcccg

SEQ ID NO: 982298 - DNA, 25 bp, Mus musculus
tggtggagtggacctgtcaagcccg

SEQ ID NO: 982299 - DNA, 25 bp, Mus musculus
tggtggatttagcagaggatgaaga

SEQ ID NO: 982300 - DNA, 25 bp, Mus musculus
tggtggatttaggagaggatgaaga

SEQ ID NO: 982301 - DNA, 25 bp, Mus musculus
tggtggcaacagctccctcgttgct

SEQ ID NO: 982302 - DNA, 25 bp, Mus musculus
tggtggcaacaggtccctcgttgct

SEQ ID NO: 982303 - DNA, 25 bp, Mus musculus
tggtggcacgcatggcaatgtgcgt

SEQ ID NO: 982304 - DNA, 25 bp, Mus musculus
tggtggcacggatggcaatgtgcgt

SEQ ID NO: 982305 - DNA, 25 bp, Mus musculus
tggtggcaggtgactccagctccgt

SEQ ID NO: 982306 - DNA, 25 bp, Mus musculus
tggtggcaggtgcgacctgaccaag

SEQ ID NO: 982307 - DNA, 25 bp, Mus musculus
tggtggcaggtgggacctgaccaag

SEQ ID NO: 982308 - DNA, 25 bp, Mus musculus
tggtggcaggtgtctccagctccgt

SEQ ID NO: 982309 - DNA, 25 bp, Mus musculus
tggtggccagcggctggatggacaa

SEQ ID NO: 982310 - DNA, 25 bp, Mus musculus
tggtggccaggggctggatggacaa

SEQ ID NO: 982311 - DNA, 25 bp, Mus musculus
tggtggccatagcacgactgatgga

SEQ ID NO: 982312 - DNA, 25 bp, Mus musculus
tggtggccatagcaggactgatgga

SEQ ID NO: 982313 - DNA, 25 bp, Mus musculus
tggtggcccttcaacctctatatac

SEQ ID NO: 982314 - DNA, 25 bp, Mus musculus
tggtggcccttcaagctctatatac

SEQ ID NO: 982315 - DNA, 25 bp, Mus musculus
tggtggccgagtgtagctgaacaca

SEQ ID NO: 982316 - DNA, 25 bp, Mus musculus
tggtggccgagtgttgctgaacaca

SEQ ID NO: 982317 - DNA, 25 bp, Mus musculus
tggtggcctctaagagccatcacct

SEQ ID NO: 982318 - DNA, 25 bp, Mus musculus
tggtggcctctaagatgctgactgt

SEQ ID NO: 982319 - DNA, 25 bp, Mus musculus
tggtggcctctaagtgccatcacct

SEQ ID NO: 982320 - DNA, 25 bp, Mus musculus
tggtggcctctaagttgctgactgt

SEQ ID NO: 982321 - DNA, 25 bp, Mus musculus
tggtggctgacaacccctgccagaa

SEQ ID NO: 982322 - DNA, 25 bp, Mus musculus
tggtggctgacatcccctgccagaa

SEQ ID NO: 982323 - DNA, 25 bp, Mus musculus
tggtggctgcctcactgtactggct

SEQ ID NO: 982324 - DNA, 25 bp, Mus musculus
tggtggctgcctcagtgtactggct

SEQ ID NO: 982325 - DNA, 25 bp, Mus musculus
tggtggcttcagcacgtatgatgaa

SEQ ID NO: 982326 - DNA, 25 bp, Mus musculus
tggtggcttcagcaggtatgatgaa

SEQ ID NO: 982327 - DNA, 25 bp, Mus musculus
tggtggctttgacgcctacgagggt

SEQ ID NO: 982328 - DNA, 25 bp, Mus musculus
tggtggctttgaggcctacgagggt

SEQ ID NO: 982329 - DNA, 25 bp, Mus musculus
tggtgggaccataggatcatggacg

SEQ ID NO: 982330 - DNA, 25 bp, Mus musculus
tggtgggaccattggatcatggacg

SEQ ID NO: 982331 - DNA, 25 bp, Mus musculus
tggtgggcagcgccttcgtatacct

SEQ ID NO: 982332 - DNA, 25 bp, Mus musculus
tggtgggcagctgtgctgatgtcaa

SEQ ID NO: 982333 - DNA, 25 bp, Mus musculus
tggtgggcagcttcatgttgtgtgt

SEQ ID NO: 982334 - DNA, 25 bp, Mus musculus
tggtgggcagggccttcgtatacct

SEQ ID NO: 982335 - DNA, 25 bp, Mus musculus
tggtgggcaggtgtgctgatgtcaa

SEQ ID NO: 982336 - DNA, 25 bp, Mus musculus
tggtgggcaggttcatgttgtgtgt

SEQ ID NO: 982337 - DNA, 25 bp, Mus musculus
tggtggggctcgcacgatccctgct

SEQ ID NO: 982338 - DNA, 25 bp, Mus musculus
tggtggggctcgcaggatccctgct

SEQ ID NO: 982339 - DNA, 25 bp, Mus musculus
tggtgggtttcacactttgaatacc

SEQ ID NO: 982340 - DNA, 25 bp, Mus musculus
tggtgggtttcagactttgaatacc

SEQ ID NO: 982341 - DNA, 25 bp, Mus musculus
tggtggtcagcggagaccacaccta

SEQ ID NO: 982342 - DNA, 25 bp, Mus musculus
tggtggtcaggggagaccacaccta

SEQ ID NO: 982343 - DNA, 25 bp, Mus musculus
tggtggtcctggcgccatcagctcc

SEQ ID NO: 982344 - DNA, 25 bp, Mus musculus
tggtggtcctggcgtacaatggtgc

SEQ ID NO: 982345 - DNA, 25 bp, Mus musculus
tggtggtcctggggccatcagctcc

SEQ ID NO: 982346 - DNA, 25 bp, Mus musculus
tggtggtcctggggtacaatggtgc

SEQ ID NO: 982347 - DNA, 25 bp, Mus musculus
tggtggtctcagcaggctgttgtgg

SEQ ID NO: 982348 - DNA, 25 bp, Mus musculus
tggtggtctcaggaggctgttgtgg

SEQ ID NO: 982349 - DNA, 25 bp, Mus musculus
tggtggtctccgcgttctgcaggag

SEQ ID NO: 982350 - DNA, 25 bp, Mus musculus
tggtggtctccgggttctgcaggag

SEQ ID NO: 982351 - DNA, 25 bp, Mus musculus
tggtggtgaactaaagcaccgagtc

SEQ ID NO: 982352 - DNA, 25 bp, Mus musculus
tggtggtgaactatatcatgtataa

SEQ ID NO: 982353 - DNA, 25 bp, Mus musculus
tggtggtgaactgctgtatcttgga

SEQ ID NO: 982354 - DNA, 25 bp, Mus musculus
tggtggtgaagtaaagcaccgagtc

SEQ ID NO: 982355 - DNA, 25 bp, Mus musculus
tggtggtgaagtatatcatgtataa

SEQ ID NO: 982356 - DNA, 25 bp, Mus musculus
tggtggtgaagtgctgtatcttgga

SEQ ID NO: 982357 - DNA, 25 bp, Mus musculus
tggtggtgacagcaatctatgaata

SEQ ID NO: 982358 - DNA, 25 bp, Mus musculus
tggtggtgacaggaatctatgaata

SEQ ID NO: 982359 - DNA, 25 bp, Mus musculus
tggtggtgatgaaactggctcagct

SEQ ID NO: 982360 - DNA, 25 bp, Mus musculus
tggtggtgatgaaagtggctcagct

SEQ ID NO: 982361 - DNA, 25 bp, Mus musculus
tggtggtgctgccacctgaggagga

SEQ ID NO: 982362 - DNA, 25 bp, Mus musculus
tggtggtgctgccagctgaggagga

SEQ ID NO: 982363 - DNA, 25 bp, Mus musculus
tggtggttggtgccgcagtccaggc

SEQ ID NO: 982364 - DNA, 25 bp, Mus musculus
tggtggttggtggcgcagtccaggc

SEQ ID NO: 982365 - DNA, 25 bp, Mus musculus
tggtgtaaagagaactctttcaaga

SEQ ID NO: 982366 - DNA, 25 bp, Mus musculus
tggtgtaaagagaagtctttcaaga

SEQ ID NO: 982367 - DNA, 25 bp, Mus musculus
tggtgtacagagggcggcccatcat

SEQ ID NO: 982368 - DNA, 25 bp, Mus musculus
tggtgtacagtgggcggcccatcat

SEQ ID NO: 982369 - DNA, 25 bp, Mus musculus
tggtgtaccgcgaccagaataagta

SEQ ID NO: 982370 - DNA, 25 bp, Mus musculus
tggtgtaccgggaccagaataagta

SEQ ID NO: 982371 - DNA, 25 bp, Mus musculus
tggtgtagcacatttccttctggct

SEQ ID NO: 982372 - DNA, 25 bp, Mus musculus
tggtgtagcagatttccttctggct

SEQ ID NO: 982373 - DNA, 25 bp, Mus musculus
tggtgtcaagcctgagggatctgag

SEQ ID NO: 982374 - DNA, 25 bp, Mus musculus
tggtgtcaagctcccagactccacc

SEQ ID NO: 982375 - DNA, 25 bp, Mus musculus
tggtgtcaaggctgagggatctgag

SEQ ID NO: 982376 - DNA, 25 bp, Mus musculus
tggtgtcaaggtcccagactccacc

SEQ ID NO: 982377 - DNA, 25 bp, Mus musculus
tggtgtccaggaaaacctctggatt

SEQ ID NO: 982378 - DNA, 25 bp, Mus musculus
tggtgtccaggataacctctggatt

SEQ ID NO: 982379 - DNA, 25 bp, Mus musculus
tggtgtccccaacgtctgcatcctg

SEQ ID NO: 982380 - DNA, 25 bp, Mus musculus
tggtgtccccaaggtctgcatcctg

SEQ ID NO: 982381 - DNA, 25 bp, Mus musculus
tggtgtcctgctgacgcgagtaaca

SEQ ID NO: 982382 - DNA, 25 bp, Mus musculus
tggtgtcctgctgaggcgagtaaca

SEQ ID NO: 982383 - DNA, 25 bp, Mus musculus
tggtgtcgctcgagttcctgaggat

SEQ ID NO: 982384 - DNA, 25 bp, Mus musculus
tggtgtcgctcgcgtatcaagtctc

SEQ ID NO: 982385 - DNA, 25 bp, Mus musculus
tggtgtcgctcgggtatcaagtctc

SEQ ID NO: 982386 - DNA, 25 bp, Mus musculus
tggtgtcgctcgtgttcctgaggat

SEQ ID NO: 982387 - DNA, 25 bp, Mus musculus
tggtgtctgtgacgtctgtcagcag

SEQ ID NO: 982388 - DNA, 25 bp, Mus musculus
tggtgtctgtgaggtctgtcagcag

SEQ ID NO: 982389 - DNA, 25 bp, Mus musculus
tggtgtgactgacttggccgcccca

SEQ ID NO: 982390 - DNA, 25 bp, Mus musculus
tggtgtgactgagttggccgcccca

SEQ ID NO: 982391 - DNA, 25 bp, Mus musculus
tggtgtgccgcggtcaccaggtctg

SEQ ID NO: 982392 - DNA, 25 bp, Mus musculus
tggtgtgccggggtcaccaggtctg

SEQ ID NO: 982393 - DNA, 25 bp, Mus musculus
tggtgtgctccacgctggacagtat

SEQ ID NO: 982394 - DNA, 25 bp, Mus musculus
tggtgtgctccaggctggacagtat

SEQ ID NO: 982395 - DNA, 25 bp, Mus musculus
tggtgtggagattgaagaaaaattt

SEQ ID NO: 982396 - DNA, 25 bp, Mus musculus
tggtgtggagtttgaagaaaaattt

SEQ ID NO: 982397 - DNA, 25 bp, Mus musculus
tggtgtggcaatttttggaccatat

SEQ ID NO: 982398 - DNA, 25 bp, Mus musculus
tggtgtggcactagaaacagatact

SEQ ID NO: 982399 - DNA, 25 bp, Mus musculus
tggtgtggcagtagaaacagatact

SEQ ID NO: 982400 - DNA, 25 bp, Mus musculus
tggtgtggcattttttggaccatat

SEQ ID NO: 982401 - DNA, 25 bp, Mus musculus
tggtgtggtgcttggagcctctctg

SEQ ID NO: 982402 - DNA, 25 bp, Mus musculus
tggtgtggtggttggagcctctctg

SEQ ID NO: 982403 - DNA, 25 bp, Mus musculus
tggtgtgtcgaaggcctatggattt

SEQ ID NO: 982404 - DNA, 25 bp, Mus musculus
tggtgtgtcgaagggctatggattt

SEQ ID NO: 982405 - DNA, 25 bp, Mus musculus
tggtgtgtttgacgagatttctaat

SEQ ID NO: 982406 - DNA, 25 bp, Mus musculus
tggtgtgtttgaggagatttctaat

SEQ ID NO: 982407 - DNA, 25 bp, Mus musculus
tggtgttactatccttcctgtggga

SEQ ID NO: 982408 - DNA, 25 bp, Mus musculus
tggtgttactatgcttcctgtggga

SEQ ID NO: 982409 - DNA, 25 bp, Mus musculus
tggtgtttatcaatacacatctcca

SEQ ID NO: 982410 - DNA, 25 bp, Mus musculus
tggtgtttatcattacacatctcca

SEQ ID NO: 982411 - DNA, 25 bp, Mus musculus
tggttacaaaaacttgttcgcagat

SEQ ID NO: 982412 - DNA, 25 bp, Mus musculus
tggttacaaaaagttgttcgcagat

SEQ ID NO: 982413 - DNA, 25 bp, Mus musculus
tggttacctgccctttgtagagatc

SEQ ID NO: 982414 - DNA, 25 bp, Mus musculus
tggttacctggcctttgtagagatc

SEQ ID NO: 982415 - DNA, 25 bp, Mus musculus
tggttatactaatggaattgctagt

SEQ ID NO: 982416 - DNA, 25 bp, Mus musculus
tggttatactcccttaacatgggca

SEQ ID NO: 982417 - DNA, 25 bp, Mus musculus
tggttatactgccttaacatgggca

SEQ ID NO: 982418 - DNA, 25 bp, Mus musculus
tggttatacttatggaattgctagt

SEQ ID NO: 982419 - DNA, 25 bp, Mus musculus
tggttatcaccacgtacgtggttat

SEQ ID NO: 982420 - DNA, 25 bp, Mus musculus
tggttatcaccaggtacgtggttat

SEQ ID NO: 982421 - DNA, 25 bp, Mus musculus
tggttatcccctatgtcagatacat

SEQ ID NO: 982422 - DNA, 25 bp, Mus musculus
tggttatcccctttgtcagatacat

SEQ ID NO: 982423 - DNA, 25 bp, Mus musculus
tggttatgagctctggcgggaattt

SEQ ID NO: 982424 - DNA, 25 bp, Mus musculus
tggttatgaggtctggcgggaattt

SEQ ID NO: 982425 - DNA, 25 bp, Mus musculus
tggttattttaagacatcctggacc

SEQ ID NO: 982426 - DNA, 25 bp, Mus musculus
tggttattttaagagatcctggacc

SEQ ID NO: 982427 - DNA, 25 bp, Mus musculus
tggttcaacaaacgaattgaaatgc

SEQ ID NO: 982428 - DNA, 25 bp, Mus musculus
tggttcaacaaaggaattgaaatgc

SEQ ID NO: 982429 - DNA, 25 bp, Mus musculus
tggttcacagagatcccagaaaccg

SEQ ID NO: 982430 - DNA, 25 bp, Mus musculus
tggttcacagagttcccagaaaccg

SEQ ID NO: 982431 - DNA, 25 bp, Mus musculus
tggttcacagcctggaatacattga

SEQ ID NO: 982432 - DNA, 25 bp, Mus musculus
tggttcacaggctggaatacattga

SEQ ID NO: 982433 - DNA, 25 bp, Mus musculus
tggttcaccacacacacagaggagc

SEQ ID NO: 982434 - DNA, 25 bp, Mus musculus
tggttcaccacacagacagaggagc

SEQ ID NO: 982435 - DNA, 25 bp, Mus musculus
tggttcacccagcctatggtgtgca

SEQ ID NO: 982436 - DNA, 25 bp, Mus musculus
tggttcacccaggctatggtgtgca

SEQ ID NO: 982437 - DNA, 25 bp, Mus musculus
tggttcactgcaccgctgggattgg

SEQ ID NO: 982438 - DNA, 25 bp, Mus musculus
tggttcactgcagcgctgggattgg

SEQ ID NO: 982439 - DNA, 25 bp, Mus musculus
tggttcagagacttttacatgtacc

SEQ ID NO: 982440 - DNA, 25 bp, Mus musculus
tggttcagagatgtcctggggaagg

SEQ ID NO: 982441 - DNA, 25 bp, Mus musculus
tggttcagagtcttttacatgtacc

SEQ ID NO: 982442 - DNA, 25 bp, Mus musculus
tggttcagagttgtcctggggaagg

SEQ ID NO: 982443 - DNA, 25 bp, Mus musculus
tggttcagcagccacctggcagcca

SEQ ID NO: 982444 - DNA, 25 bp, Mus musculus
tggttcagcagccagctggcagcca

SEQ ID NO: 982445 - DNA, 25 bp, Mus musculus
tggttcctacagcgctagagcagct

SEQ ID NO: 982446 - DNA, 25 bp, Mus musculus
tggttcctacagggctagagcagct

SEQ ID NO: 982447 - DNA, 25 bp, Mus musculus
tggttcctagagaggcaacctttct

SEQ ID NO: 982448 - DNA, 25 bp, Mus musculus
tggttcctagagtggcaacctttct

SEQ ID NO: 982449 - DNA, 25 bp, Mus musculus
tggttcctctgtcacatgatgatca

SEQ ID NO: 982450 - DNA, 25 bp, Mus musculus
tggttcctctgtcagatgatgatca

SEQ ID NO: 982451 - DNA, 25 bp, Mus musculus
tggttcctggagcgatcaatgtgac

SEQ ID NO: 982452 - DNA, 25 bp, Mus musculus
tggttcctggagggatcaatgtgac

SEQ ID NO: 982453 - DNA, 25 bp, Mus musculus
tggttccttccacggcctggtggta

SEQ ID NO: 982454 - DNA, 25 bp, Mus musculus
tggttccttccagggcctggtggta

SEQ ID NO: 982455 - DNA, 25 bp, Mus musculus
tggttcgcgagaacagttcaagggc

SEQ ID NO: 982456 - DNA, 25 bp, Mus musculus
tggttcgcgagaactgttcaagggc

SEQ ID NO: 982457 - DNA, 25 bp, Mus musculus
tggttctcctgccacggcccctttg

SEQ ID NO: 982458 - DNA, 25 bp, Mus musculus
tggttctcctgccagggcccctttg

SEQ ID NO: 982459 - DNA, 25 bp, Mus musculus
tggttctgagccaacaggagcagga

SEQ ID NO: 982460 - DNA, 25 bp, Mus musculus
tggttctgaggcaacaggagcagga

SEQ ID NO: 982461 - DNA, 25 bp, Mus musculus
tggttctgcagacgaacagctgtgc

SEQ ID NO: 982462 - DNA, 25 bp, Mus musculus
tggttctgcagaggaacagctgtgc

SEQ ID NO: 982463 - DNA, 25 bp, Mus musculus
tggttctgctcacaggtcgagtact

SEQ ID NO: 982464 - DNA, 25 bp, Mus musculus
tggttctgctcagaggtcgagtact

SEQ ID NO: 982465 - DNA, 25 bp, Mus musculus
tggttcttcagtaacactgaagagc

SEQ ID NO: 982466 - DNA, 25 bp, Mus musculus
tggttcttcagtaagactgaagagc

SEQ ID NO: 982467 - DNA, 25 bp, Mus musculus
tggttcttgtttcatactttatgca

SEQ ID NO: 982468 - DNA, 25 bp, Mus musculus
tggttcttgtttgatactttatgca

SEQ ID NO: 982469 - DNA, 25 bp, Mus musculus
tggttgaaatggccttcaatgttga

SEQ ID NO: 982470 - DNA, 25 bp, Mus musculus
tggttgaaatgggcttcaatgttga

SEQ ID NO: 982471 - DNA, 25 bp, Mus musculus
tggttgattgagaaggagggagagt

SEQ ID NO: 982472 - DNA, 25 bp, Mus musculus
tggttgattgagtaggagggagagt

SEQ ID NO: 982473 - DNA, 25 bp, Mus musculus
tggttgcaagaaactagtaaagaca

SEQ ID NO: 982474 - DNA, 25 bp, Mus musculus
tggttgcaagtaactagtaaagaca

SEQ ID NO: 982475 - DNA, 25 bp, Mus musculus
tggttgcaggagcacccccaccgct

SEQ ID NO: 982476 - DNA, 25 bp, Mus musculus
tggttgcaggagcgtgaagggcctg

SEQ ID NO: 982477 - DNA, 25 bp, Mus musculus
tggttgcaggaggacccccaccgct

SEQ ID NO: 982478 - DNA, 25 bp, Mus musculus
tggttgcaggagggtgaagggcctg

SEQ ID NO: 982479 - DNA, 25 bp, Mus musculus
tggttgccgccatacgtttatggag

SEQ ID NO: 982480 - DNA, 25 bp, Mus musculus
tggttgccgccataggtttatggag

SEQ ID NO: 982481 - DNA, 25 bp, Mus musculus
tggttgctgaagaacagcatcatgg

SEQ ID NO: 982482 - DNA, 25 bp, Mus musculus
tggttgctgaagaagagcatcatgg

SEQ ID NO: 982483 - DNA, 25 bp, Mus musculus
tggttgctggtgcgcgtgagcagca

SEQ ID NO: 982484 - DNA, 25 bp, Mus musculus
tggttgctggtgcgggtgagcagca

SEQ ID NO: 982485 - DNA, 25 bp, Mus musculus
tggttgcttctgcggtcacaggatg

SEQ ID NO: 982486 - DNA, 25 bp, Mus musculus
tggttgcttctggggtcacaggatg

SEQ ID NO: 982487 - DNA, 25 bp, Mus musculus
tggttggatctcagcgcatgcccaa

SEQ ID NO: 982488 - DNA, 25 bp, Mus musculus
tggttggatctcagggcatgcccaa

SEQ ID NO: 982489 - DNA, 25 bp, Mus musculus
tggttgggataaactcgcatgtgtg

SEQ ID NO: 982490 - DNA, 25 bp, Mus musculus
tggttgggataatctcgcatgtgtg

SEQ ID NO: 982491 - DNA, 25 bp, Mus musculus
tggttgtcttccaaaaggctcaaag

SEQ ID NO: 982492 - DNA, 25 bp, Mus musculus
tggttgtcttccaataggctcaaag

SEQ ID NO: 982493 - DNA, 25 bp, Mus musculus
tggttgtgaggactcctcctgagcc

SEQ ID NO: 982494 - DNA, 25 bp, Mus musculus
tggttgtgaggactgctcctgagcc

SEQ ID NO: 982495 - DNA, 25 bp, Mus musculus
tggttgttcgaccatccatcctcag

SEQ ID NO: 982496 - DNA, 25 bp, Mus musculus
tggttgttcgacgatccatcctcag

SEQ ID NO: 982497 - DNA, 25 bp, Mus musculus
tggtttaacacaatggcatatttag

SEQ ID NO: 982498 - DNA, 25 bp, Mus musculus
tggtttaacacattggcatatttag

SEQ ID NO: 982499 - DNA, 25 bp, Mus musculus
tggtttactgatctcttactgtgac

SEQ ID NO: 982500 - DNA, 25 bp, Mus musculus
tggtttactgttctcttactgtgac

SEQ ID NO: 982501 - DNA, 25 bp, Mus musculus
tggtttatttacaccaagctggatg

SEQ ID NO: 982502 - DNA, 25 bp, Mus musculus
tggtttattttcaccaagctggatg

SEQ ID NO: 982503 - DNA, 25 bp, Mus musculus
tggtttccactgagtccttagccag

SEQ ID NO: 982504 - DNA, 25 bp, Mus musculus
tggtttccactgcacctcctggcct

SEQ ID NO: 982505 - DNA, 25 bp, Mus musculus
tggtttccactggacctcctggcct

SEQ ID NO: 982506 - DNA, 25 bp, Mus musculus
tggtttccactgtgtccttagccag

SEQ ID NO: 982507 - DNA, 25 bp, Mus musculus
tggtttcctgcctgaggaatcgaca

SEQ ID NO: 982508 - DNA, 25 bp, Mus musculus
tggtttcctggctgaggaatcgaca

SEQ ID NO: 982509 - DNA, 25 bp, Mus musculus
tggtttctccaccacgacatggatt

SEQ ID NO: 982510 - DNA, 25 bp, Mus musculus
tggtttctccaccaggacatggatt

SEQ ID NO: 982511 - DNA, 25 bp, Mus musculus
tggtttgaagatcccaatacttctc

SEQ ID NO: 982512 - DNA, 25 bp, Mus musculus
tggtttgaagctttggagtcgagat

SEQ ID NO: 982513 - DNA, 25 bp, Mus musculus
tggtttgaaggtttggagtcgagat

SEQ ID NO: 982514 - DNA, 25 bp, Mus musculus
tggtttgaagttcccaatacttctc

SEQ ID NO: 982515 - DNA, 25 bp, Mus musculus
tggtttggagtgctgtttgtggtgc

SEQ ID NO: 982516 - DNA, 25 bp, Mus musculus
tggtttggagtggtgtttgtggtgc

SEQ ID NO: 982517 - DNA, 25 bp, Mus musculus
tggttttcatccaggtggatcgcac

SEQ ID NO: 982518 - DNA, 25 bp, Mus musculus
tggttttcatcctggtggatcgcac

SEQ ID NO: 982519 - DNA, 25 bp, Mus musculus
tggttttcctggctctcggtcttga

SEQ ID NO: 982520 - DNA, 25 bp, Mus musculus
tggttttcctgggtctcggtcttga

SEQ ID NO: 982521 - DNA, 25 bp, Mus musculus
tggttttcggcactctgacatctcc

SEQ ID NO: 982522 - DNA, 25 bp, Mus musculus
tggttttcggcactgtgacatctcc

SEQ ID NO: 982523 - DNA, 25 bp, Mus musculus
tgtaaaaaagcttctctatataagg

SEQ ID NO: 982524 - DNA, 25 bp, Mus musculus
tgtaaaaaaggttctctatataagg

SEQ ID NO: 982525 - DNA, 25 bp, Mus musculus
tgtaaacaaacacgatcttcctaat

SEQ ID NO: 982526 - DNA, 25 bp, Mus musculus
tgtaaacaaacaggatcttcctaat

SEQ ID NO: 982527 - DNA, 25 bp, Mus musculus
tgtaaacaatctcctggaagtgtct

SEQ ID NO: 982528 - DNA, 25 bp, Mus musculus
tgtaaacaatgtcctggaagtgtct

SEQ ID NO: 982529 - DNA, 25 bp, Mus musculus
tgtaaagaagagcaaccttccacct

SEQ ID NO: 982530 - DNA, 25 bp, Mus musculus
tgtaaagaagtgcaaccttccacct

SEQ ID NO: 982531 - DNA, 25 bp, Mus musculus
tgtaaagagaagactttcaagaact

SEQ ID NO: 982532 - DNA, 25 bp, Mus musculus
tgtaaagagaagtctttcaagaact

SEQ ID NO: 982533 - DNA, 25 bp, Mus musculus
tgtaaagcagcttttccggcgtgtt

SEQ ID NO: 982534 - DNA, 25 bp, Mus musculus
tgtaaagcaggttttccggcgtgtt

SEQ ID NO: 982535 - DNA, 25 bp, Mus musculus
tgtaacattgatcccacagagcact

SEQ ID NO: 982536 - DNA, 25 bp, Mus musculus
tgtaacattgttcccacagagcact

SEQ ID NO: 982537 - DNA, 25 bp, Mus musculus
tgtaaccatgaaaatcagaaaatgc

SEQ ID NO: 982538 - DNA, 25 bp, Mus musculus
tgtaaccatgtaaatcagaaaatgc

SEQ ID NO: 982539 - DNA, 25 bp, Mus musculus
tgtaacgtgcaacgaagccagcatt

SEQ ID NO: 982540 - DNA, 25 bp, Mus musculus
tgtaacgtgcaaggaagccagcatt

SEQ ID NO: 982541 - DNA, 25 bp, Mus musculus
tgtaactcacaacgcacgcctcctt

SEQ ID NO: 982542 - DNA, 25 bp, Mus musculus
tgtaactcacaacgcgattgtcttg

SEQ ID NO: 982543 - DNA, 25 bp, Mus musculus
tgtaactcacaacggacgcctcctt

SEQ ID NO: 982544 - DNA, 25 bp, Mus musculus
tgtaactcacaacgggattgtcttg

SEQ ID NO: 982545 - DNA, 25 bp, Mus musculus
tgtaactcgtcaaacgtctcattca

SEQ ID NO: 982546 - DNA, 25 bp, Mus musculus
tgtaactcgtcaaaggtctcattca

SEQ ID NO: 982547 - DNA, 25 bp, Mus musculus
tgtaactgcaaactcccacgtcctc

SEQ ID NO: 982548 - DNA, 25 bp, Mus musculus
tgtaactgcaaactgccacgtcctc

SEQ ID NO: 982549 - DNA, 25 bp, Mus musculus
tgtaagattctgcgctctggtattt

SEQ ID NO: 982550 - DNA, 25 bp, Mus musculus
tgtaagattctgggctctggtattt

SEQ ID NO: 982551 - DNA, 25 bp, Mus musculus
tgtaagcctcagaacgatgcgggct

SEQ ID NO: 982552 - DNA, 25 bp, Mus musculus
tgtaagcctcagaaggatgcgggct

SEQ ID NO: 982553 - DNA, 25 bp, Mus musculus
tgtaaggcccatcctttgtgagatc

SEQ ID NO: 982554 - DNA, 25 bp, Mus musculus
tgtaaggcccttcctttgtgagatc

SEQ ID NO: 982555 - DNA, 25 bp, Mus musculus
tgtaagtaccgactgctgcttttga

SEQ ID NO: 982556 - DNA, 25 bp, Mus musculus
tgtaagtaccgagtgctgcttttga

SEQ ID NO: 982557 - DNA, 25 bp, Mus musculus
tgtaataaagctgcgaagctggggt

SEQ ID NO: 982558 - DNA, 25 bp, Mus musculus
tgtaataaaggtgcgaagctggggt

SEQ ID NO: 982559 - DNA, 25 bp, Mus musculus
tgtaatagtgaaccagagccatgaa

SEQ ID NO: 982560 - DNA, 25 bp, Mus musculus
tgtaatagtgaagcagagccatgaa

SEQ ID NO: 982561 - DNA, 25 bp, Mus musculus
tgtaatccaaggaaatgtggatcac

SEQ ID NO: 982562 - DNA, 25 bp, Mus musculus
tgtaatccaaggtaatgtggatcac

SEQ ID NO: 982563 - DNA, 25 bp, Mus musculus
tgtaatggacggccattttgttccc

SEQ ID NO: 982564 - DNA, 25 bp, Mus musculus
tgtaatggacgggcattttgttccc

SEQ ID NO: 982565 - DNA, 25 bp, Mus musculus
tgtaatttctgaagaagggggctgg

SEQ ID NO: 982566 - DNA, 25 bp, Mus musculus
tgtaatttctgatgaagggggctgg

SEQ ID NO: 982567 - DNA, 25 bp, Mus musculus
tgtacaacactgcaaccaaccagtg

SEQ ID NO: 982568 - DNA, 25 bp, Mus musculus
tgtacaacactggaaccaaccagtg

SEQ ID NO: 982569 - DNA, 25 bp, Mus musculus
tgtacaacagaatgaccagtgcctg

SEQ ID NO: 982570 - DNA, 25 bp, Mus musculus
tgtacaacagtatgaccagtgcctg

SEQ ID NO: 982571 - DNA, 25 bp, Mus musculus
tgtacaagacaaataagatgacctc

SEQ ID NO: 982572 - DNA, 25 bp, Mus musculus
tgtacaagacaattaagatgacctc

SEQ ID NO: 982573 - DNA, 25 bp, Mus musculus
tgtacaagattgcgcagcccagaca

SEQ ID NO: 982574 - DNA, 25 bp, Mus musculus
tgtacaagattgctcaactcagatc

SEQ ID NO: 982575 - DNA, 25 bp, Mus musculus
tgtacaagattgggcagcccagaca

SEQ ID NO: 982576 - DNA, 25 bp, Mus musculus
tgtacaagattggtcaactcagatc

SEQ ID NO: 982577 - DNA, 25 bp, Mus musculus
tgtacaatgaaaatcttgttcatat

SEQ ID NO: 982578 - DNA, 25 bp, Mus musculus
tgtacaatgacaaacatattcaaga

SEQ ID NO: 982579 - DNA, 25 bp, Mus musculus
tgtacaatgagaaacatattcaaga

SEQ ID NO: 982580 - DNA, 25 bp, Mus musculus
tgtacaatgataatcttgttcatat

SEQ ID NO: 982581 - DNA, 25 bp, Mus musculus
tgtacagaagcacattaagcacatg

SEQ ID NO: 982582 - DNA, 25 bp, Mus musculus
tgtacagaagcagattaagcacatg

SEQ ID NO: 982583 - DNA, 25 bp, Mus musculus
tgtacagaagcttacacagggaccc

SEQ ID NO: 982584 - DNA, 25 bp, Mus musculus
tgtacagaaggttacacagggaccc

SEQ ID NO: 982585 - DNA, 25 bp, Mus musculus
tgtacagcctatcgtcgggaggagt

SEQ ID NO: 982586 - DNA, 25 bp, Mus musculus
tgtacagcctatggtcgggaggagt

SEQ ID NO: 982587 - DNA, 25 bp, Mus musculus
tgtacaggcacacttgctgatatgt

SEQ ID NO: 982588 - DNA, 25 bp, Mus musculus
tgtacaggcacagttgctgatatgt

SEQ ID NO: 982589 - DNA, 25 bp, Mus musculus
tgtacagtacagccaaatttccagg

SEQ ID NO: 982590 - DNA, 25 bp, Mus musculus
tgtacagtacaggcaaatttccagg

SEQ ID NO: 982591 - DNA, 25 bp, Mus musculus
tgtacagtgacacgtatatctttgc

SEQ ID NO: 982592 - DNA, 25 bp, Mus musculus
tgtacagtgacaggtatatctttgc

SEQ ID NO: 982593 - DNA, 25 bp, Mus musculus
tgtacatgaaagctggcttaatgaa

SEQ ID NO: 982594 - DNA, 25 bp, Mus musculus
tgtacatgaaaggtggcttaatgaa

SEQ ID NO: 982595 - DNA, 25 bp, Mus musculus
tgtaccaactctttttgacaactat

SEQ ID NO: 982596 - DNA, 25 bp, Mus musculus
tgtaccaactgtttttgacaactat

SEQ ID NO: 982597 - DNA, 25 bp, Mus musculus
tgtaccactgaccaggtggagatcc

SEQ ID NO: 982598 - DNA, 25 bp, Mus musculus
tgtaccactgtccaggtggagatcc

SEQ ID NO: 982599 - DNA, 25 bp, Mus musculus
tgtaccagatgaaatcgcagaatcc

SEQ ID NO: 982600 - DNA, 25 bp, Mus musculus
tgtaccagatgatatcgcagaatcc

SEQ ID NO: 982601 - DNA, 25 bp, Mus musculus
tgtaccatccctgagatctggacct

SEQ ID NO: 982602 - DNA, 25 bp, Mus musculus
tgtaccatccgtgagatctggacct

SEQ ID NO: 982603 - DNA, 25 bp, Mus musculus
tgtaccatggctggctgtttgaagg

SEQ ID NO: 982604 - DNA, 25 bp, Mus musculus
tgtaccatgggtggctgtttgaagg

SEQ ID NO: 982605 - DNA, 25 bp, Mus musculus
tgtaccccagccattgggcatggag

SEQ ID NO: 982606 - DNA, 25 bp, Mus musculus
tgtaccccaggcattgggcatggag

SEQ ID NO: 982607 - DNA, 25 bp, Mus musculus
tgtaccccgaaacagctcctgggct

SEQ ID NO: 982608 - DNA, 25 bp, Mus musculus
tgtaccccgaaagagctcctgggct

SEQ ID NO: 982609 - DNA, 25 bp, Mus musculus
tgtaccgaagccactacacgctgga

SEQ ID NO: 982610 - DNA, 25 bp, Mus musculus
tgtaccgaaggcactacacgctgga

SEQ ID NO: 982611 - DNA, 25 bp, Mus musculus
tgtaccgcagcttcaaaatattgta

SEQ ID NO: 982612 - DNA, 25 bp, Mus musculus
tgtaccgcagcttctaaatattgta

SEQ ID NO: 982613 - DNA, 25 bp, Mus musculus
tgtaccttgtgcaaccgcccagact

SEQ ID NO: 982614 - DNA, 25 bp, Mus musculus
tgtaccttgtgcaagcgcccagact

SEQ ID NO: 982615 - DNA, 25 bp, Mus musculus
tgtacggccgcaccaccatggcact

SEQ ID NO: 982616 - DNA, 25 bp, Mus musculus
tgtacggccgcagcaccatggcact

SEQ ID NO: 982617 - DNA, 25 bp, Mus musculus
tgtacggcggagatgaagttggcgc

SEQ ID NO: 982618 - DNA, 25 bp, Mus musculus
tgtacggcggagttgaagttggcgc

SEQ ID NO: 982619 - DNA, 25 bp, Mus musculus
tgtacgggacaaccaaggaagctgt

SEQ ID NO: 982620 - DNA, 25 bp, Mus musculus
tgtacgggacaacgaagctgttcgg

SEQ ID NO: 982621 - DNA, 25 bp, Mus musculus
tgtacgggacaagcaaggaagctgt

SEQ ID NO: 982622 - DNA, 25 bp, Mus musculus
tgtacgggacaaggaagctgttcgg

SEQ ID NO: 982623 - DNA, 25 bp, Mus musculus
tgtacgtgaagccccgcaacaagga

SEQ ID NO: 982624 - DNA, 25 bp, Mus musculus
tgtacgtgaagcccggcaacaagga

SEQ ID NO: 982625 - DNA, 25 bp, Mus musculus
tgtactcaagacctggatcagtgag

SEQ ID NO: 982626 - DNA, 25 bp, Mus musculus
tgtactcaagactgcaggcgctaac

SEQ ID NO: 982627 - DNA, 25 bp, Mus musculus
tgtactcaagtcctggatcagtgag

SEQ ID NO: 982628 - DNA, 25 bp, Mus musculus
tgtactcaagtctgcaggcgctaac

SEQ ID NO: 982629 - DNA, 25 bp, Mus musculus
tgtactcagacatacacctgaagaa

SEQ ID NO: 982630 - DNA, 25 bp, Mus musculus
tgtactcagacatagacctgaagaa

SEQ ID NO: 982631 - DNA, 25 bp, Mus musculus
tgtactcctgcacgtttagccgaca

SEQ ID NO: 982632 - DNA, 25 bp, Mus musculus
tgtactcctgcaggtttagccgaca

SEQ ID NO: 982633 - DNA, 25 bp, Mus musculus
tgtactcttacaaacgtgtatgatg

SEQ ID NO: 982634 - DNA, 25 bp, Mus musculus
tgtactcttacaaaggtgtatgatg

SEQ ID NO: 982635 - DNA, 25 bp, Mus musculus
tgtactgaagcacgtatgtttgcaa

SEQ ID NO: 982636 - DNA, 25 bp, Mus musculus
tgtactgaagcaggtatgtttgcaa

SEQ ID NO: 982637 - DNA, 25 bp, Mus musculus
tgtactgaagcatttctggtaggtc

SEQ ID NO: 982638 - DNA, 25 bp, Mus musculus
tgtactgaaggatttctggtaggtc

SEQ ID NO: 982639 - DNA, 25 bp, Mus musculus
tgtactgacggtcacatatatgaaa

SEQ ID NO: 982640 - DNA, 25 bp, Mus musculus
tgtactgacggtcagatatatgaaa

SEQ ID NO: 982641 - DNA, 25 bp, Mus musculus
tgtactgcccggaacccagacatgg

SEQ ID NO: 982642 - DNA, 25 bp, Mus musculus
tgtactgcccggtacccagacatgg

SEQ ID NO: 982643 - DNA, 25 bp, Mus musculus
tgtacttcactgaattttcacctca

SEQ ID NO: 982644 - DNA, 25 bp, Mus musculus
tgtacttcactgtattttcacctca

SEQ ID NO: 982645 - DNA, 25 bp, Mus musculus
tgtagaagccatccgttctcgtgct

SEQ ID NO: 982646 - DNA, 25 bp, Mus musculus
tgtagaagccatgcgttctcgtgct

SEQ ID NO: 982647 - DNA, 25 bp, Mus musculus
tgtagacacagagactggtgctgca

SEQ ID NO: 982648 - DNA, 25 bp, Mus musculus
tgtagacacagagagtggtgctgca

SEQ ID NO: 982649 - DNA, 25 bp, Mus musculus
tgtagaccaaagcccatggcctagg

SEQ ID NO: 982650 - DNA, 25 bp, Mus musculus
tgtagaccaactggtgtctaccatg

SEQ ID NO: 982651 - DNA, 25 bp, Mus musculus
tgtagaccaagtggtgtctaccatg

SEQ ID NO: 982652 - DNA, 25 bp, Mus musculus
tgtagaccaatgcccatggcctagg

SEQ ID NO: 982653 - DNA, 25 bp, Mus musculus
tgtagaccagcgctaattagtattt

SEQ ID NO: 982654 - DNA, 25 bp, Mus musculus
tgtagaccagggctaattagtattt

SEQ ID NO: 982655 - DNA, 25 bp, Mus musculus
tgtagacttgaacaccattgaggat

SEQ ID NO: 982656 - DNA, 25 bp, Mus musculus
tgtagacttgaacagcattgaggat

SEQ ID NO: 982657 - DNA, 25 bp, Mus musculus
tgtagagaagccatctgtggctctt

SEQ ID NO: 982658 - DNA, 25 bp, Mus musculus
tgtagagaagcccatcgcccactat

SEQ ID NO: 982659 - DNA, 25 bp, Mus musculus
tgtagagaaggcatctgtggctctt

SEQ ID NO: 982660 - DNA, 25 bp, Mus musculus
tgtagagaaggccatcgcccactat

SEQ ID NO: 982661 - DNA, 25 bp, Mus musculus
tgtagagcgaatcatgaaggatgtc

SEQ ID NO: 982662 - DNA, 25 bp, Mus musculus
tgtagagcgaatgatgaaggatgtc

SEQ ID NO: 982663 - DNA, 25 bp, Mus musculus
tgtagatatgccagacgaggcatat

SEQ ID NO: 982664 - DNA, 25 bp, Mus musculus
tgtagatatggcagacgaggcatat

SEQ ID NO: 982665 - DNA, 25 bp, Mus musculus
tgtagatgaaagcgctgccccactg

SEQ ID NO: 982666 - DNA, 25 bp, Mus musculus
tgtagatgaaagggctgccccactg

SEQ ID NO: 982667 - DNA, 25 bp, Mus musculus
tgtagatggagaatcgtaccgcgcc

SEQ ID NO: 982668 - DNA, 25 bp, Mus musculus
tgtagatggagaatggtaccgcgcc

SEQ ID NO: 982669 - DNA, 25 bp, Mus musculus
tgtagcagagagtgatcttgtttgt

SEQ ID NO: 982670 - DNA, 25 bp, Mus musculus
tgtagcagagtgtgatcttgtttgt

SEQ ID NO: 982671 - DNA, 25 bp, Mus musculus
tgtagcagtggtcattgatccaacc

SEQ ID NO: 982672 - DNA, 25 bp, Mus musculus
tgtagcagtggtgattgatccaacc

SEQ ID NO: 982673 - DNA, 25 bp, Mus musculus
tgtagccaagaccacatccttcaca

SEQ ID NO: 982674 - DNA, 25 bp, Mus musculus
tgtagccaagctcagattacctgca

SEQ ID NO: 982675 - DNA, 25 bp, Mus musculus
tgtagccaaggtcagattacctgca

SEQ ID NO: 982676 - DNA, 25 bp, Mus musculus
tgtagccaagtccacatccttcaca

SEQ ID NO: 982677 - DNA, 25 bp, Mus musculus
tgtagcccagaaagtcctaggtggg

SEQ ID NO: 982678 - DNA, 25 bp, Mus musculus
tgtagcccagtaagtcctaggtggg

SEQ ID NO: 982679 - DNA, 25 bp, Mus musculus
tgtagcctacgtctgaacaggctgg

SEQ ID NO: 982680 - DNA, 25 bp, Mus musculus
tgtagcctacgtgtgaacaggctgg

SEQ ID NO: 982681 - DNA, 25 bp, Mus musculus
tgtagcctgaaacaacccgagctgt

SEQ ID NO: 982682 - DNA, 25 bp, Mus musculus
tgtagcctgaaagaacccgagctgt

SEQ ID NO: 982683 - DNA, 25 bp, Mus musculus
tgtagcgctgcccgcgatctccatc

SEQ ID NO: 982684 - DNA, 25 bp, Mus musculus
tgtagcgctgcccgggatctccatc

SEQ ID NO: 982685 - DNA, 25 bp, Mus musculus
tgtaggacaaagctatggctttgtg

SEQ ID NO: 982686 - DNA, 25 bp, Mus musculus
tgtaggacaaaggtatggctttgtg

SEQ ID NO: 982687 - DNA, 25 bp, Mus musculus
tgtaggactttgagctgaggctgca

SEQ ID NO: 982688 - DNA, 25 bp, Mus musculus
tgtaggactttgtgctgaggctgca

SEQ ID NO: 982689 - DNA, 25 bp, Mus musculus
tgtaggcaaagttacatccaatgtc

SEQ ID NO: 982690 - DNA, 25 bp, Mus musculus
tgtaggcaaagttagatccaatgtc

SEQ ID NO: 982691 - DNA, 25 bp, Mus musculus
tgtaggcagctaaacgaattacacc

SEQ ID NO: 982692 - DNA, 25 bp, Mus musculus
tgtaggcagctaaaggaattacacc

SEQ ID NO: 982693 - DNA, 25 bp, Mus musculus
tgtaggtgccctgccggcttcgagg

SEQ ID NO: 982694 - DNA, 25 bp, Mus musculus
tgtaggtgccctgcgggcttcgagg

SEQ ID NO: 982695 - DNA, 25 bp, Mus musculus
tgtagtcagtaacctgtggtgtacc

SEQ ID NO: 982696 - DNA, 25 bp, Mus musculus
tgtagtcagtaagctgtggtgtacc

SEQ ID NO: 982697 - DNA, 25 bp, Mus musculus
tgtagtcatgtaccagcaccacgtc

SEQ ID NO: 982698 - DNA, 25 bp, Mus musculus
tgtagtcatgtacctgcaccacgtc

SEQ ID NO: 982699 - DNA, 25 bp, Mus musculus
tgtagtgaagggagaggtacagaaa

SEQ ID NO: 982700 - DNA, 25 bp, Mus musculus
tgtagtgaagggtgaggtacagaaa

SEQ ID NO: 982701 - DNA, 25 bp, Mus musculus
tgtagtgatgctgcatgccatgaag

SEQ ID NO: 982702 - DNA, 25 bp, Mus musculus
tgtagtgatggtgcatgccatgaag

SEQ ID NO: 982703 - DNA, 25 bp, Mus musculus
tgtagtggatcacgcactggcccag

SEQ ID NO: 982704 - DNA, 25 bp, Mus musculus
tgtagtggatcaggcactggcccag

SEQ ID NO: 982705 - DNA, 25 bp, Mus musculus
tgtagtggtgctcacgcaagatggg

SEQ ID NO: 982706 - DNA, 25 bp, Mus musculus
tgtagtggtgctcactggcagcatg

SEQ ID NO: 982707 - DNA, 25 bp, Mus musculus
tgtagtggtgctcaggcaagatggg

SEQ ID NO: 982708 - DNA, 25 bp, Mus musculus
tgtagtggtgctcagtggcagcatg

SEQ ID NO: 982709 - DNA, 25 bp, Mus musculus
tgtagtttctctgttcctggtggag

SEQ ID NO: 982710 - DNA, 25 bp, Mus musculus
tgtagtttctgtgttcctggtggag

SEQ ID NO: 982711 - DNA, 25 bp, Mus musculus
tgtataaatgagactgctattgata

SEQ ID NO: 982712 - DNA, 25 bp, Mus musculus
tgtataaatgagtctgctattgata

SEQ ID NO: 982713 - DNA, 25 bp, Mus musculus
tgtatacatgatcccttcaggcttc

SEQ ID NO: 982714 - DNA, 25 bp, Mus musculus
tgtatacatgttcccttcaggcttc

SEQ ID NO: 982715 - DNA, 25 bp, Mus musculus
tgtatagaagagggaagatgcccga

SEQ ID NO: 982716 - DNA, 25 bp, Mus musculus
tgtatagaagtgggaagatgcccga

SEQ ID NO: 982717 - DNA, 25 bp, Mus musculus
tgtatagataaaaatgtcatggaaa

SEQ ID NO: 982718 - DNA, 25 bp, Mus musculus
tgtatagataaatatgtcatggaaa

SEQ ID NO: 982719 - DNA, 25 bp, Mus musculus
tgtatatcagacactgtcctgttgg

SEQ ID NO: 982720 - DNA, 25 bp, Mus musculus
tgtatatcagtcactgtcctgttgg

SEQ ID NO: 982721 - DNA, 25 bp, Mus musculus
tgtatatctttccttttggcttggt

SEQ ID NO: 982722 - DNA, 25 bp, Mus musculus
tgtatatctttcgttttggcttggt

SEQ ID NO: 982723 - DNA, 25 bp, Mus musculus
tgtatcaaaccctacctgggggaat

SEQ ID NO: 982724 - DNA, 25 bp, Mus musculus
tgtatcaaacgctacctgggggaat

SEQ ID NO: 982725 - DNA, 25 bp, Mus musculus
tgtatcatcggacttttggaccaat

SEQ ID NO: 982726 - DNA, 25 bp, Mus musculus
tgtatcatcggagttttggaccaat

SEQ ID NO: 982727 - DNA, 25 bp, Mus musculus
tgtatcattacacaatttgcaaagt

SEQ ID NO: 982728 - DNA, 25 bp, Mus musculus
tgtatcattacagaatttgcaaagt

SEQ ID NO: 982729 - DNA, 25 bp, Mus musculus
tgtatccatggacgtattcctccac

SEQ ID NO: 982730 - DNA, 25 bp, Mus musculus
tgtatccatggaggtattcctccac

SEQ ID NO: 982731 - DNA, 25 bp, Mus musculus
tgtatgaaagcctgtcagccggatg

SEQ ID NO: 982732 - DNA, 25 bp, Mus musculus
tgtatgaaaggctgtcagccggatg

SEQ ID NO: 982733 - DNA, 25 bp, Mus musculus
tgtatgaatatacatttttaaataa

SEQ ID NO: 982734 - DNA, 25 bp, Mus musculus
tgtatgaatatagatttttaaataa

SEQ ID NO: 982735 - DNA, 25 bp, Mus musculus
tgtatgccagcttatgaaggtgtat

SEQ ID NO: 982736 - DNA, 25 bp, Mus musculus
tgtatgccaggttatgaaggtgtat

SEQ ID NO: 982737 - DNA, 25 bp, Mus musculus
tgtatgcgggagctcccatcagtag

SEQ ID NO: 982738 - DNA, 25 bp, Mus musculus
tgtatgcgggaggtcccatcagtag

SEQ ID NO: 982739 - DNA, 25 bp, Mus musculus
tgtatgctccagccaaggaggactg

SEQ ID NO: 982740 - DNA, 25 bp, Mus musculus
tgtatgctccaggcaaggaggactg

SEQ ID NO: 982741 - DNA, 25 bp, Mus musculus
tgtatggcgcccgcgggaagggacg

SEQ ID NO: 982742 - DNA, 25 bp, Mus musculus
tgtatggcgcgcgcgggaagggacg

SEQ ID NO: 982743 - DNA, 25 bp, Mus musculus
tgtatgggggcacgtggctttgtgg

SEQ ID NO: 982744 - DNA, 25 bp, Mus musculus
tgtatgggggcaggtggctttgtgg

SEQ ID NO: 982745 - DNA, 25 bp, Mus musculus
tgtatgtatacacgtttgttaactg

SEQ ID NO: 982746 - DNA, 25 bp, Mus musculus
tgtatgtatacaggtttgttaactg

SEQ ID NO: 982747 - DNA, 25 bp, Mus musculus
tgtatgtatacgacaccacggcgac

SEQ ID NO: 982748 - DNA, 25 bp, Mus musculus
tgtatgtatacgatccccccacaac

SEQ ID NO: 982749 - DNA, 25 bp, Mus musculus
tgtatgtatacgtcaccacggcgac

SEQ ID NO: 982750 - DNA, 25 bp, Mus musculus
tgtatgtatacgttccccccacaac

SEQ ID NO: 982751 - DNA, 25 bp, Mus musculus
tgtatgtgagcacattttctcctca

SEQ ID NO: 982752 - DNA, 25 bp, Mus musculus
tgtatgtgagcagattttctcctca

SEQ ID NO: 982753 - DNA, 25 bp, Mus musculus
tgtattatcgttatgagtattggag

SEQ ID NO: 982754 - DNA, 25 bp, Mus musculus
tgtattatcgttttgagtattggag

SEQ ID NO: 982755 - DNA, 25 bp, Mus musculus
tgtattcaagatgctggagacttgg

SEQ ID NO: 982756 - DNA, 25 bp, Mus musculus
tgtattcaagctctgcgacgagccc

SEQ ID NO: 982757 - DNA, 25 bp, Mus musculus
tgtattcaaggtctgcgacgagccc

SEQ ID NO: 982758 - DNA, 25 bp, Mus musculus
tgtattcaagttgctggagacttgg

SEQ ID NO: 982759 - DNA, 25 bp, Mus musculus
tgtattccagattgactgtaccaac

SEQ ID NO: 982760 - DNA, 25 bp, Mus musculus
tgtattccagtttgactgtaccaac

SEQ ID NO: 982761 - DNA, 25 bp, Mus musculus
tgtattctgcaaaaccttatgcaca

SEQ ID NO: 982762 - DNA, 25 bp, Mus musculus
tgtattctgcaaacttcaagcacaa

SEQ ID NO: 982763 - DNA, 25 bp, Mus musculus
tgtattctgcaataccttatgcaca

SEQ ID NO: 982764 - DNA, 25 bp, Mus musculus
tgtattctgcaatcttcaagcacaa

SEQ ID NO: 982765 - DNA, 25 bp, Mus musculus
tgtattttctcacgtgtgcatgtag

SEQ ID NO: 982766 - DNA, 25 bp, Mus musculus
tgtattttctcaggtgtgcatgtag

SEQ ID NO: 982767 - DNA, 25 bp, Mus musculus
tgtcaaaaaacccaaggtgatgctg

SEQ ID NO: 982768 - DNA, 25 bp, Mus musculus
tgtcaaaaaacccatggtgatgctg

SEQ ID NO: 982769 - DNA, 25 bp, Mus musculus
tgtcaaaaagctacgactcgaggtg

SEQ ID NO: 982770 - DNA, 25 bp, Mus musculus
tgtcaaaaagctatggttccgaccg

SEQ ID NO: 982771 - DNA, 25 bp, Mus musculus
tgtcaaaaaggtacgactcgaggtg

SEQ ID NO: 982772 - DNA, 25 bp, Mus musculus
tgtcaaaaaggtatggttccgaccg

SEQ ID NO: 982773 - DNA, 25 bp, Mus musculus
tgtcaaaactgcaacttgcacccag

SEQ ID NO: 982774 - DNA, 25 bp, Mus musculus
tgtcaaaactgcaagttgcacccag

SEQ ID NO: 982775 - DNA, 25 bp, Mus musculus
tgtcaaacagatgaagattatccac

SEQ ID NO: 982776 - DNA, 25 bp, Mus musculus
tgtcaaacagatgatgattatccac

SEQ ID NO: 982777 - DNA, 25 bp, Mus musculus
tgtcaaacttcacagtgaatgccat

SEQ ID NO: 982778 - DNA, 25 bp, Mus musculus
tgtcaaacttcagagtgaatgccat

SEQ ID NO: 982779 - DNA, 25 bp, Mus musculus
tgtcaaagactgccttactaaagat

SEQ ID NO: 982780 - DNA, 25 bp, Mus musculus
tgtcaaagactggcttactaaagat

SEQ ID NO: 982781 - DNA, 25 bp, Mus musculus
tgtcaaagagcagaaggctggaaag

SEQ ID NO: 982782 - DNA, 25 bp, Mus musculus
tgtcaaagaggagaaggctggaaag

SEQ ID NO: 982783 - DNA, 25 bp, Mus musculus
tgtcaaagatcaattatcatgtaga

SEQ ID NO: 982784 - DNA, 25 bp, Mus musculus
tgtcaaagatcatttatcatgtaga

SEQ ID NO: 982785 - DNA, 25 bp, Mus musculus
tgtcaaccagcaacctggctcaccg

SEQ ID NO: 982786 - DNA, 25 bp, Mus musculus
tgtcaaccaggaacctggctcaccg

SEQ ID NO: 982787 - DNA, 25 bp, Mus musculus
tgtcaactctcccacggctttctga

SEQ ID NO: 982788 - DNA, 25 bp, Mus musculus
tgtcaactctcccagggctttctga

SEQ ID NO: 982789 - DNA, 25 bp, Mus musculus
tgtcaagaacaacgcccagtctgtg

SEQ ID NO: 982790 - DNA, 25 bp, Mus musculus
tgtcaagaacaaggcccagtctgtg

SEQ ID NO: 982791 - DNA, 25 bp, Mus musculus
tgtcaagaacagctggggaagtgaa

SEQ ID NO: 982792 - DNA, 25 bp, Mus musculus
tgtcaagaacaggtggggaagtgaa

SEQ ID NO: 982793 - DNA, 25 bp, Mus musculus
tgtcaagaagctaatatcttattgt

SEQ ID NO: 982794 - DNA, 25 bp, Mus musculus
tgtcaagaaggtaatatcttattgt

SEQ ID NO: 982795 - DNA, 25 bp, Mus musculus
tgtcaagaccaaacggcccccttga

SEQ ID NO: 982796 - DNA, 25 bp, Mus musculus
tgtcaagaccaatcggcccccttga

SEQ ID NO: 982797 - DNA, 25 bp, Mus musculus
tgtcaagacgcacccgtttacaagc

SEQ ID NO: 982798 - DNA, 25 bp, Mus musculus
tgtcaagacgcactagccgtttaca

SEQ ID NO: 982799 - DNA, 25 bp, Mus musculus
tgtcaagacgcagccgtttacaagc

SEQ ID NO: 982800 - DNA, 25 bp, Mus musculus
tgtcaagacgcagtagccgtttaca

SEQ ID NO: 982801 - DNA, 25 bp, Mus musculus
tgtcaagaggatgtctccaagaggt

SEQ ID NO: 982802 - DNA, 25 bp, Mus musculus
tgtcaagaggttgtctccaagaggt

SEQ ID NO: 982803 - DNA, 25 bp, Mus musculus
tgtcaagcacggcgcgggggcagag

SEQ ID NO: 982804 - DNA, 25 bp, Mus musculus
tgtcaagcacggggcgggggcagag

SEQ ID NO: 982805 - DNA, 25 bp, Mus musculus
tgtcaagcagcgtaatctccccccg

SEQ ID NO: 982806 - DNA, 25 bp, Mus musculus
tgtcaagcagggtaatctccccccg

SEQ ID NO: 982807 - DNA, 25 bp, Mus musculus
tgtcaaggacagcgagtcattccca

SEQ ID NO: 982808 - DNA, 25 bp, Mus musculus
tgtcaaggacagggagtcattccca

SEQ ID NO: 982809 - DNA, 25 bp, Mus musculus
tgtcaatcaatgctgtcccagatga

SEQ ID NO: 982810 - DNA, 25 bp, Mus musculus
tgtcaatcaatggtgtcccagatga

SEQ ID NO: 982811 - DNA, 25 bp, Mus musculus
tgtcaatcacaacttgaaagatgcc

SEQ ID NO: 982812 - DNA, 25 bp, Mus musculus
tgtcaatcacaagttgaaagatgcc

SEQ ID NO: 982813 - DNA, 25 bp, Mus musculus
tgtcaatgagccagaattccacctg

SEQ ID NO: 982814 - DNA, 25 bp, Mus musculus
tgtcaatgagctaatcgtcgagcag

SEQ ID NO: 982815 - DNA, 25 bp, Mus musculus
tgtcaatgaggcagaattccacctg

SEQ ID NO: 982816 - DNA, 25 bp, Mus musculus
tgtcaatgaggtaatcgtcgagcag

SEQ ID NO: 982817 - DNA, 25 bp, Mus musculus
tgtcaatgaggtatcgtcgagcagt

SEQ ID NO: 982818 - DNA, 25 bp, Mus musculus
tgtcaatgaggtttcgtcgagcagt

SEQ ID NO: 982819 - DNA, 25 bp, Mus musculus
tgtcaatggttccgcaactgaatgg

SEQ ID NO: 982820 - DNA, 25 bp, Mus musculus
tgtcaatggttcggcaactgaatgg

SEQ ID NO: 982821 - DNA, 25 bp, Mus musculus
tgtcacaagaaacaagagccaagtg

SEQ ID NO: 982822 - DNA, 25 bp, Mus musculus
tgtcacaagaaagaagagccaagtg

SEQ ID NO: 982823 - DNA, 25 bp, Mus musculus
tgtcacaagcagacatgaaagtcca

SEQ ID NO: 982824 - DNA, 25 bp, Mus musculus
tgtcacaagcagactgaccaaggac

SEQ ID NO: 982825 - DNA, 25 bp, Mus musculus
tgtcacaagcagtcatgaaagtcca

SEQ ID NO: 982826 - DNA, 25 bp, Mus musculus
tgtcacaagcagtctgaccaaggac

SEQ ID NO: 982827 - DNA, 25 bp, Mus musculus
tgtcacaaggatcacatgaaaggat

SEQ ID NO: 982828 - DNA, 25 bp, Mus musculus
tgtcacaaggttcacatgaaaggat

SEQ ID NO: 982829 - DNA, 25 bp, Mus musculus
tgtcacacaatgcaattcgctttgg

SEQ ID NO: 982830 - DNA, 25 bp, Mus musculus
tgtcacacaatggaattcgctttgg

SEQ ID NO: 982831 - DNA, 25 bp, Mus musculus
tgtcacagagcacaatgattggcag

SEQ ID NO: 982832 - DNA, 25 bp, Mus musculus
tgtcacagagcacttttaataaccc

SEQ ID NO: 982833 - DNA, 25 bp, Mus musculus
tgtcacagagcagaatgattggcag

SEQ ID NO: 982834 - DNA, 25 bp, Mus musculus
tgtcacagagcagttttaataaccc

SEQ ID NO: 982835 - DNA, 25 bp, Mus musculus
tgtcacagcgcacttttatggccag

SEQ ID NO: 982836 - DNA, 25 bp, Mus musculus
tgtcacagcggacttttatggccag

SEQ ID NO: 982837 - DNA, 25 bp, Mus musculus
tgtcacagctctgtctatgagcagt

SEQ ID NO: 982838 - DNA, 25 bp, Mus musculus
tgtcacagctgtgtctatgagcagt

SEQ ID NO: 982839 - DNA, 25 bp, Mus musculus
tgtcacaggattcacctctgtttcc

SEQ ID NO: 982840 - DNA, 25 bp, Mus musculus
tgtcacaggattcacgccactaaac

SEQ ID NO: 982841 - DNA, 25 bp, Mus musculus
tgtcacaggattcagctctgtttcc

SEQ ID NO: 982842 - DNA, 25 bp, Mus musculus
tgtcacaggattcaggccactaaac

SEQ ID NO: 982843 - DNA, 25 bp, Mus musculus
tgtcaccaaaactgtgaagggaggg

SEQ ID NO: 982844 - DNA, 25 bp, Mus musculus
tgtcaccaaatctgtgaagggaggg

SEQ ID NO: 982845 - DNA, 25 bp, Mus musculus
tgtcaccaagcaccccaactggtac

SEQ ID NO: 982846 - DNA, 25 bp, Mus musculus
tgtcaccaaggaccccaactggtac

SEQ ID NO: 982847 - DNA, 25 bp, Mus musculus
tgtcacccagctttacacgctattg

SEQ ID NO: 982848 - DNA, 25 bp, Mus musculus
tgtcacccaggtttacacgctattg

SEQ ID NO: 982849 - DNA, 25 bp, Mus musculus
tgtcacccccaatgagtacactgca

SEQ ID NO: 982850 - DNA, 25 bp, Mus musculus
tgtcacccccaatgtgtacactgca

SEQ ID NO: 982851 - DNA, 25 bp, Mus musculus
tgtcacccctgtatatcaacctgaa

SEQ ID NO: 982852 - DNA, 25 bp, Mus musculus
tgtcacccctgtttatcaacctgaa

SEQ ID NO: 982853 - DNA, 25 bp, Mus musculus
tgtcaccttcagctacccctgcaga

SEQ ID NO: 982854 - DNA, 25 bp, Mus musculus
tgtcaccttcaggtacccctgcaga

SEQ ID NO: 982855 - DNA, 25 bp, Mus musculus
tgtcacgccgggcactgaccagctg

SEQ ID NO: 982856 - DNA, 25 bp, Mus musculus
tgtcacgccggggactgaccagctg

SEQ ID NO: 982857 - DNA, 25 bp, Mus musculus
tgtcacggaggccacgctgtccttc

SEQ ID NO: 982858 - DNA, 25 bp, Mus musculus
tgtcacggaggccaggctgtccttc

SEQ ID NO: 982859 - DNA, 25 bp, Mus musculus
tgtcactcagctgcggacattctac

SEQ ID NO: 982860 - DNA, 25 bp, Mus musculus
tgtcactcaggtgcggacattctac

SEQ ID NO: 982861 - DNA, 25 bp, Mus musculus
tgtcactgcagccacggctccgggt

SEQ ID NO: 982862 - DNA, 25 bp, Mus musculus
tgtcactgcagccctgctgtggctg

SEQ ID NO: 982863 - DNA, 25 bp, Mus musculus
tgtcactgcagcgacggctccgggt

SEQ ID NO: 982864 - DNA, 25 bp, Mus musculus
tgtcactgcagcgctgctgtggctg

SEQ ID NO: 982865 - DNA, 25 bp, Mus musculus
tgtcactgccagaactcggttacca

SEQ ID NO: 982866 - DNA, 25 bp, Mus musculus
tgtcactgccagtactcggttacca

SEQ ID NO: 982867 - DNA, 25 bp, Mus musculus
tgtcacttccacggagggatactta

SEQ ID NO: 982868 - DNA, 25 bp, Mus musculus
tgtcacttccacggtgggatactta

SEQ ID NO: 982869 - DNA, 25 bp, Mus musculus
tgtcactttatacaacttcacctca

SEQ ID NO: 982870 - DNA, 25 bp, Mus musculus
tgtcactttatagaacttcacctca

SEQ ID NO: 982871 - DNA, 25 bp, Mus musculus
tgtcagaaagaacaggaaaccagag

SEQ ID NO: 982872 - DNA, 25 bp, Mus musculus
tgtcagaaagaagaggaaaccagag

SEQ ID NO: 982873 - DNA, 25 bp, Mus musculus
tgtcagaaccaggcaccaccgaggg

SEQ ID NO: 982874 - DNA, 25 bp, Mus musculus
tgtcagaacctggcaccaccgaggg

SEQ ID NO: 982875 - DNA, 25 bp, Mus musculus
tgtcagacacaacgttcatcacgag

SEQ ID NO: 982876 - DNA, 25 bp, Mus musculus
tgtcagacacaaggttcatcacgag

SEQ ID NO: 982877 - DNA, 25 bp, Mus musculus
tgtcagacagctttggccgcaagcc

SEQ ID NO: 982878 - DNA, 25 bp, Mus musculus
tgtcagacaggtttggccgcaagcc

SEQ ID NO: 982879 - DNA, 25 bp, Mus musculus
tgtcagacatgacacgagggcttcg

SEQ ID NO: 982880 - DNA, 25 bp, Mus musculus
tgtcagacatgacaggagggcttcg

SEQ ID NO: 982881 - DNA, 25 bp, Mus musculus
tgtcagaggaaaatatgacatgcac

SEQ ID NO: 982882 - DNA, 25 bp, Mus musculus
tgtcagaggaaattatgacatgcac

SEQ ID NO: 982883 - DNA, 25 bp, Mus musculus
tgtcagcaggacgtcgtgacagagt

SEQ ID NO: 982884 - DNA, 25 bp, Mus musculus
tgtcagcaggacgtggtgacagagt

SEQ ID NO: 982885 - DNA, 25 bp, Mus musculus
tgtcagcctgctactttctgcagaa

SEQ ID NO: 982886 - DNA, 25 bp, Mus musculus
tgtcagcctggtactttctgcagaa

SEQ ID NO: 982887 - DNA, 25 bp, Mus musculus
tgtcagcgcaaactcggcaaacgct

SEQ ID NO: 982888 - DNA, 25 bp, Mus musculus
tgtcagcgcaaactgggcaaacgct

SEQ ID NO: 982889 - DNA, 25 bp, Mus musculus
tgtcagcgggaacagcagtggtgaa

SEQ ID NO: 982890 - DNA, 25 bp, Mus musculus
tgtcagcgggtacagcagtggtgaa

SEQ ID NO: 982891 - DNA, 25 bp, Mus musculus
tgtcagctacatgacggcagtggat

SEQ ID NO: 982892 - DNA, 25 bp, Mus musculus
tgtcagctacatgagggcagtggat

SEQ ID NO: 982893 - DNA, 25 bp, Mus musculus
tgtcagctgacaaagtgtcctcgca

SEQ ID NO: 982894 - DNA, 25 bp, Mus musculus
tgtcagctgacatagtgtcctcgca

SEQ ID NO: 982895 - DNA, 25 bp, Mus musculus
tgtcagctgccaacggacaaggctg

SEQ ID NO: 982896 - DNA, 25 bp, Mus musculus
tgtcagctgccatcggacaaggctg

SEQ ID NO: 982897 - DNA, 25 bp, Mus musculus
tgtcagctgtaccacggaacggaga

SEQ ID NO: 982898 - DNA, 25 bp, Mus musculus
tgtcagctgtaccagggaacggaga

SEQ ID NO: 982899 - DNA, 25 bp, Mus musculus
tgtcaggaagcagtcacacctgaat

SEQ ID NO: 982900 - DNA, 25 bp, Mus musculus
tgtcaggaaggagtcacacctgaat

SEQ ID NO: 982901 - DNA, 25 bp, Mus musculus
tgtcaggagcagattgccagggcaa

SEQ ID NO: 982902 - DNA, 25 bp, Mus musculus
tgtcaggagcagtttgccagggcaa

SEQ ID NO: 982903 - DNA, 25 bp, Mus musculus
tgtcaggggaccagcaaatcacccc

SEQ ID NO: 982904 - DNA, 25 bp, Mus musculus
tgtcaggggaccaggaaatcacccc

SEQ ID NO: 982905 - DNA, 25 bp, Mus musculus
tgtcaggttctacatatgtgctgac

SEQ ID NO: 982906 - DNA, 25 bp, Mus musculus
tgtcaggttctagatatgtgctgac

SEQ ID NO: 982907 - DNA, 25 bp, Mus musculus
tgtcagtatgaggtccagtgtgagc

SEQ ID NO: 982908 - DNA, 25 bp, Mus musculus
tgtcagtatgtggtccagtgtgagc

SEQ ID NO: 982909 - DNA, 25 bp, Mus musculus
tgtcagtcagcggacgtggaacacc

SEQ ID NO: 982910 - DNA, 25 bp, Mus musculus
tgtcagtcaggggacgtggaacacc

SEQ ID NO: 982911 - DNA, 25 bp, Mus musculus
tgtcagtcctatcgcagtaccagtg

SEQ ID NO: 982912 - DNA, 25 bp, Mus musculus
tgtcagtcctatggcagtaccagtg

SEQ ID NO: 982913 - DNA, 25 bp, Mus musculus
tgtcagtcttcacgagatgaagcct

SEQ ID NO: 982914 - DNA, 25 bp, Mus musculus
tgtcagtcttcaggagatgaagcct

SEQ ID NO: 982915 - DNA, 25 bp, Mus musculus
tgtcagtgagcttcctgctgctgtc

SEQ ID NO: 982916 - DNA, 25 bp, Mus musculus
tgtcagtgagctttctgtcaggccc

SEQ ID NO: 982917 - DNA, 25 bp, Mus musculus
tgtcagtgaggttcctgctgctgtc

SEQ ID NO: 982918 - DNA, 25 bp, Mus musculus
tgtcagtgaggtttctgtcaggccc

SEQ ID NO: 982919 - DNA, 25 bp, Mus musculus
tgtcagtgatcgccaacttcagtga

SEQ ID NO: 982920 - DNA, 25 bp, Mus musculus
tgtcagtgatcggcaacttcagtga

SEQ ID NO: 982921 - DNA, 25 bp, Mus musculus
tgtcagttacagagaagtcataaag

SEQ ID NO: 982922 - DNA, 25 bp, Mus musculus
tgtcagttacagagtagtcataaag

SEQ ID NO: 982923 - DNA, 25 bp, Mus musculus
tgtcatagaaaacaactttcagcca

SEQ ID NO: 982924 - DNA, 25 bp, Mus musculus
tgtcatagaaaagaactttcagcca

SEQ ID NO: 982925 - DNA, 25 bp, Mus musculus
tgtcatagcacacatcctggccggc

SEQ ID NO: 982926 - DNA, 25 bp, Mus musculus
tgtcatagcacagatcctggccggc

SEQ ID NO: 982927 - DNA, 25 bp, Mus musculus
tgtcatagccagcttgcaaaggcag

SEQ ID NO: 982928 - DNA, 25 bp, Mus musculus
tgtcatagccagctttagtccctat

SEQ ID NO: 982929 - DNA, 25 bp, Mus musculus
tgtcatagccaggttgcaaaggcag

SEQ ID NO: 982930 - DNA, 25 bp, Mus musculus
tgtcatagccaggtttagtccctat

SEQ ID NO: 982931 - DNA, 25 bp, Mus musculus
tgtcatcaaattgactattattttg

SEQ ID NO: 982932 - DNA, 25 bp, Mus musculus
tgtcatcaaattgagtattattttg

SEQ ID NO: 982933 - DNA, 25 bp, Mus musculus
tgtcatcaaccaccatggcgaggag

SEQ ID NO: 982934 - DNA, 25 bp, Mus musculus
tgtcatcaaccagcatggcgaggag

SEQ ID NO: 982935 - DNA, 25 bp, Mus musculus
tgtcatcaagctaaccccaaggaag

SEQ ID NO: 982936 - DNA, 25 bp, Mus musculus
tgtcatcaaggtaaccccaaggaag

SEQ ID NO: 982937 - DNA, 25 bp, Mus musculus
tgtcatcacgctgctcgaacagcac

SEQ ID NO: 982938 - DNA, 25 bp, Mus musculus
tgtcatcacggtgctcgaacagcac

SEQ ID NO: 982939 - DNA, 25 bp, Mus musculus
tgtcatcatgagcaactcagccagt

SEQ ID NO: 982940 - DNA, 25 bp, Mus musculus
tgtcatcatgaggaactcagccagt

SEQ ID NO: 982941 - DNA, 25 bp, Mus musculus
tgtcatccacagaatcctagacttt

SEQ ID NO: 982942 - DNA, 25 bp, Mus musculus
tgtcatccacagagacttgaagcct

SEQ ID NO: 982943 - DNA, 25 bp, Mus musculus
tgtcatccacagtatcctagacttt

SEQ ID NO: 982944 - DNA, 25 bp, Mus musculus
tgtcatccacagtgacttgaagcct

SEQ ID NO: 982945 - DNA, 25 bp, Mus musculus
tgtcatccaccacgctggaaatgga

SEQ ID NO: 982946 - DNA, 25 bp, Mus musculus
tgtcatccaccaggctggaaatgga

SEQ ID NO: 982947 - DNA, 25 bp, Mus musculus
tgtcatccggaacctggcaaaaacg

SEQ ID NO: 982948 - DNA, 25 bp, Mus musculus
tgtcatccggaagctggcaaaaacg

SEQ ID NO: 982949 - DNA, 25 bp, Mus musculus
tgtcatcctcagacaacattgtgca

SEQ ID NO: 982950 - DNA, 25 bp, Mus musculus
tgtcatcctcagccacaccaagatg

SEQ ID NO: 982951 - DNA, 25 bp, Mus musculus
tgtcatcctcagccagtgccctgaa

SEQ ID NO: 982952 - DNA, 25 bp, Mus musculus
tgtcatcctcaggcacaccaagatg

SEQ ID NO: 982953 - DNA, 25 bp, Mus musculus
tgtcatcctcaggcagtgccctgaa

SEQ ID NO: 982954 - DNA, 25 bp, Mus musculus
tgtcatcctcagtcaacattgtgca

SEQ ID NO: 982955 - DNA, 25 bp, Mus musculus
tgtcatccttctctcattgggagaa

SEQ ID NO: 982956 - DNA, 25 bp, Mus musculus
tgtcatccttgtctcattgggagaa

SEQ ID NO: 982957 - DNA, 25 bp, Mus musculus
tgtcatcgagatgctggacgttgac

SEQ ID NO: 982958 - DNA, 25 bp, Mus musculus
tgtcatcgagttgctggacgttgac

SEQ ID NO: 982959 - DNA, 25 bp, Mus musculus
tgtcatctcccacggactgcgcagc

SEQ ID NO: 982960 - DNA, 25 bp, Mus musculus
tgtcatctcccagggactgcgcagc

SEQ ID NO: 982961 - DNA, 25 bp, Mus musculus
tgtcatcttccagccgaagcgccgt

SEQ ID NO: 982962 - DNA, 25 bp, Mus musculus
tgtcatcttccagcggaagcgccgt

SEQ ID NO: 982963 - DNA, 25 bp, Mus musculus
tgtcatgaagagcccctttaacaac

SEQ ID NO: 982964 - DNA, 25 bp, Mus musculus
tgtcatgaagtgcccctttaacaac

SEQ ID NO: 982965 - DNA, 25 bp, Mus musculus
tgtcatgacacacactagaggaaat

SEQ ID NO: 982966 - DNA, 25 bp, Mus musculus
tgtcatgacacagactagaggaaat

SEQ ID NO: 982967 - DNA, 25 bp, Mus musculus
tgtcatgatgctgtttggccttggt

SEQ ID NO: 982968 - DNA, 25 bp, Mus musculus
tgtcatgatggtgtttggccttggt

SEQ ID NO: 982969 - DNA, 25 bp, Mus musculus
tgtcatgcacaacatccggccacac

SEQ ID NO: 982970 - DNA, 25 bp, Mus musculus
tgtcatgcacaagatccggccacac

SEQ ID NO: 982971 - DNA, 25 bp, Mus musculus
tgtcatgtttaacgttggtgaagat

SEQ ID NO: 982972 - DNA, 25 bp, Mus musculus
tgtcatgtttaaggttggtgaagat

SEQ ID NO: 982973 - DNA, 25 bp, Mus musculus
tgtcattatgatctttgagatgatt

SEQ ID NO: 982974 - DNA, 25 bp, Mus musculus
tgtcattatgttctttgagatgatt

SEQ ID NO: 982975 - DNA, 25 bp, Mus musculus
tgtcattcaaagaacttaaggccac

SEQ ID NO: 982976 - DNA, 25 bp, Mus musculus
tgtcattcaaagtacttaaggccac

SEQ ID NO: 982977 - DNA, 25 bp, Mus musculus
tgtcattcattgccaatggcgtggt

SEQ ID NO: 982978 - DNA, 25 bp, Mus musculus
tgtcattcattggcaatggcgtggt

SEQ ID NO: 982979 - DNA, 25 bp, Mus musculus
tgtcattctgaacatgatgctgtct

SEQ ID NO: 982980 - DNA, 25 bp, Mus musculus
tgtcattctgtacatgatgctgtct

SEQ ID NO: 982981 - DNA, 25 bp, Mus musculus
tgtcattgagaactgccccaagcca

SEQ ID NO: 982982 - DNA, 25 bp, Mus musculus
tgtcattgagaagtgccccaagcca

SEQ ID NO: 982983 - DNA, 25 bp, Mus musculus
tgtcattgagctgctggggttgttc

SEQ ID NO: 982984 - DNA, 25 bp, Mus musculus
tgtcattgaggtgctggggttgttc

SEQ ID NO: 982985 - DNA, 25 bp, Mus musculus
tgtcattggagccacgcaggtgcag

SEQ ID NO: 982986 - DNA, 25 bp, Mus musculus
tgtcattggagccacgtacgtacag

SEQ ID NO: 982987 - DNA, 25 bp, Mus musculus
tgtcattggagccaggcaggtgcag

SEQ ID NO: 982988 - DNA, 25 bp, Mus musculus
tgtcattggagccaggtacgtacag

SEQ ID NO: 982989 - DNA, 25 bp, Mus musculus
tgtccaaaatattgcggtagaggtg

SEQ ID NO: 982990 - DNA, 25 bp, Mus musculus
tgtccaaaattttgcggtagaggtg

SEQ ID NO: 982991 - DNA, 25 bp, Mus musculus
tgtccaacaaatgtcgtccgtgctt

SEQ ID NO: 982992 - DNA, 25 bp, Mus musculus
tgtccaacaaatgtggtccgtgctt

SEQ ID NO: 982993 - DNA, 25 bp, Mus musculus
tgtccaaccagaaacagtccaaagc

SEQ ID NO: 982994 - DNA, 25 bp, Mus musculus
tgtccaaccagaaagagtccaaagc

SEQ ID NO: 982995 - DNA, 25 bp, Mus musculus
tgtccacagaaacacgctttgctct

SEQ ID NO: 982996 - DNA, 25 bp, Mus musculus
tgtccacagaaacaggctttgctct

SEQ ID NO: 982997 - DNA, 25 bp, Mus musculus
tgtccaccaaaacgaggatactccc

SEQ ID NO: 982998 - DNA, 25 bp, Mus musculus
tgtccaccaaaaggaggatactccc

SEQ ID NO: 982999 - DNA, 25 bp, Mus musculus
tgtccaccacgacgatctccaagat

SEQ ID NO: 983000 - DNA, 25 bp, Mus musculus
tgtccaccacgaggatctccaagat

SEQ ID NO: 983001 - DNA, 25 bp, Mus musculus
tgtccacctgattgaattcgccagg

SEQ ID NO: 983002 - DNA, 25 bp, Mus musculus
tgtccacctgtttgaattcgccagg

SEQ ID NO: 983003 - DNA, 25 bp, Mus musculus
tgtccacgcgccagcgaatggacct

SEQ ID NO: 983004 - DNA, 25 bp, Mus musculus
tgtccacgcgccagggaatggacct

SEQ ID NO: 983005 - DNA, 25 bp, Mus musculus
tgtccagaagctggggcttatggat

SEQ ID NO: 983006 - DNA, 25 bp, Mus musculus
tgtccagaaggtggggcttatggat

SEQ ID NO: 983007 - DNA, 25 bp, Mus musculus
tgtccagaccaacggtacagcctgt

SEQ ID NO: 983008 - DNA, 25 bp, Mus musculus
tgtccagaccaagggtacagcctgt

SEQ ID NO: 983009 - DNA, 25 bp, Mus musculus
tgtccagactcgcggccctgttctc

SEQ ID NO: 983010 - DNA, 25 bp, Mus musculus
tgtccagactcggggccctgttctc

SEQ ID NO: 983011 - DNA, 25 bp, Mus musculus
tgtccagactctaaggtgcctggtg

SEQ ID NO: 983012 - DNA, 25 bp, Mus musculus
tgtccagactgtaaggtgcctggtg

SEQ ID NO: 983013 - DNA, 25 bp, Mus musculus
tgtccagagttgcgtcacagcctct

SEQ ID NO: 983014 - DNA, 25 bp, Mus musculus
tgtccagagttgggtcacagcctct

SEQ ID NO: 983015 - DNA, 25 bp, Mus musculus
tgtccagcggcttgcctgtggctac

SEQ ID NO: 983016 - DNA, 25 bp, Mus musculus
tgtccagcgggttgcctgtggctac

SEQ ID NO: 983017 - DNA, 25 bp, Mus musculus
tgtccaggaaaacctctggatttgt

SEQ ID NO: 983018 - DNA, 25 bp, Mus musculus
tgtccaggaatacctctggatttgt

SEQ ID NO: 983019 - DNA, 25 bp, Mus musculus
tgtccaggacaagacgtgcccagct

SEQ ID NO: 983020 - DNA, 25 bp, Mus musculus
tgtccaggacaagaggtgcccagct

SEQ ID NO: 983021 - DNA, 25 bp, Mus musculus
tgtccatgagaagacgaagcttctt

SEQ ID NO: 983022 - DNA, 25 bp, Mus musculus
tgtccatgagaagaggaagcttctt

SEQ ID NO: 983023 - DNA, 25 bp, Mus musculus
tgtccatgcagtatgctgcctggct

SEQ ID NO: 983024 - DNA, 25 bp, Mus musculus
tgtccatgcagtcccccagcctgca

SEQ ID NO: 983025 - DNA, 25 bp, Mus musculus
tgtccatgcagtgccccagcctgca

SEQ ID NO: 983026 - DNA, 25 bp, Mus musculus
tgtccatgcagtttgctgcctggct

SEQ ID NO: 983027 - DNA, 25 bp, Mus musculus
tgtcccaccaagaccagggtgacat

SEQ ID NO: 983028 - DNA, 25 bp, Mus musculus
tgtcccaccaagtccagggtgacat

SEQ ID NO: 983029 - DNA, 25 bp, Mus musculus
tgtcccagacagcgcccatcagtct

SEQ ID NO: 983030 - DNA, 25 bp, Mus musculus
tgtcccagacagggcccatcagtct

SEQ ID NO: 983031 - DNA, 25 bp, Mus musculus
tgtcccatgaagcaaggaaatcctt

SEQ ID NO: 983032 - DNA, 25 bp, Mus musculus
tgtcccatgaaggaaggaaatcctt

SEQ ID NO: 983033 - DNA, 25 bp, Mus musculus
tgtcccatgcatttgaaataagttg

SEQ ID NO: 983034 - DNA, 25 bp, Mus musculus
tgtcccatgcttttgaaataagttg

SEQ ID NO: 983035 - DNA, 25 bp, Mus musculus
tgtccccaagagctacttttctcac

SEQ ID NO: 983036 - DNA, 25 bp, Mus musculus
tgtccccaagaggtacttttctcac

SEQ ID NO: 983037 - DNA, 25 bp, Mus musculus
tgtccccaagcgcataaagaagcca

SEQ ID NO: 983038 - DNA, 25 bp, Mus musculus
tgtccccaagctctgcatcctgatc

SEQ ID NO: 983039 - DNA, 25 bp, Mus musculus
tgtccccaagggcataaagaagcca

SEQ ID NO: 983040 - DNA, 25 bp, Mus musculus
tgtccccaaggtctgcatcctgatc

SEQ ID NO: 983041 - DNA, 25 bp, Mus musculus
tgtccccacctccacggtgaagttg

SEQ ID NO: 983042 - DNA, 25 bp, Mus musculus
tgtccccacctccagggtgaagttg

SEQ ID NO: 983043 - DNA, 25 bp, Mus musculus
tgtccccagagacacggcactgctg

SEQ ID NO: 983044 - DNA, 25 bp, Mus musculus
tgtccccagagacagggcactgctg

SEQ ID NO: 983045 - DNA, 25 bp, Mus musculus
tgtccccagtctcacatggaagaga

SEQ ID NO: 983046 - DNA, 25 bp, Mus musculus
tgtccccagtctcagatggaagaga

SEQ ID NO: 983047 - DNA, 25 bp, Mus musculus
tgtcccccagccgagtttgtctttg

SEQ ID NO: 983048 - DNA, 25 bp, Mus musculus
tgtcccccaggcgagtttgtctttg

SEQ ID NO: 983049 - DNA, 25 bp, Mus musculus
tgtcccctgccccacacaacattct

SEQ ID NO: 983050 - DNA, 25 bp, Mus musculus
tgtcccctgccccagacaacattct

SEQ ID NO: 983051 - DNA, 25 bp, Mus musculus
tgtcccctgggactgcttacttttc

SEQ ID NO: 983052 - DNA, 25 bp, Mus musculus
tgtcccctgggagtgcttacttttc

SEQ ID NO: 983053 - DNA, 25 bp, Mus musculus
tgtccctcaaaggcacgctcctgtc

SEQ ID NO: 983054 - DNA, 25 bp, Mus musculus
tgtccctcaaattcgaggactccac

SEQ ID NO: 983055 - DNA, 25 bp, Mus musculus
tgtccctcaacttgcctgcaggagg

SEQ ID NO: 983056 - DNA, 25 bp, Mus musculus
tgtccctcaagttgcctgcaggagg

SEQ ID NO: 983057 - DNA, 25 bp, Mus musculus
tgtccctcaatgcaaaaaggccaga

SEQ ID NO: 983058 - DNA, 25 bp, Mus musculus
tgtccctcaatggaaaaaggccaga

SEQ ID NO: 983059 - DNA, 25 bp, Mus musculus
tgtccctcaatggcacgctcctgtc

SEQ ID NO: 983060 - DNA, 25 bp, Mus musculus
tgtccctcaatttcgaggactccac

SEQ ID NO: 983061 - DNA, 25 bp, Mus musculus
tgtccctcagacgagccccgttgag

SEQ ID NO: 983062 - DNA, 25 bp, Mus musculus
tgtccctcagctacatttgtcaagg

SEQ ID NO: 983063 - DNA, 25 bp, Mus musculus
tgtccctcagctggccccttctgcc

SEQ ID NO: 983064 - DNA, 25 bp, Mus musculus
tgtccctcaggtacatttgtcaagg

SEQ ID NO: 983065 - DNA, 25 bp, Mus musculus
tgtccctcaggtggccccttctgcc

SEQ ID NO: 983066 - DNA, 25 bp, Mus musculus
tgtccctcagtcgagccccgttgag

SEQ ID NO: 983067 - DNA, 25 bp, Mus musculus
tgtccctccccaccaatctactctc

SEQ ID NO: 983068 - DNA, 25 bp, Mus musculus
tgtccctccccacgaacattgacca

SEQ ID NO: 983069 - DNA, 25 bp, Mus musculus
tgtccctccccagcaatctactctc

SEQ ID NO: 983070 - DNA, 25 bp, Mus musculus
tgtccctccccaggaacattgacca

SEQ ID NO: 983071 - DNA, 25 bp, Mus musculus
tgtccctctatgccaaaaggccaga

SEQ ID NO: 983072 - DNA, 25 bp, Mus musculus
tgtccctctatggcaaaaggccaga

SEQ ID NO: 983073 - DNA, 25 bp, Mus musculus
tgtccctgcatgcggcgctttggga

SEQ ID NO: 983074 - DNA, 25 bp, Mus musculus
tgtccctgcatggggcgctttggga

SEQ ID NO: 983075 - DNA, 25 bp, Mus musculus
tgtccgacagcacgaggtgttcatg

SEQ ID NO: 983076 - DNA, 25 bp, Mus musculus
tgtccgacagcaggaggtgttcatg

SEQ ID NO: 983077 - DNA, 25 bp, Mus musculus
tgtccgacgctgacatggactgggc

SEQ ID NO: 983078 - DNA, 25 bp, Mus musculus
tgtccgacgctgacttggactgggc

SEQ ID NO: 983079 - DNA, 25 bp, Mus musculus
tgtccgagagaacacacagctggta

SEQ ID NO: 983080 - DNA, 25 bp, Mus musculus
tgtccgagagaacaccaccaaggcc

SEQ ID NO: 983081 - DNA, 25 bp, Mus musculus
tgtccgagagaacgtgggtgacatc

SEQ ID NO: 983082 - DNA, 25 bp, Mus musculus
tgtccgagagaagacacagctggta

SEQ ID NO: 983083 - DNA, 25 bp, Mus musculus
tgtccgagagaagaccaccaaggcc

SEQ ID NO: 983084 - DNA, 25 bp, Mus musculus
tgtccgagagaaggtgggtgacatc

SEQ ID NO: 983085 - DNA, 25 bp, Mus musculus
tgtccgagccagcacgagggatctg

SEQ ID NO: 983086 - DNA, 25 bp, Mus musculus
tgtccgagccaggacgagggatctg

SEQ ID NO: 983087 - DNA, 25 bp, Mus musculus
tgtccgagctctccactcccacctc

SEQ ID NO: 983088 - DNA, 25 bp, Mus musculus
tgtccgagctgtccactcccacctc

SEQ ID NO: 983089 - DNA, 25 bp, Mus musculus
tgtccgcaggcgcctcaaagacttg

SEQ ID NO: 983090 - DNA, 25 bp, Mus musculus
tgtccgcaggcggctcaaagacttg

SEQ ID NO: 983091 - DNA, 25 bp, Mus musculus
tgtccgcgcgcgcggagctgccatt

SEQ ID NO: 983092 - DNA, 25 bp, Mus musculus
tgtccgcgcgcggggagctgccatt

SEQ ID NO: 983093 - DNA, 25 bp, Mus musculus
tgtccgctttcacgaggacattatt

SEQ ID NO: 983094 - DNA, 25 bp, Mus musculus
tgtccgctttcaggaggacattatt

SEQ ID NO: 983095 - DNA, 25 bp, Mus musculus
tgtccgtgagagaagaggaagtatc

SEQ ID NO: 983096 - DNA, 25 bp, Mus musculus
tgtccgtgagtgaagaggaagtatc

SEQ ID NO: 983097 - DNA, 25 bp, Mus musculus
tgtcctaagaaaccatcaagaagcg

SEQ ID NO: 983098 - DNA, 25 bp, Mus musculus
tgtcctaagaaacgcaggctccagc

SEQ ID NO: 983099 - DNA, 25 bp, Mus musculus
tgtcctaagaaagcatcaagaagcg

SEQ ID NO: 983100 - DNA, 25 bp, Mus musculus
tgtcctaagaaaggcaggctccagc

SEQ ID NO: 983101 - DNA, 25 bp, Mus musculus
tgtcctacacaacaccattctggtt

SEQ ID NO: 983102 - DNA, 25 bp, Mus musculus
tgtcctacacaagaccattctggtt

SEQ ID NO: 983103 - DNA, 25 bp, Mus musculus
tgtcctcaacaacctgactgtattc

SEQ ID NO: 983104 - DNA, 25 bp, Mus musculus
tgtcctcaacaagctgactgtattc

SEQ ID NO: 983105 - DNA, 25 bp, Mus musculus
tgtcctcagggactgcctgcacttc

SEQ ID NO: 983106 - DNA, 25 bp, Mus musculus
tgtcctcagggagtgcctgcacttc

SEQ ID NO: 983107 - DNA, 25 bp, Mus musculus
tgtcctcatcagcggggaaagcgga

SEQ ID NO: 983108 - DNA, 25 bp, Mus musculus
tgtcctcatcaggggggaaagcgga

SEQ ID NO: 983109 - DNA, 25 bp, Mus musculus
tgtcctcctgcccaatatgtgaaac

SEQ ID NO: 983110 - DNA, 25 bp, Mus musculus
tgtcctcctggccaatatgtgaaac

SEQ ID NO: 983111 - DNA, 25 bp, Mus musculus
tgtcctcgagagacccagccattcg

SEQ ID NO: 983112 - DNA, 25 bp, Mus musculus
tgtcctcgagatttactacagagac

SEQ ID NO: 983113 - DNA, 25 bp, Mus musculus
tgtcctcgagtgacccagccattcg

SEQ ID NO: 983114 - DNA, 25 bp, Mus musculus
tgtcctcgagttttactacagagac

SEQ ID NO: 983115 - DNA, 25 bp, Mus musculus
tgtcctctcaagcctcaaactcaga

SEQ ID NO: 983116 - DNA, 25 bp, Mus musculus
tgtcctctcaaggctcaaactcaga

SEQ ID NO: 983117 - DNA, 25 bp, Mus musculus
tgtcctctttcatacgcggaaccct

SEQ ID NO: 983118 - DNA, 25 bp, Mus musculus
tgtcctctttcatacggattttgat

SEQ ID NO: 983119 - DNA, 25 bp, Mus musculus
tgtcctctttcataggcggaaccct

SEQ ID NO: 983120 - DNA, 25 bp, Mus musculus
tgtcctctttcatagggattttgat

SEQ ID NO: 983121 - DNA, 25 bp, Mus musculus
tgtcctgaagaacgtggccgagatc

SEQ ID NO: 983122 - DNA, 25 bp, Mus musculus
tgtcctgaagaaggtggccgagatc

SEQ ID NO: 983123 - DNA, 25 bp, Mus musculus
tgtcctgaagattcccctcgtgtca

SEQ ID NO: 983124 - DNA, 25 bp, Mus musculus
tgtcctgaagtttcccctcgtgtca

SEQ ID NO: 983125 - DNA, 25 bp, Mus musculus
tgtcctgagcagctgaaactggttc

SEQ ID NO: 983126 - DNA, 25 bp, Mus musculus
tgtcctgagcaggtgaaactggttc

SEQ ID NO: 983127 - DNA, 25 bp, Mus musculus
tgtcctgcatctctttggagagtac

SEQ ID NO: 983128 - DNA, 25 bp, Mus musculus
tgtcctgcatctgtttggagagtac

SEQ ID NO: 983129 - DNA, 25 bp, Mus musculus
tgtcctgcctgccacaacatgctgt

SEQ ID NO: 983130 - DNA, 25 bp, Mus musculus
tgtcctgcctgccagaacatgctgt

SEQ ID NO: 983131 - DNA, 25 bp, Mus musculus
tgtcctgctgagccgagtaacaaga

SEQ ID NO: 983132 - DNA, 25 bp, Mus musculus
tgtcctgctgaggcgagtaacaaga

SEQ ID NO: 983133 - DNA, 25 bp, Mus musculus
tgtcctgtgaagacatcaacgaatg

SEQ ID NO: 983134 - DNA, 25 bp, Mus musculus
tgtcctgtgaagacatcaatgagtg

SEQ ID NO: 983135 - DNA, 25 bp, Mus musculus
tgtcctgtgaagaccaagacgagtg

SEQ ID NO: 983136 - DNA, 25 bp, Mus musculus
tgtcctgtgaagtcatcaacgaatg

SEQ ID NO: 983137 - DNA, 25 bp, Mus musculus
tgtcctgtgaagtcatcaatgagtg

SEQ ID NO: 983138 - DNA, 25 bp, Mus musculus
tgtcctgtgaagtccaagacgagtg

SEQ ID NO: 983139 - DNA, 25 bp, Mus musculus
tgtccttcactcaagcccatccagt

SEQ ID NO: 983140 - DNA, 25 bp, Mus musculus
tgtccttcactctagcccatccagt

SEQ ID NO: 983141 - DNA, 25 bp, Mus musculus
tgtccttgctgttcagtttgtgaag

SEQ ID NO: 983142 - DNA, 25 bp, Mus musculus
tgtccttgctgttctgtttgtgaag

SEQ ID NO: 983143 - DNA, 25 bp, Mus musculus
tgtcgaacacagagacagatctgca

SEQ ID NO: 983144 - DNA, 25 bp, Mus musculus
tgtcgaacacagtgacagatctgca

SEQ ID NO: 983145 - DNA, 25 bp, Mus musculus
tgtcgaagaaagatactgcagctaa

SEQ ID NO: 983146 - DNA, 25 bp, Mus musculus
tgtcgaagaaagttactgcagctaa

SEQ ID NO: 983147 - DNA, 25 bp, Mus musculus
tgtcgaaggagacgaagagatgaga

SEQ ID NO: 983148 - DNA, 25 bp, Mus musculus
tgtcgaaggagaggaagagatgaga

SEQ ID NO: 983149 - DNA, 25 bp, Mus musculus
tgtcgaagggctatggatttgtctc

SEQ ID NO: 983150 - DNA, 25 bp, Mus musculus
tgtcgaaggggtatggatttgtctc

SEQ ID NO: 983151 - DNA, 25 bp, Mus musculus
tgtcgactctgactggtttggattt

SEQ ID NO: 983152 - DNA, 25 bp, Mus musculus
tgtcgactctgagtggtttggattt

SEQ ID NO: 983153 - DNA, 25 bp, Mus musculus
tgtcgagaacatgaagatcttgcgt

SEQ ID NO: 983154 - DNA, 25 bp, Mus musculus
tgtcgagaacatgatgatcttgcgt

SEQ ID NO: 983155 - DNA, 25 bp, Mus musculus
tgtcgatatgcaaaggcgccgatgc

SEQ ID NO: 983156 - DNA, 25 bp, Mus musculus
tgtcgatatggaaaggcgccgatgc

SEQ ID NO: 983157 - DNA, 25 bp, Mus musculus
tgtcgatgggccaactgtaaccagc

SEQ ID NO: 983158 - DNA, 25 bp, Mus musculus
tgtcgatgggccaagtgtaaccagc

SEQ ID NO: 983159 - DNA, 25 bp, Mus musculus
tgtcgattatcacgctttgaaccag

SEQ ID NO: 983160 - DNA, 25 bp, Mus musculus
tgtcgattatcaggctttgaaccag

SEQ ID NO: 983161 - DNA, 25 bp, Mus musculus
tgtcgcatccatctcattgaccaca

SEQ ID NO: 983162 - DNA, 25 bp, Mus musculus
tgtcgcatccatgtcattgaccaca

SEQ ID NO: 983163 - DNA, 25 bp, Mus musculus
tgtcgccatgcttatcaccaggact

SEQ ID NO: 983164 - DNA, 25 bp, Mus musculus
tgtcgccatggttatcaccaggact

SEQ ID NO: 983165 - DNA, 25 bp, Mus musculus
tgtcgcccagctgaagatcatgacg

SEQ ID NO: 983166 - DNA, 25 bp, Mus musculus
tgtcgcccaggtgaagatcatgacg

SEQ ID NO: 983167 - DNA, 25 bp, Mus musculus
tgtcgccctccagacgtgcctggag

SEQ ID NO: 983168 - DNA, 25 bp, Mus musculus
tgtcgccctccagaggtgcctggag

SEQ ID NO: 983169 - DNA, 25 bp, Mus musculus
tgtcgccttccttcaggagaatatt

SEQ ID NO: 983170 - DNA, 25 bp, Mus musculus
tgtcgccttccttctggagaatatt

SEQ ID NO: 983171 - DNA, 25 bp, Mus musculus
tgtcggaaagaaatgtcccaggtgg

SEQ ID NO: 983172 - DNA, 25 bp, Mus musculus
tgtcggaaagtaatgtcccaggtgg

SEQ ID NO: 983173 - DNA, 25 bp, Mus musculus
tgtcggaccataccggcctgcaatc

SEQ ID NO: 983174 - DNA, 25 bp, Mus musculus
tgtcggaccatagcggcctgcaatc

SEQ ID NO: 983175 - DNA, 25 bp, Mus musculus
tgtcggaggccacttctggtccgca

SEQ ID NO: 983176 - DNA, 25 bp, Mus musculus
tgtcggaggccagttctggtccgca

SEQ ID NO: 983177 - DNA, 25 bp, Mus musculus
tgtcggcaagctagtcgatagcgac

SEQ ID NO: 983178 - DNA, 25 bp, Mus musculus
tgtcggcaaggtagtcgatagcgac

SEQ ID NO: 983179 - DNA, 25 bp, Mus musculus
tgtcggctgagacgcaggctgtcaa

SEQ ID NO: 983180 - DNA, 25 bp, Mus musculus
tgtcggctgagaggcaggctgtcaa

SEQ ID NO: 983181 - DNA, 25 bp, Mus musculus
tgtcggcttccttaagacagatggg

SEQ ID NO: 983182 - DNA, 25 bp, Mus musculus
tgtcggcttccttatgacagatggg

SEQ ID NO: 983183 - DNA, 25 bp, Mus musculus
tgtcgggcagaactgtgtctgtatg

SEQ ID NO: 983184 - DNA, 25 bp, Mus musculus
tgtcgggcagccagccattcatgca

SEQ ID NO: 983185 - DNA, 25 bp, Mus musculus
tgtcgggcaggcagccattcatgca

SEQ ID NO: 983186 - DNA, 25 bp, Mus musculus
tgtcgggcagtactgtgtctgtatg

SEQ ID NO: 983187 - DNA, 25 bp, Mus musculus
tgtcggtcacatcgaaagagcaacc

SEQ ID NO: 983188 - DNA, 25 bp, Mus musculus
tgtcggtcacatggaaagagcaacc

SEQ ID NO: 983189 - DNA, 25 bp, Mus musculus
tgtcgtcaagcctattgtggtaact

SEQ ID NO: 983190 - DNA, 25 bp, Mus musculus
tgtcgtcaaggctattgtggtaact

SEQ ID NO: 983191 - DNA, 25 bp, Mus musculus
tgtcgtcattgaaacttgccgagac

SEQ ID NO: 983192 - DNA, 25 bp, Mus musculus
tgtcgtcattgatacttgccgagac

SEQ ID NO: 983193 - DNA, 25 bp, Mus musculus
tgtcgtccagtatacggagaagctg

SEQ ID NO: 983194 - DNA, 25 bp, Mus musculus
tgtcgtccagtatagggagaagctg

SEQ ID NO: 983195 - DNA, 25 bp, Mus musculus
tgtcgtcgtcagcttgacaaaagta

SEQ ID NO: 983196 - DNA, 25 bp, Mus musculus
tgtcgtcgtcaggttgacaaaagta

SEQ ID NO: 983197 - DNA, 25 bp, Mus musculus
tgtcgtctgtcctgagtgaaactgg

SEQ ID NO: 983198 - DNA, 25 bp, Mus musculus
tgtcgtctgtcctgtgtgaaactgg

SEQ ID NO: 983199 - DNA, 25 bp, Mus musculus
tgtcgtgatcaacaataagacctgg

SEQ ID NO: 983200 - DNA, 25 bp, Mus musculus
tgtcgtgatcaagaataagacctgg

SEQ ID NO: 983201 - DNA, 25 bp, Mus musculus
tgtcgtggagatgagacagatagag

SEQ ID NO: 983202 - DNA, 25 bp, Mus musculus
tgtcgtggagttgagacagatagag

SEQ ID NO: 983203 - DNA, 25 bp, Mus musculus
tgtctaaaaaccacttctgaaactg

SEQ ID NO: 983204 - DNA, 25 bp, Mus musculus
tgtctaaaaacctcttctgaaactg

SEQ ID NO: 983205 - DNA, 25 bp, Mus musculus
tgtctacaagcacaagcgctgtatc

SEQ ID NO: 983206 - DNA, 25 bp, Mus musculus
tgtctacaagcatggccgggccgat

SEQ ID NO: 983207 - DNA, 25 bp, Mus musculus
tgtctacaaggacaagcgctgtatc

SEQ ID NO: 983208 - DNA, 25 bp, Mus musculus
tgtctacaaggatggccgggccgat

SEQ ID NO: 983209 - DNA, 25 bp, Mus musculus
tgtctaccagatcgtaccgggctcc

SEQ ID NO: 983210 - DNA, 25 bp, Mus musculus
tgtctaccagatggtaccgggctcc

SEQ ID NO: 983211 - DNA, 25 bp, Mus musculus
tgtctaccccagctggcagccttgg

SEQ ID NO: 983212 - DNA, 25 bp, Mus musculus
tgtctaccccaggtggcagccttgg

SEQ ID NO: 983213 - DNA, 25 bp, Mus musculus
tgtctacgagaccctgaagaatcgc

SEQ ID NO: 983214 - DNA, 25 bp, Mus musculus
tgtctacgagctcatcaaccagggg

SEQ ID NO: 983215 - DNA, 25 bp, Mus musculus
tgtctacgaggtcatcaaccagggg

SEQ ID NO: 983216 - DNA, 25 bp, Mus musculus
tgtctacgagtccctgaagaatcgc

SEQ ID NO: 983217 - DNA, 25 bp, Mus musculus
tgtctactgcaacggaccttctatg

SEQ ID NO: 983218 - DNA, 25 bp, Mus musculus
tgtctactgcaagggaccttctatg

SEQ ID NO: 983219 - DNA, 25 bp, Mus musculus
tgtctagaagctctaggaatgattc

SEQ ID NO: 983220 - DNA, 25 bp, Mus musculus
tgtctagaaggtctaggaatgattc

SEQ ID NO: 983221 - DNA, 25 bp, Mus musculus
tgtctagttcagcccagctgctgct

SEQ ID NO: 983222 - DNA, 25 bp, Mus musculus
tgtctagttcaggccagctgctgct

SEQ ID NO: 983223 - DNA, 25 bp, Mus musculus
tgtctataccagaacggcttcctac

SEQ ID NO: 983224 - DNA, 25 bp, Mus musculus
tgtctataccagaagggcttcctac

SEQ ID NO: 983225 - DNA, 25 bp, Mus musculus
tgtctatgacttccccggttttctc

SEQ ID NO: 983226 - DNA, 25 bp, Mus musculus
tgtctatgacttgcccggttttctc

SEQ ID NO: 983227 - DNA, 25 bp, Mus musculus
tgtctatgagattctgatgtctggt

SEQ ID NO: 983228 - DNA, 25 bp, Mus musculus
tgtctatgagtttctgatgtctggt

SEQ ID NO: 983229 - DNA, 25 bp, Mus musculus
tgtctatgcattcgcgactgtgtgg

SEQ ID NO: 983230 - DNA, 25 bp, Mus musculus
tgtctatgcattcgggactgtgtgg

SEQ ID NO: 983231 - DNA, 25 bp, Mus musculus
tgtctatggctccacatgggaatgg

SEQ ID NO: 983232 - DNA, 25 bp, Mus musculus
tgtctatggctccagatgggaatgg

SEQ ID NO: 983233 - DNA, 25 bp, Mus musculus
tgtctatttgcagtgtctaaaacct

SEQ ID NO: 983234 - DNA, 25 bp, Mus musculus
tgtctatttggagtgtctaaaacct

SEQ ID NO: 983235 - DNA, 25 bp, Mus musculus
tgtctcaacaaaagggctctactac

SEQ ID NO: 983236 - DNA, 25 bp, Mus musculus
tgtctcaacaaatgggctctactac

SEQ ID NO: 983237 - DNA, 25 bp, Mus musculus
tgtctcaaccctcgactcttctgtc

SEQ ID NO: 983238 - DNA, 25 bp, Mus musculus
tgtctcaaccctcgtctcttctgtc

SEQ ID NO: 983239 - DNA, 25 bp, Mus musculus
tgtctcaacctgcataccatggcct

SEQ ID NO: 983240 - DNA, 25 bp, Mus musculus
tgtctcaacctggataccatggcct

SEQ ID NO: 983241 - DNA, 25 bp, Mus musculus
tgtctcaagagaagattctcagcga

SEQ ID NO: 983242 - DNA, 25 bp, Mus musculus
tgtctcaagagatgattctcagcga

SEQ ID NO: 983243 - DNA, 25 bp, Mus musculus
tgtctcaattctaatattgtcccca

SEQ ID NO: 983244 - DNA, 25 bp, Mus musculus
tgtctcaattcttatattgtcccca

SEQ ID NO: 983245 - DNA, 25 bp, Mus musculus
tgtctcacagacaagctctctttgg

SEQ ID NO: 983246 - DNA, 25 bp, Mus musculus
tgtctcacagtcaagctctctttgg

SEQ ID NO: 983247 - DNA, 25 bp, Mus musculus
tgtctcacccagcatgagtttcatc

SEQ ID NO: 983248 - DNA, 25 bp, Mus musculus
tgtctcacccaggacatcttcagaa

SEQ ID NO: 983249 - DNA, 25 bp, Mus musculus
tgtctcacccaggacatggagttcc

SEQ ID NO: 983250 - DNA, 25 bp, Mus musculus
tgtctcacccaggagatcttcagaa

SEQ ID NO: 983251 - DNA, 25 bp, Mus musculus
tgtctcacccaggagatggagttcc

SEQ ID NO: 983252 - DNA, 25 bp, Mus musculus
tgtctcacccaggatgagtttcatc

SEQ ID NO: 983253 - DNA, 25 bp, Mus musculus
tgtctcagaaaccaagtgcgagcgc

SEQ ID NO: 983254 - DNA, 25 bp, Mus musculus
tgtctcagaaacgaagtgcgagcgc

SEQ ID NO: 983255 - DNA, 25 bp, Mus musculus
tgtctcatcaaattcgacaagacag

SEQ ID NO: 983256 - DNA, 25 bp, Mus musculus
tgtctcatcaaattggacaagacag

SEQ ID NO: 983257 - DNA, 25 bp, Mus musculus
tgtctcatttggatcgcaccacccc

SEQ ID NO: 983258 - DNA, 25 bp, Mus musculus
tgtctcatttggatggcaccacccc

SEQ ID NO: 983259 - DNA, 25 bp, Mus musculus
tgtctccaaacctcagaggccagag

SEQ ID NO: 983260 - DNA, 25 bp, Mus musculus
tgtctccaaacctctgaggccagag

SEQ ID NO: 983261 - DNA, 25 bp, Mus musculus
tgtctccatctgcaaaagttccttt

SEQ ID NO: 983262 - DNA, 25 bp, Mus musculus
tgtctccatctggaaaagttccttt

SEQ ID NO: 983263 - DNA, 25 bp, Mus musculus
tgtctcccagcctttgaagggccac

SEQ ID NO: 983264 - DNA, 25 bp, Mus musculus
tgtctcccaggctttgaagggccac

SEQ ID NO: 983265 - DNA, 25 bp, Mus musculus
tgtctccgtaagatcggaaatccac

SEQ ID NO: 983266 - DNA, 25 bp, Mus musculus
tgtctccgtaagatgggaaatccac

SEQ ID NO: 983267 - DNA, 25 bp, Mus musculus
tgtctcggtgaccttcccgtcgaat

SEQ ID NO: 983268 - DNA, 25 bp, Mus musculus
tgtctcggtgctcttcaaatgtcgt

SEQ ID NO: 983269 - DNA, 25 bp, Mus musculus
tgtctcggtggtcttcaaatgtcgt

SEQ ID NO: 983270 - DNA, 25 bp, Mus musculus
tgtctcggtgtccttcccgtcgaat

SEQ ID NO: 983271 - DNA, 25 bp, Mus musculus
tgtctctaaacaccttttagaacag

SEQ ID NO: 983272 - DNA, 25 bp, Mus musculus
tgtctctaaacagcttttagaacag

SEQ ID NO: 983273 - DNA, 25 bp, Mus musculus
tgtctctgaagactaccttgacctc

SEQ ID NO: 983274 - DNA, 25 bp, Mus musculus
tgtctctgaagagtaccttgacctc

SEQ ID NO: 983275 - DNA, 25 bp, Mus musculus
tgtctctgccatcgtgaactccctg

SEQ ID NO: 983276 - DNA, 25 bp, Mus musculus
tgtctctgccatggtgaactccctg

SEQ ID NO: 983277 - DNA, 25 bp, Mus musculus
tgtctctgtcctagtcttatctcct

SEQ ID NO: 983278 - DNA, 25 bp, Mus musculus
tgtctctgtcctattgcctttatca

SEQ ID NO: 983279 - DNA, 25 bp, Mus musculus
tgtctctgtccttgtcttatctcct

SEQ ID NO: 983280 - DNA, 25 bp, Mus musculus
tgtctctgtccttttgcctttatca

SEQ ID NO: 983281 - DNA, 25 bp, Mus musculus
tgtctgaaaacgatgatggagctgg

SEQ ID NO: 983282 - DNA, 25 bp, Mus musculus
tgtctgaaaacgttgatggagctgg

SEQ ID NO: 983283 - DNA, 25 bp, Mus musculus
tgtctgaagaggaggtgctgggccc

SEQ ID NO: 983284 - DNA, 25 bp, Mus musculus
tgtctgaagaggtggtgctgggccc

SEQ ID NO: 983285 - DNA, 25 bp, Mus musculus
tgtctgacctcatcctgacgggtaa

SEQ ID NO: 983286 - DNA, 25 bp, Mus musculus
tgtctgacctctcaaactgggctca

SEQ ID NO: 983287 - DNA, 25 bp, Mus musculus
tgtctgacctgatcctgacgggtaa

SEQ ID NO: 983288 - DNA, 25 bp, Mus musculus
tgtctgacctgtcaaactgggctca

SEQ ID NO: 983289 - DNA, 25 bp, Mus musculus
tgtctgactgtggacgcctttgtca

SEQ ID NO: 983290 - DNA, 25 bp, Mus musculus
tgtctgactgtggaggcctttgtca

SEQ ID NO: 983291 - DNA, 25 bp, Mus musculus
tgtctgacttcgctcagccatgtca

SEQ ID NO: 983292 - DNA, 25 bp, Mus musculus
tgtctgacttcggtcagccatgtca

SEQ ID NO: 983293 - DNA, 25 bp, Mus musculus
tgtctgagaccccgtacgtgtcaga

SEQ ID NO: 983294 - DNA, 25 bp, Mus musculus
tgtctgagacccggtacgtgtcaga

SEQ ID NO: 983295 - DNA, 25 bp, Mus musculus
tgtctgagaggaacccttctctgag

SEQ ID NO: 983296 - DNA, 25 bp, Mus musculus
tgtctgagaggaagttttatctgtg

SEQ ID NO: 983297 - DNA, 25 bp, Mus musculus
tgtctgagaggatcccttctctgag

SEQ ID NO: 983298 - DNA, 25 bp, Mus musculus
tgtctgagaggatgttttatctgtg

SEQ ID NO: 983299 - DNA, 25 bp, Mus musculus
tgtctgagcccctacagaacctgaa

SEQ ID NO: 983300 - DNA, 25 bp, Mus musculus
tgtctgagccgctacagaacctgaa

SEQ ID NO: 983301 - DNA, 25 bp, Mus musculus
tgtctgaggggaagagatgcaattc

SEQ ID NO: 983302 - DNA, 25 bp, Mus musculus
tgtctgaggggaagtgatgcaattc

SEQ ID NO: 983303 - DNA, 25 bp, Mus musculus
tgtctgagtctgaagaagacaaagg

SEQ ID NO: 983304 - DNA, 25 bp, Mus musculus
tgtctgagtctgtagaagacaaagg

SEQ ID NO: 983305 - DNA, 25 bp, Mus musculus
tgtctgataaataacagggcaatgc

SEQ ID NO: 983306 - DNA, 25 bp, Mus musculus
tgtctgataaataagagggcaatgc

SEQ ID NO: 983307 - DNA, 25 bp, Mus musculus
tgtctgcaagcttcacttgaggaaa

SEQ ID NO: 983308 - DNA, 25 bp, Mus musculus
tgtctgcaaggttcacttgaggaaa

SEQ ID NO: 983309 - DNA, 25 bp, Mus musculus
tgtctgcatgtgccctggccaggat

SEQ ID NO: 983310 - DNA, 25 bp, Mus musculus
tgtctgcatgtggcctggccaggat

SEQ ID NO: 983311 - DNA, 25 bp, Mus musculus
tgtctgccagagtgccccaggctat

SEQ ID NO: 983312 - DNA, 25 bp, Mus musculus
tgtctgccagtgtgccccaggctat

SEQ ID NO: 983313 - DNA, 25 bp, Mus musculus
tgtctgcgtctcgacacaagaccat

SEQ ID NO: 983314 - DNA, 25 bp, Mus musculus
tgtctgcgtctcgagacaagaccat

SEQ ID NO: 983315 - DNA, 25 bp, Mus musculus
tgtctgctggggaccttcttcacct

SEQ ID NO: 983316 - DNA, 25 bp, Mus musculus
tgtctgctggggacgttcttcacct

SEQ ID NO: 983317 - DNA, 25 bp, Mus musculus
tgtctggaagctcgctgtgctatgg

SEQ ID NO: 983318 - DNA, 25 bp, Mus musculus
tgtctggaaggtcgctgtgctatgg

SEQ ID NO: 983319 - DNA, 25 bp, Mus musculus
tgtctggaatcacacgccaactact

SEQ ID NO: 983320 - DNA, 25 bp, Mus musculus
tgtctggaatcacaggccaactact

SEQ ID NO: 983321 - DNA, 25 bp, Mus musculus
tgtctggacttgggcggacgtatgt

SEQ ID NO: 983322 - DNA, 25 bp, Mus musculus
tgtctggacttggggggacgtatgt

SEQ ID NO: 983323 - DNA, 25 bp, Mus musculus
tgtctggaggagctgccggggagcc

SEQ ID NO: 983324 - DNA, 25 bp, Mus musculus
tgtctggaggaggtgccggggagcc

SEQ ID NO: 983325 - DNA, 25 bp, Mus musculus
tgtctggcaaagacacagagcagat

SEQ ID NO: 983326 - DNA, 25 bp, Mus musculus
tgtctggcaaagtcacagagcagat

SEQ ID NO: 983327 - DNA, 25 bp, Mus musculus
tgtctggtaaccagagcggcggtgg

SEQ ID NO: 983328 - DNA, 25 bp, Mus musculus
tgtctggtaaccagtgcggcggtgg

SEQ ID NO: 983329 - DNA, 25 bp, Mus musculus
tgtctgtatgagaacaaagccagtc

SEQ ID NO: 983330 - DNA, 25 bp, Mus musculus
tgtctgtatgagaggctgagagggt

SEQ ID NO: 983331 - DNA, 25 bp, Mus musculus
tgtctgtatgagtacaaagccagtc

SEQ ID NO: 983332 - DNA, 25 bp, Mus musculus
tgtctgtatgagtggctgagagggt

SEQ ID NO: 983333 - DNA, 25 bp, Mus musculus
tgtctgtgactgcattggccgcaga

SEQ ID NO: 983334 - DNA, 25 bp, Mus musculus
tgtctgtgactgctttgtggacagt

SEQ ID NO: 983335 - DNA, 25 bp, Mus musculus
tgtctgtgactggattggccgcaga

SEQ ID NO: 983336 - DNA, 25 bp, Mus musculus
tgtctgtgactggtttgtggacagt

SEQ ID NO: 983337 - DNA, 25 bp, Mus musculus
tgtctgtgagctctgtcagcagcct

SEQ ID NO: 983338 - DNA, 25 bp, Mus musculus
tgtctgtgaggtctgtcagcagcct

SEQ ID NO: 983339 - DNA, 25 bp, Mus musculus
tgtctgtgctttcacctcagacagc

SEQ ID NO: 983340 - DNA, 25 bp, Mus musculus
tgtctgtgctttcagctcagacagc

SEQ ID NO: 983341 - DNA, 25 bp, Mus musculus
tgtctgtggcaacggcgattccagc

SEQ ID NO: 983342 - DNA, 25 bp, Mus musculus
tgtctgtggcaagggcgattccagc

SEQ ID NO: 983343 - DNA, 25 bp, Mus musculus
tgtctgttagaagaaatggagctgt

SEQ ID NO: 983344 - DNA, 25 bp, Mus musculus
tgtctgttagtagaaatggagctgt

SEQ ID NO: 983345 - DNA, 25 bp, Mus musculus
tgtcttcaagaaaaggatctccctc

SEQ ID NO: 983346 - DNA, 25 bp, Mus musculus
tgtcttcaagctgccgccatgctgc

SEQ ID NO: 983347 - DNA, 25 bp, Mus musculus
tgtcttcaaggtgccgccatgctgc

SEQ ID NO: 983348 - DNA, 25 bp, Mus musculus
tgtcttcaagtaaaggatctccctc

SEQ ID NO: 983349 - DNA, 25 bp, Mus musculus
tgtcttcagtcacgattttacagtt

SEQ ID NO: 983350 - DNA, 25 bp, Mus musculus
tgtcttcagtcaggattttacagtt

SEQ ID NO: 983351 - DNA, 25 bp, Mus musculus
tgtcttcattcgaaagaaggatcgg

SEQ ID NO: 983352 - DNA, 25 bp, Mus musculus
tgtcttcattcgaatgaaggatcgg

SEQ ID NO: 983353 - DNA, 25 bp, Mus musculus
tgtcttccagatcctgctccggaac

SEQ ID NO: 983354 - DNA, 25 bp, Mus musculus
tgtcttccagttcctgctccggaac

SEQ ID NO: 983355 - DNA, 25 bp, Mus musculus
tgtcttccatatcacccgcttacag

SEQ ID NO: 983356 - DNA, 25 bp, Mus musculus
tgtcttccatatcagccgcttacag

SEQ ID NO: 983357 - DNA, 25 bp, Mus musculus
tgtcttcgatgacacaactctcaat

SEQ ID NO: 983358 - DNA, 25 bp, Mus musculus
tgtcttcgatgagacaactctcaat

SEQ ID NO: 983359 - DNA, 25 bp, Mus musculus
tgtcttcgtcaacggcacactgaga

SEQ ID NO: 983360 - DNA, 25 bp, Mus musculus
tgtcttcgtcaagggcacactgaga

SEQ ID NO: 983361 - DNA, 25 bp, Mus musculus
tgtcttgaagaacacccagtgcatc

SEQ ID NO: 983362 - DNA, 25 bp, Mus musculus
tgtcttgaagtacacccagtgcatc

SEQ ID NO: 983363 - DNA, 25 bp, Mus musculus
tgtcttgcagctggaatgccatcca

SEQ ID NO: 983364 - DNA, 25 bp, Mus musculus
tgtcttgcaggacgcacgcatattc

SEQ ID NO: 983365 - DNA, 25 bp, Mus musculus
tgtcttgcaggaggcacgcatattc

SEQ ID NO: 983366 - DNA, 25 bp, Mus musculus
tgtcttgcaggtggaatgccatcca

SEQ ID NO: 983367 - DNA, 25 bp, Mus musculus
tgtcttggaagactgcacatccttt

SEQ ID NO: 983368 - DNA, 25 bp, Mus musculus
tgtcttggaagagtgcacatccttt

SEQ ID NO: 983369 - DNA, 25 bp, Mus musculus
tgtctttcttcacaacatctcccct

SEQ ID NO: 983370 - DNA, 25 bp, Mus musculus
tgtctttcttcacatcatctcccct

SEQ ID NO: 983371 - DNA, 25 bp, Mus musculus
tgtctttgacaacgatgggaatggc

SEQ ID NO: 983372 - DNA, 25 bp, Mus musculus
tgtctttgacaaggatgggaatggc

SEQ ID NO: 983373 - DNA, 25 bp, Mus musculus
tgtctttggagacctcaaagagaag

SEQ ID NO: 983374 - DNA, 25 bp, Mus musculus
tgtctttggagagctcaaagagaag

SEQ ID NO: 983375 - DNA, 25 bp, Mus musculus
tgtgaaaaacttcacaccccagtgc

SEQ ID NO: 983376 - DNA, 25 bp, Mus musculus
tgtgaaaaacttcagaccccagtgc

SEQ ID NO: 983377 - DNA, 25 bp, Mus musculus
tgtgaaaaagaattcaaacatagga

SEQ ID NO: 983378 - DNA, 25 bp, Mus musculus
tgtgaaaaagagccattttataagt

SEQ ID NO: 983379 - DNA, 25 bp, Mus musculus
tgtgaaaaagaggcattttataagt

SEQ ID NO: 983380 - DNA, 25 bp, Mus musculus
tgtgaaaaagtattcaaacatagga

SEQ ID NO: 983381 - DNA, 25 bp, Mus musculus
tgtgaaacagacaagcagatggggt

SEQ ID NO: 983382 - DNA, 25 bp, Mus musculus
tgtgaaacagcgaagcagctggccc

SEQ ID NO: 983383 - DNA, 25 bp, Mus musculus
tgtgaaacagggaagcagctggccc

SEQ ID NO: 983384 - DNA, 25 bp, Mus musculus
tgtgaaacagtcaagcagatggggt

SEQ ID NO: 983385 - DNA, 25 bp, Mus musculus
tgtgaaacccgacttcaatgctcgc

SEQ ID NO: 983386 - DNA, 25 bp, Mus musculus
tgtgaaacccgagttcaatgctcgc

SEQ ID NO: 983387 - DNA, 25 bp, Mus musculus
tgtgaaagaaaactgggtgcctgag

SEQ ID NO: 983388 - DNA, 25 bp, Mus musculus
tgtgaaagaaaagtgggtgcctgag

SEQ ID NO: 983389 - DNA, 25 bp, Mus musculus
tgtgaaattaaacggtacacttgat

SEQ ID NO: 983390 - DNA, 25 bp, Mus musculus
tgtgaaattaaagggtacacttgat

SEQ ID NO: 983391 - DNA, 25 bp, Mus musculus
tgtgaacactgacggctgcatggag

SEQ ID NO: 983392 - DNA, 25 bp, Mus musculus
tgtgaacactgagggctgcatggag

SEQ ID NO: 983393 - DNA, 25 bp, Mus musculus
tgtgaacagcagaacactagagaga

SEQ ID NO: 983394 - DNA, 25 bp, Mus musculus
tgtgaacagcagaagactagagaga

SEQ ID NO: 983395 - DNA, 25 bp, Mus musculus
tgtgaacaggcacacgctgggctcg

SEQ ID NO: 983396 - DNA, 25 bp, Mus musculus
tgtgaacagggacacgctgggctcg

SEQ ID NO: 983397 - DNA, 25 bp, Mus musculus
tgtgaagaaccacggccagtgcggg

SEQ ID NO: 983398 - DNA, 25 bp, Mus musculus
tgtgaagaaccagggccagtgcggg

SEQ ID NO: 983399 - DNA, 25 bp, Mus musculus
tgtgaagatccactacccaggtgtt

SEQ ID NO: 983400 - DNA, 25 bp, Mus musculus
tgtgaagatccagtacccaggtgtt

SEQ ID NO: 983401 - DNA, 25 bp, Mus musculus
tgtgaagatggacagcttccctatg

SEQ ID NO: 983402 - DNA, 25 bp, Mus musculus
tgtgaagatggagagcttccctatg

SEQ ID NO: 983403 - DNA, 25 bp, Mus musculus
tgtgaagcagaaatatctggaatac

SEQ ID NO: 983404 - DNA, 25 bp, Mus musculus
tgtgaagcagaattatctggaatac

SEQ ID NO: 983405 - DNA, 25 bp, Mus musculus
tgtgaagcagatgaagatcatccat

SEQ ID NO: 983406 - DNA, 25 bp, Mus musculus
tgtgaagcagatgatgatcatccat

SEQ ID NO: 983407 - DNA, 25 bp, Mus musculus
tgtgaagccacgatgtgggacctaa

SEQ ID NO: 983408 - DNA, 25 bp, Mus musculus
tgtgaagccacgcttgcctctccac

SEQ ID NO: 983409 - DNA, 25 bp, Mus musculus
tgtgaagccacggttgcctctccac

SEQ ID NO: 983410 - DNA, 25 bp, Mus musculus
tgtgaagccacgttgtgggacctaa

SEQ ID NO: 983411 - DNA, 25 bp, Mus musculus
tgtgaaggatgccaccccaaaccag

SEQ ID NO: 983412 - DNA, 25 bp, Mus musculus
tgtgaaggatgccacccctccaggg

SEQ ID NO: 983413 - DNA, 25 bp, Mus musculus
tgtgaaggatgccagcccaaaccag

SEQ ID NO: 983414 - DNA, 25 bp, Mus musculus
tgtgaaggatgccagccctccaggg

SEQ ID NO: 983415 - DNA, 25 bp, Mus musculus
tgtgaaggctgtaacggcttctttc

SEQ ID NO: 983416 - DNA, 25 bp, Mus musculus
tgtgaaggctgtaagggcttctttc

SEQ ID NO: 983417 - DNA, 25 bp, Mus musculus
tgtgaagtccaacctggaggcattc

SEQ ID NO: 983418 - DNA, 25 bp, Mus musculus
tgtgaagtccaagctggaggcattc

SEQ ID NO: 983419 - DNA, 25 bp, Mus musculus
tgtgaagtctcttattggtgcagca

SEQ ID NO: 983420 - DNA, 25 bp, Mus musculus
tgtgaagtctgttattggtgcagca

SEQ ID NO: 983421 - DNA, 25 bp, Mus musculus
tgtgaagtgcacccccagcgtgctt

SEQ ID NO: 983422 - DNA, 25 bp, Mus musculus
tgtgaagtgcacccccgtgcttccg

SEQ ID NO: 983423 - DNA, 25 bp, Mus musculus
tgtgaagtgcacccgcagcgtgctt

SEQ ID NO: 983424 - DNA, 25 bp, Mus musculus
tgtgaagtgcacccgcgtgcttccg

SEQ ID NO: 983425 - DNA, 25 bp, Mus musculus
tgtgaagtggagaagcacggccggg

SEQ ID NO: 983426 - DNA, 25 bp, Mus musculus
tgtgaagtggagtagcacggccggg

SEQ ID NO: 983427 - DNA, 25 bp, Mus musculus
tgtgaagttcaacctgtacgatcgg

SEQ ID NO: 983428 - DNA, 25 bp, Mus musculus
tgtgaagttcaagctgtacgatcgg

SEQ ID NO: 983429 - DNA, 25 bp, Mus musculus
tgtgaataaaagacagctgatcaca

SEQ ID NO: 983430 - DNA, 25 bp, Mus musculus
tgtgaataaaagtcagctgatcaca

SEQ ID NO: 983431 - DNA, 25 bp, Mus musculus
tgtgaatatgcaccactccacaagc

SEQ ID NO: 983432 - DNA, 25 bp, Mus musculus
tgtgaatatggaccactccacaagc

SEQ ID NO: 983433 - DNA, 25 bp, Mus musculus
tgtgaatcatagatgtgacccaaat

SEQ ID NO: 983434 - DNA, 25 bp, Mus musculus
tgtgaatcatagttgtgacccaaat

SEQ ID NO: 983435 - DNA, 25 bp, Mus musculus
tgtgaatgaaataatagctactctt

SEQ ID NO: 983436 - DNA, 25 bp, Mus musculus
tgtgaatgaattaatagctactctt

SEQ ID NO: 983437 - DNA, 25 bp, Mus musculus
tgtgacaaaagaattaaacaggatg

SEQ ID NO: 983438 - DNA, 25 bp, Mus musculus
tgtgacaaaagatttaaacaggatg

SEQ ID NO: 983439 - DNA, 25 bp, Mus musculus
tgtgacaattaacattgatcctgaa

SEQ ID NO: 983440 - DNA, 25 bp, Mus musculus
tgtgacaattaagattgatcctgaa

SEQ ID NO: 983441 - DNA, 25 bp, Mus musculus
tgtgacacctgggaagccatggaga

SEQ ID NO: 983442 - DNA, 25 bp, Mus musculus
tgtgacacctgggatgccatggaga

SEQ ID NO: 983443 - DNA, 25 bp, Mus musculus
tgtgacagagagggacttggtatgc

SEQ ID NO: 983444 - DNA, 25 bp, Mus musculus
tgtgacagagtgggacttggtatgc

SEQ ID NO: 983445 - DNA, 25 bp, Mus musculus
tgtgacagatcacgagtccttcaat

SEQ ID NO: 983446 - DNA, 25 bp, Mus musculus
tgtgacagatcaggagtccttcaat

SEQ ID NO: 983447 - DNA, 25 bp, Mus musculus
tgtgacatcacacctggtgaatgag

SEQ ID NO: 983448 - DNA, 25 bp, Mus musculus
tgtgacatcacagctggtgaatgag

SEQ ID NO: 983449 - DNA, 25 bp, Mus musculus
tgtgacatgaatctggattttgatg

SEQ ID NO: 983450 - DNA, 25 bp, Mus musculus
tgtgacatgaatgtggattttgatg

SEQ ID NO: 983451 - DNA, 25 bp, Mus musculus
tgtgacatggatcgctcccgtcatt

SEQ ID NO: 983452 - DNA, 25 bp, Mus musculus
tgtgacatggatggctcccgtcatt

SEQ ID NO: 983453 - DNA, 25 bp, Mus musculus
tgtgacattgagctgggctttgagg

SEQ ID NO: 983454 - DNA, 25 bp, Mus musculus
tgtgacattgtgctgggctttgagg

SEQ ID NO: 983455 - DNA, 25 bp, Mus musculus
tgtgaccatagacccgcaaacaggg

SEQ ID NO: 983456 - DNA, 25 bp, Mus musculus
tgtgaccatagagccgcaaacaggg

SEQ ID NO: 983457 - DNA, 25 bp, Mus musculus
tgtgaccatcagctactgcagggtt

SEQ ID NO: 983458 - DNA, 25 bp, Mus musculus
tgtgaccatcaggtactgcagggtt

SEQ ID NO: 983459 - DNA, 25 bp, Mus musculus
tgtgacccagagcagaggggcaggc

SEQ ID NO: 983460 - DNA, 25 bp, Mus musculus
tgtgacccagaggggcaggctgggt

SEQ ID NO: 983461 - DNA, 25 bp, Mus musculus
tgtgacccagtgcagaggggcaggc

SEQ ID NO: 983462 - DNA, 25 bp, Mus musculus
tgtgacccagtggggcaggctgggt

SEQ ID NO: 983463 - DNA, 25 bp, Mus musculus
tgtgaccgagatcaagatccacttc

SEQ ID NO: 983464 - DNA, 25 bp, Mus musculus
tgtgaccgagcttgaacatttcaag

SEQ ID NO: 983465 - DNA, 25 bp, Mus musculus
tgtgaccgaggttgaacatttcaag

SEQ ID NO: 983466 - DNA, 25 bp, Mus musculus
tgtgaccgagttcaagatccacttc

SEQ ID NO: 983467 - DNA, 25 bp, Mus musculus
tgtgacctgcttcgttcaactggag

SEQ ID NO: 983468 - DNA, 25 bp, Mus musculus
tgtgacctgcttggttcaactggag

SEQ ID NO: 983469 - DNA, 25 bp, Mus musculus
tgtgacgaggccaatgctgctgcta

SEQ ID NO: 983470 - DNA, 25 bp, Mus musculus
tgtgacgagggcaatgctgctgcta

SEQ ID NO: 983471 - DNA, 25 bp, Mus musculus
tgtgactgagatggccgccccatcc

SEQ ID NO: 983472 - DNA, 25 bp, Mus musculus
tgtgactgagttggccgccccatcc

SEQ ID NO: 983473 - DNA, 25 bp, Mus musculus
tgtgactgtagccccgacatcacct

SEQ ID NO: 983474 - DNA, 25 bp, Mus musculus
tgtgactgtagcccggacatcacct

SEQ ID NO: 983475 - DNA, 25 bp, Mus musculus
tgtgacttagaagaatttcagacct

SEQ ID NO: 983476 - DNA, 25 bp, Mus musculus
tgtgacttagaagattttcagacct

SEQ ID NO: 983477 - DNA, 25 bp, Mus musculus
tgtgacttagcccaggagttaaagt

SEQ ID NO: 983478 - DNA, 25 bp, Mus musculus
tgtgacttagctaggtgagcctgtg

SEQ ID NO: 983479 - DNA, 25 bp, Mus musculus
tgtgacttaggccaggagttaaagt

SEQ ID NO: 983480 - DNA, 25 bp, Mus musculus
tgtgacttaggtaggtgagcctgtg

SEQ ID NO: 983481 - DNA, 25 bp, Mus musculus
tgtgactttgcactttcaccaaacc

SEQ ID NO: 983482 - DNA, 25 bp, Mus musculus
tgtgactttgcagtttcaccaaacc

SEQ ID NO: 983483 - DNA, 25 bp, Mus musculus
tgtgagaaccgacaaatggcaaaat

SEQ ID NO: 983484 - DNA, 25 bp, Mus musculus
tgtgagaaccgagaaatggcaaaat

SEQ ID NO: 983485 - DNA, 25 bp, Mus musculus
tgtgagaacgacctcagtgggcagc

SEQ ID NO: 983486 - DNA, 25 bp, Mus musculus
tgtgagaacgtcctcagtgggcagc

SEQ ID NO: 983487 - DNA, 25 bp, Mus musculus
tgtgagaataagcatattgccaatt

SEQ ID NO: 983488 - DNA, 25 bp, Mus musculus
tgtgagaataaggatattgccaatt

SEQ ID NO: 983489 - DNA, 25 bp, Mus musculus
tgtgagacagacattgacgagtgct

SEQ ID NO: 983490 - DNA, 25 bp, Mus musculus
tgtgagacagactcttcctgagtca

SEQ ID NO: 983491 - DNA, 25 bp, Mus musculus
tgtgagacagtcattgacgagtgct

SEQ ID NO: 983492 - DNA, 25 bp, Mus musculus
tgtgagacagtctcttcctgagtca

SEQ ID NO: 983493 - DNA, 25 bp, Mus musculus
tgtgagaggcagcgcttgtcaatga

SEQ ID NO: 983494 - DNA, 25 bp, Mus musculus
tgtgagaggcagggcttgtcaatga

SEQ ID NO: 983495 - DNA, 25 bp, Mus musculus
tgtgagatccagctgcaggcagtag

SEQ ID NO: 983496 - DNA, 25 bp, Mus musculus
tgtgagatccaggtgcaggcagtag

SEQ ID NO: 983497 - DNA, 25 bp, Mus musculus
tgtgagatttttctggacagcacat

SEQ ID NO: 983498 - DNA, 25 bp, Mus musculus
tgtgagatttttgtggacagcacat

SEQ ID NO: 983499 - DNA, 25 bp, Mus musculus
tgtgagcatgagatggatatacaac

SEQ ID NO: 983500 - DNA, 25 bp, Mus musculus
tgtgagcatgagcttgtctattaca

SEQ ID NO: 983501 - DNA, 25 bp, Mus musculus
tgtgagcatgaggttgtctattaca

SEQ ID NO: 983502 - DNA, 25 bp, Mus musculus
tgtgagcatgagttggatatacaac

SEQ ID NO: 983503 - DNA, 25 bp, Mus musculus
tgtgagccacagactctacgagaga

SEQ ID NO: 983504 - DNA, 25 bp, Mus musculus
tgtgagccacagtctctacgagaga

SEQ ID NO: 983505 - DNA, 25 bp, Mus musculus
tgtgagccggagatctctgggctag

SEQ ID NO: 983506 - DNA, 25 bp, Mus musculus
tgtgagccggtgatctctgggctag

SEQ ID NO: 983507 - DNA, 25 bp, Mus musculus
tgtgagcctgattgtgggctgtcca

SEQ ID NO: 983508 - DNA, 25 bp, Mus musculus
tgtgagcctgccgctcatgctgtat

SEQ ID NO: 983509 - DNA, 25 bp, Mus musculus
tgtgagcctggcgctcatgctgtat

SEQ ID NO: 983510 - DNA, 25 bp, Mus musculus
tgtgagcctgtttgtgggctgtcca

SEQ ID NO: 983511 - DNA, 25 bp, Mus musculus
tgtgagcgactgcatcgtcaacgtg

SEQ ID NO: 983512 - DNA, 25 bp, Mus musculus
tgtgagcgactggatcgtcaacgtg

SEQ ID NO: 983513 - DNA, 25 bp, Mus musculus
tgtgagctcaagattctggattttg

SEQ ID NO: 983514 - DNA, 25 bp, Mus musculus
tgtgagctcaagtttctggattttg

SEQ ID NO: 983515 - DNA, 25 bp, Mus musculus
tgtgagctgaagatcctagactttg

SEQ ID NO: 983516 - DNA, 25 bp, Mus musculus
tgtgagctgaagttcctagactttg

SEQ ID NO: 983517 - DNA, 25 bp, Mus musculus
tgtgagctttgacgatttcatcaaa

SEQ ID NO: 983518 - DNA, 25 bp, Mus musculus
tgtgagctttgaggatttcatcaaa

SEQ ID NO: 983519 - DNA, 25 bp, Mus musculus
tgtgaggaaacacatgcaatacctg

SEQ ID NO: 983520 - DNA, 25 bp, Mus musculus
tgtgaggaaacagatgcaatacctg

SEQ ID NO: 983521 - DNA, 25 bp, Mus musculus
tgtgaggacaagagtgtggaaaatg

SEQ ID NO: 983522 - DNA, 25 bp, Mus musculus
tgtgaggacaagtgtgtggaaaatg

SEQ ID NO: 983523 - DNA, 25 bp, Mus musculus
tgtgaggaggtgctcgacttaccta

SEQ ID NO: 983524 - DNA, 25 bp, Mus musculus
tgtgaggaggtgctggacttaccta

SEQ ID NO: 983525 - DNA, 25 bp, Mus musculus
tgtgaggggggacacgtatatggaa

SEQ ID NO: 983526 - DNA, 25 bp, Mus musculus
tgtgaggggggacaggtatatggaa

SEQ ID NO: 983527 - DNA, 25 bp, Mus musculus
tgtgaggtacagctgtcggctctgt

SEQ ID NO: 983528 - DNA, 25 bp, Mus musculus
tgtgaggtacaggtgtcggctctgt

SEQ ID NO: 983529 - DNA, 25 bp, Mus musculus
tgtgagtcagaggggtcatgatttt

SEQ ID NO: 983530 - DNA, 25 bp, Mus musculus
tgtgagtcagtggggtcatgatttt

SEQ ID NO: 983531 - DNA, 25 bp, Mus musculus
tgtgagtctgagactcggacctata

SEQ ID NO: 983532 - DNA, 25 bp, Mus musculus
tgtgagtctgagtctcggacctata

SEQ ID NO: 983533 - DNA, 25 bp, Mus musculus
tgtgagtgaagaaagtttaggtcaa

SEQ ID NO: 983534 - DNA, 25 bp, Mus musculus
tgtgagtgaagaagatcgtaatact

SEQ ID NO: 983535 - DNA, 25 bp, Mus musculus
tgtgagtgaagatagtttaggtcaa

SEQ ID NO: 983536 - DNA, 25 bp, Mus musculus
tgtgagtgaagatgatcgtaatact

SEQ ID NO: 983537 - DNA, 25 bp, Mus musculus
tgtgagttcgactgtgatttaccgc

SEQ ID NO: 983538 - DNA, 25 bp, Mus musculus
tgtgagttcgtctgtgatttaccgc

SEQ ID NO: 983539 - DNA, 25 bp, Mus musculus
tgtgagttgtcacgtaaagatgagc

SEQ ID NO: 983540 - DNA, 25 bp, Mus musculus
tgtgagttgtcaggtaaagatgagc

SEQ ID NO: 983541 - DNA, 25 bp, Mus musculus
tgtgataaagaccagaatatggtgg

SEQ ID NO: 983542 - DNA, 25 bp, Mus musculus
tgtgataaagatcaggaaatggtgg

SEQ ID NO: 983543 - DNA, 25 bp, Mus musculus
tgtgataaagctgtccccaaggaat

SEQ ID NO: 983544 - DNA, 25 bp, Mus musculus
tgtgataaaggtgtccccaaggaat

SEQ ID NO: 983545 - DNA, 25 bp, Mus musculus
tgtgataaagtccagaatatggtgg

SEQ ID NO: 983546 - DNA, 25 bp, Mus musculus
tgtgataaagttcaggaaatggtgg

SEQ ID NO: 983547 - DNA, 25 bp, Mus musculus
tgtgataacagtcgccacccttctt

SEQ ID NO: 983548 - DNA, 25 bp, Mus musculus
tgtgataacagtggccacccttctt

SEQ ID NO: 983549 - DNA, 25 bp, Mus musculus
tgtgatatctcttaccaggaaagat

SEQ ID NO: 983550 - DNA, 25 bp, Mus musculus
tgtgatatctcttacgaaagatggt

SEQ ID NO: 983551 - DNA, 25 bp, Mus musculus
tgtgatatctcttagcaggaaagat

SEQ ID NO: 983552 - DNA, 25 bp, Mus musculus
tgtgatatctcttaggaaagatggt

SEQ ID NO: 983553 - DNA, 25 bp, Mus musculus
tgtgatccccggacaactggggcat

SEQ ID NO: 983554 - DNA, 25 bp, Mus musculus
tgtgatccccggtcaactggggcat

SEQ ID NO: 983555 - DNA, 25 bp, Mus musculus
tgtgatcccgaacatcaactcacca

SEQ ID NO: 983556 - DNA, 25 bp, Mus musculus
tgtgatcccgaagatcaactcacca

SEQ ID NO: 983557 - DNA, 25 bp, Mus musculus
tgtgatcctccaacttcagtatcag

SEQ ID NO: 983558 - DNA, 25 bp, Mus musculus
tgtgatcctccatcttcagtatcag

SEQ ID NO: 983559 - DNA, 25 bp, Mus musculus
tgtgatgccatgattaacaacaacc

SEQ ID NO: 983560 - DNA, 25 bp, Mus musculus
tgtgatgccatgtttaacaacaacc

SEQ ID NO: 983561 - DNA, 25 bp, Mus musculus
tgtgatgcttgccgaatgcagcccg

SEQ ID NO: 983562 - DNA, 25 bp, Mus musculus
tgtgatgcttgcctgcaatgctcac

SEQ ID NO: 983563 - DNA, 25 bp, Mus musculus
tgtgatgcttgcggaatgcagcccg

SEQ ID NO: 983564 - DNA, 25 bp, Mus musculus
tgtgatgcttgcgtgcaatgctcac

SEQ ID NO: 983565 - DNA, 25 bp, Mus musculus
tgtgatggcttgcacgggtcaagtc

SEQ ID NO: 983566 - DNA, 25 bp, Mus musculus
tgtgatggcttgcaggggtcaagtc

SEQ ID NO: 983567 - DNA, 25 bp, Mus musculus
tgtgatggtcagcaagcctgctgcg

SEQ ID NO: 983568 - DNA, 25 bp, Mus musculus
tgtgatggtcagctctgacggagtc

SEQ ID NO: 983569 - DNA, 25 bp, Mus musculus
tgtgatggtcaggaagcctgctgcg

SEQ ID NO: 983570 - DNA, 25 bp, Mus musculus
tgtgatggtcaggtctgacggagtc

SEQ ID NO: 983571 - DNA, 25 bp, Mus musculus
tgtgatgtctatttcgagtgtctaa

SEQ ID NO: 983572 - DNA, 25 bp, Mus musculus
tgtgatgtctatttggagtgtctaa

SEQ ID NO: 983573 - DNA, 25 bp, Mus musculus
tgtgattaagcctctggactatgaa

SEQ ID NO: 983574 - DNA, 25 bp, Mus musculus
tgtgattaaggctctggactatgaa

SEQ ID NO: 983575 - DNA, 25 bp, Mus musculus
tgtgattatgcatatggaacttgga

SEQ ID NO: 983576 - DNA, 25 bp, Mus musculus
tgtgattatggatatggaacttgga

SEQ ID NO: 983577 - DNA, 25 bp, Mus musculus
tgtgattctcaacctgggaagtcat

SEQ ID NO: 983578 - DNA, 25 bp, Mus musculus
tgtgattctcaagctgggaagtcat

SEQ ID NO: 983579 - DNA, 25 bp, Mus musculus
tgtgattgtcaacgatcagctgtaa

SEQ ID NO: 983580 - DNA, 25 bp, Mus musculus
tgtgattgtcaaggatcagctgtaa

SEQ ID NO: 983581 - DNA, 25 bp, Mus musculus
tgtgattgtcgacacgtgcgaccgc

SEQ ID NO: 983582 - DNA, 25 bp, Mus musculus
tgtgattgtcgagacgtgcgaccgc

SEQ ID NO: 983583 - DNA, 25 bp, Mus musculus
tgtgattttcagcaaaagtgcaaga

SEQ ID NO: 983584 - DNA, 25 bp, Mus musculus
tgtgattttcaggaaaagtgcaaga

SEQ ID NO: 983585 - DNA, 25 bp, Mus musculus
tgtgcaaagaatggcgtaaccatag

SEQ ID NO: 983586 - DNA, 25 bp, Mus musculus
tgtgcaaagaatggggtaaccatag

SEQ ID NO: 983587 - DNA, 25 bp, Mus musculus
tgtgcaaatgacccaggatgtacag

SEQ ID NO: 983588 - DNA, 25 bp, Mus musculus
tgtgcaaatgtcccaggatgtacag

SEQ ID NO: 983589 - DNA, 25 bp, Mus musculus
tgtgcaacagcaaaatcaaattgga

SEQ ID NO: 983590 - DNA, 25 bp, Mus musculus
tgtgcaacaggaaaatcaaattgga

SEQ ID NO: 983591 - DNA, 25 bp, Mus musculus
tgtgcaagaacgcctggtgcaagca

SEQ ID NO: 983592 - DNA, 25 bp, Mus musculus
tgtgcaagaacggctggtgcaagca

SEQ ID NO: 983593 - DNA, 25 bp, Mus musculus
tgtgcaagcaagactgaaatacagt

SEQ ID NO: 983594 - DNA, 25 bp, Mus musculus
tgtgcaagcaagtctgaaatacagt

SEQ ID NO: 983595 - DNA, 25 bp, Mus musculus
tgtgcaaggcagtacgcaaagagcc

SEQ ID NO: 983596 - DNA, 25 bp, Mus musculus
tgtgcaaggcagtaggcaaagagcc

SEQ ID NO: 983597 - DNA, 25 bp, Mus musculus
tgtgcacacaagtctgagagcaagg

SEQ ID NO: 983598 - DNA, 25 bp, Mus musculus
tgtgcacacatgtctgagagcaagg

SEQ ID NO: 983599 - DNA, 25 bp, Mus musculus
tgtgcacattcacatacggtggagc

SEQ ID NO: 983600 - DNA, 25 bp, Mus musculus
tgtgcacattcaccagatacggtgg

SEQ ID NO: 983601 - DNA, 25 bp, Mus musculus
tgtgcacattcacgagtgtgttcca

SEQ ID NO: 983602 - DNA, 25 bp, Mus musculus
tgtgcacattcagatacggtggagc

SEQ ID NO: 983603 - DNA, 25 bp, Mus musculus
tgtgcacattcagcagatacggtgg

SEQ ID NO: 983604 - DNA, 25 bp, Mus musculus
tgtgcacattcaggagtgtgttcca

SEQ ID NO: 983605 - DNA, 25 bp, Mus musculus
tgtgcacctcaaagtctaagaaatc

SEQ ID NO: 983606 - DNA, 25 bp, Mus musculus
tgtgcacctcaatgtctaagaaatc

SEQ ID NO: 983607 - DNA, 25 bp, Mus musculus
tgtgcaccttgtcgcttgcgctctg

SEQ ID NO: 983608 - DNA, 25 bp, Mus musculus
tgtgcaccttgtggcttgcgctctg

SEQ ID NO: 983609 - DNA, 25 bp, Mus musculus
tgtgcagaaagacctcagggactgc

SEQ ID NO: 983610 - DNA, 25 bp, Mus musculus
tgtgcagaaagacctcagggactgg

SEQ ID NO: 983611 - DNA, 25 bp, Mus musculus
tgtgcagaaagagctcagggactgc

SEQ ID NO: 983612 - DNA, 25 bp, Mus musculus
tgtgcagaaagagctcagggactgg

SEQ ID NO: 983613 - DNA, 25 bp, Mus musculus
tgtgcagaaattgaagagagagaag

SEQ ID NO: 983614 - DNA, 25 bp, Mus musculus
tgtgcagaaattgatgagagagaag

SEQ ID NO: 983615 - DNA, 25 bp, Mus musculus
tgtgcagaagattcaaggtacatca

SEQ ID NO: 983616 - DNA, 25 bp, Mus musculus
tgtgcagaagccaaggcctgcgacc

SEQ ID NO: 983617 - DNA, 25 bp, Mus musculus
tgtgcagaaggcaaggcctgcgacc

SEQ ID NO: 983618 - DNA, 25 bp, Mus musculus
tgtgcagaagtttcaaggtacatca

SEQ ID NO: 983619 - DNA, 25 bp, Mus musculus
tgtgcagacacacggcagatgtaat

SEQ ID NO: 983620 - DNA, 25 bp, Mus musculus
tgtgcagacacagggcagatgtaat

SEQ ID NO: 983621 - DNA, 25 bp, Mus musculus
tgtgcagagacacttgcactgttgt

SEQ ID NO: 983622 - DNA, 25 bp, Mus musculus
tgtgcagagacagttgcactgttgt

SEQ ID NO: 983623 - DNA, 25 bp, Mus musculus
tgtgcagagcagatctggtggccct

SEQ ID NO: 983624 - DNA, 25 bp, Mus musculus
tgtgcagagcagttctggtggccct

SEQ ID NO: 983625 - DNA, 25 bp, Mus musculus
tgtgcagcctgtaaccccagcacta

SEQ ID NO: 983626 - DNA, 25 bp, Mus musculus
tgtgcagcctgtaacttcttgcaga

SEQ ID NO: 983627 - DNA, 25 bp, Mus musculus
tgtgcagcctgtaagcccagcacta

SEQ ID NO: 983628 - DNA, 25 bp, Mus musculus
tgtgcagcctgtaagttcttgcaga

SEQ ID NO: 983629 - DNA, 25 bp, Mus musculus
tgtgcagcgcagcctgagctgctgt

SEQ ID NO: 983630 - DNA, 25 bp, Mus musculus
tgtgcagcgcaggctgagctgctgt

SEQ ID NO: 983631 - DNA, 25 bp, Mus musculus
tgtgcagctacgcacactactgcta

SEQ ID NO: 983632 - DNA, 25 bp, Mus musculus
tgtgcagctacggacactactgcta

SEQ ID NO: 983633 - DNA, 25 bp, Mus musculus
tgtgcagtagcggacggaggcaatg

SEQ ID NO: 983634 - DNA, 25 bp, Mus musculus
tgtgcagtaggggacggaggcaatg

SEQ ID NO: 983635 - DNA, 25 bp, Mus musculus
tgtgcagtcacacgtggataccctc

SEQ ID NO: 983636 - DNA, 25 bp, Mus musculus
tgtgcagtcacaggtggataccctc

SEQ ID NO: 983637 - DNA, 25 bp, Mus musculus
tgtgcagttcaaccctccggcctat

SEQ ID NO: 983638 - DNA, 25 bp, Mus musculus
tgtgcagttcaagcctccggcctat

SEQ ID NO: 983639 - DNA, 25 bp, Mus musculus
tgtgcatacccgtcggttgtaattg

SEQ ID NO: 983640 - DNA, 25 bp, Mus musculus
tgtgcataccggtcggttgtaattg

SEQ ID NO: 983641 - DNA, 25 bp, Mus musculus
tgtgcatcggagctcaccttcgtct

SEQ ID NO: 983642 - DNA, 25 bp, Mus musculus
tgtgcatcggaggtcaccttcgtct

SEQ ID NO: 983643 - DNA, 25 bp, Mus musculus
tgtgcatctccacgtcccacctgct

SEQ ID NO: 983644 - DNA, 25 bp, Mus musculus
tgtgcatctccaggtcccacctgct

SEQ ID NO: 983645 - DNA, 25 bp, Mus musculus
tgtgcatgcctcctctgaaaacgag

SEQ ID NO: 983646 - DNA, 25 bp, Mus musculus
tgtgcatgcctcctgtgaaaacgag

SEQ ID NO: 983647 - DNA, 25 bp, Mus musculus
tgtgcatgttcttgcaaacctgata

SEQ ID NO: 983648 - DNA, 25 bp, Mus musculus
tgtgcatgttcttggaaacctgata

SEQ ID NO: 983649 - DNA, 25 bp, Mus musculus
tgtgccaagaaactctgacctcttc

SEQ ID NO: 983650 - DNA, 25 bp, Mus musculus
tgtgccaagaaagtctgacctcttc

SEQ ID NO: 983651 - DNA, 25 bp, Mus musculus
tgtgccagataccacgttgctggtg

SEQ ID NO: 983652 - DNA, 25 bp, Mus musculus
tgtgccagataccaggttgctggtg

SEQ ID NO: 983653 - DNA, 25 bp, Mus musculus
tgtgccagccagctgggcatgacag

SEQ ID NO: 983654 - DNA, 25 bp, Mus musculus
tgtgccagccaggtgggcatgacag

SEQ ID NO: 983655 - DNA, 25 bp, Mus musculus
tgtgccattgccagtggttctgagc

SEQ ID NO: 983656 - DNA, 25 bp, Mus musculus
tgtgccattgcctgtggttctgagc

SEQ ID NO: 983657 - DNA, 25 bp, Mus musculus
tgtgcccacaagcctcccctcgcaa

SEQ ID NO: 983658 - DNA, 25 bp, Mus musculus
tgtgcccacatgcctcccctcgcaa

SEQ ID NO: 983659 - DNA, 25 bp, Mus musculus
tgtgcccagtagtaacacagcatct

SEQ ID NO: 983660 - DNA, 25 bp, Mus musculus
tgtgcccagttgtaacacagcatct

SEQ ID NO: 983661 - DNA, 25 bp, Mus musculus
tgtgcccatcacagcagtcacccga

SEQ ID NO: 983662 - DNA, 25 bp, Mus musculus
tgtgcccatctcagcagtcacccga

SEQ ID NO: 983663 - DNA, 25 bp, Mus musculus
tgtgcccattgccacttttcagatt

SEQ ID NO: 983664 - DNA, 25 bp, Mus musculus
tgtgcccattgccagttttcagatt

SEQ ID NO: 983665 - DNA, 25 bp, Mus musculus
tgtgcccgtgctatcgatgttgaac

SEQ ID NO: 983666 - DNA, 25 bp, Mus musculus
tgtgcccgtggtatcgatgttgaac

SEQ ID NO: 983667 - DNA, 25 bp, Mus musculus
tgtgccctgcagccattgattgatt

SEQ ID NO: 983668 - DNA, 25 bp, Mus musculus
tgtgccctgcaggcattgattgatt

SEQ ID NO: 983669 - DNA, 25 bp, Mus musculus
tgtgccctgctgcgtggggagacag

SEQ ID NO: 983670 - DNA, 25 bp, Mus musculus
tgtgccctgctgggtggggagacag

SEQ ID NO: 983671 - DNA, 25 bp, Mus musculus
tgtgccgactacctggaggagccca

SEQ ID NO: 983672 - DNA, 25 bp, Mus musculus
tgtgccgactacgtggaggagccca

SEQ ID NO: 983673 - DNA, 25 bp, Mus musculus
tgtgccgcagctcgagatttcaggt

SEQ ID NO: 983674 - DNA, 25 bp, Mus musculus
tgtgccgcaggtcgagatttcaggt

SEQ ID NO: 983675 - DNA, 25 bp, Mus musculus
tgtgccgccgaggacagaagattgc

SEQ ID NO: 983676 - DNA, 25 bp, Mus musculus
tgtgccgccgtggacagaagattgc

SEQ ID NO: 983677 - DNA, 25 bp, Mus musculus
tgtgccgcttcccgaagctgcactg

SEQ ID NO: 983678 - DNA, 25 bp, Mus musculus
tgtgccgcttccggaagctgcactg

SEQ ID NO: 983679 - DNA, 25 bp, Mus musculus
tgtgcctagtcgaaccccagagaag

SEQ ID NO: 983680 - DNA, 25 bp, Mus musculus
tgtgcctagtcgaactgcccccctc

SEQ ID NO: 983681 - DNA, 25 bp, Mus musculus
tgtgcctagtcgaagcccagagaag

SEQ ID NO: 983682 - DNA, 25 bp, Mus musculus
tgtgcctagtcgaagtgcccccctc

SEQ ID NO: 983683 - DNA, 25 bp, Mus musculus
tgtgcctcagcgcttagtcaaagtt

SEQ ID NO: 983684 - DNA, 25 bp, Mus musculus
tgtgcctcagggcttagtcaaagtt

SEQ ID NO: 983685 - DNA, 25 bp, Mus musculus
tgtgcctcgcggagcaaaatcaact

SEQ ID NO: 983686 - DNA, 25 bp, Mus musculus
tgtgcctcgcggaggaaaatcaact

SEQ ID NO: 983687 - DNA, 25 bp, Mus musculus
tgtgcctctgcatgcacttccaagt

SEQ ID NO: 983688 - DNA, 25 bp, Mus musculus
tgtgcctctggatgcacttccaagt

SEQ ID NO: 983689 - DNA, 25 bp, Mus musculus
tgtgcctgagcgcaggactggctac

SEQ ID NO: 983690 - DNA, 25 bp, Mus musculus
tgtgcctgagcgcgctagctgtgga

SEQ ID NO: 983691 - DNA, 25 bp, Mus musculus
tgtgcctgagcggaggactggctac

SEQ ID NO: 983692 - DNA, 25 bp, Mus musculus
tgtgcctgagcgggctagctgtgga

SEQ ID NO: 983693 - DNA, 25 bp, Mus musculus
tgtgcctgtcctcgttgttcctcaa

SEQ ID NO: 983694 - DNA, 25 bp, Mus musculus
tgtgcctgtcctggttgttcctcaa

SEQ ID NO: 983695 - DNA, 25 bp, Mus musculus
tgtgcgacagcttggatgactacaa

SEQ ID NO: 983696 - DNA, 25 bp, Mus musculus
tgtgcgacaggttggatgactacaa

SEQ ID NO: 983697 - DNA, 25 bp, Mus musculus
tgtgcgcaagctcaatgccgaaggc

SEQ ID NO: 983698 - DNA, 25 bp, Mus musculus
tgtgcgcaaggtcaatgccgaaggc

SEQ ID NO: 983699 - DNA, 25 bp, Mus musculus
tgtgcgtgttggtcccctctctgcc

SEQ ID NO: 983700 - DNA, 25 bp, Mus musculus
tgtgcgtgttggtcccgggggttct

SEQ ID NO: 983701 - DNA, 25 bp, Mus musculus
tgtgcgtgttggtcgcctctctgcc

SEQ ID NO: 983702 - DNA, 25 bp, Mus musculus
tgtgcgtgttggtcgcgggggttct

SEQ ID NO: 983703 - DNA, 25 bp, Mus musculus
tgtgctacagcttgattttccttct

SEQ ID NO: 983704 - DNA, 25 bp, Mus musculus
tgtgctacaggttgattttccttct

SEQ ID NO: 983705 - DNA, 25 bp, Mus musculus
tgtgctaccttacgatcgagcggtc

SEQ ID NO: 983706 - DNA, 25 bp, Mus musculus
tgtgctaccttaggatcgagcggtc

SEQ ID NO: 983707 - DNA, 25 bp, Mus musculus
tgtgctagacagctggaaggctctc

SEQ ID NO: 983708 - DNA, 25 bp, Mus musculus
tgtgctagacaggtggaaggctctc

SEQ ID NO: 983709 - DNA, 25 bp, Mus musculus
tgtgctcaaaaactgctgcaagatc

SEQ ID NO: 983710 - DNA, 25 bp, Mus musculus
tgtgctcaaaaagtgctgcaagatc

SEQ ID NO: 983711 - DNA, 25 bp, Mus musculus
tgtgctcagaagagcaaagtccaaa

SEQ ID NO: 983712 - DNA, 25 bp, Mus musculus
tgtgctcagaagtgcaaagtccaaa

SEQ ID NO: 983713 - DNA, 25 bp, Mus musculus
tgtgctccagcctggacagtatggc

SEQ ID NO: 983714 - DNA, 25 bp, Mus musculus
tgtgctccaggctggacagtatggc

SEQ ID NO: 983715 - DNA, 25 bp, Mus musculus
tgtgctcgtgccacggaggtgccaa

SEQ ID NO: 983716 - DNA, 25 bp, Mus musculus
tgtgctcgtggcacggaggtgccaa

SEQ ID NO: 983717 - DNA, 25 bp, Mus musculus
tgtgctctctaacggccatgcagct

SEQ ID NO: 983718 - DNA, 25 bp, Mus musculus
tgtgctctctaagggccatgcagct

SEQ ID NO: 983719 - DNA, 25 bp, Mus musculus
tgtgctctgcagagtgcaattttat

SEQ ID NO: 983720 - DNA, 25 bp, Mus musculus
tgtgctctgcagtgtgcaattttat

SEQ ID NO: 983721 - DNA, 25 bp, Mus musculus
tgtgctctggctgccaacccttgtg

SEQ ID NO: 983722 - DNA, 25 bp, Mus musculus
tgtgctctgggtgccaacccttgtg

SEQ ID NO: 983723 - DNA, 25 bp, Mus musculus
tgtgctgaagcgcatcctggaggac

SEQ ID NO: 983724 - DNA, 25 bp, Mus musculus
tgtgctgaagggcatcctggaggac

SEQ ID NO: 983725 - DNA, 25 bp, Mus musculus
tgtgctgcagattctggaggcggct

SEQ ID NO: 983726 - DNA, 25 bp, Mus musculus
tgtgctgcagcacattgtcaatctg

SEQ ID NO: 983727 - DNA, 25 bp, Mus musculus
tgtgctgcagcagattgtcaatctg

SEQ ID NO: 983728 - DNA, 25 bp, Mus musculus
tgtgctgcagtttctggaggcggct

SEQ ID NO: 983729 - DNA, 25 bp, Mus musculus
tgtgctgccactccctccacagaca

SEQ ID NO: 983730 - DNA, 25 bp, Mus musculus
tgtgctgccagtccctccacagaca

SEQ ID NO: 983731 - DNA, 25 bp, Mus musculus
tgtgctgcccagatcttggtgacca

SEQ ID NO: 983732 - DNA, 25 bp, Mus musculus
tgtgctgcccagttcttggtgacca

SEQ ID NO: 983733 - DNA, 25 bp, Mus musculus
tgtgctgcccgaaacgctgagaccg

SEQ ID NO: 983734 - DNA, 25 bp, Mus musculus
tgtgctgcccgaaaggctgagaccg

SEQ ID NO: 983735 - DNA, 25 bp, Mus musculus
tgtgctgctcaaagaggtcctccgg

SEQ ID NO: 983736 - DNA, 25 bp, Mus musculus
tgtgctgctcaatgaggtcctccgg

SEQ ID NO: 983737 - DNA, 25 bp, Mus musculus
tgtgctggagccttttgggaatgcc

SEQ ID NO: 983738 - DNA, 25 bp, Mus musculus
tgtgctggaggcttttgggaatgcc

SEQ ID NO: 983739 - DNA, 25 bp, Mus musculus
tgtgctgtcaaaaacgtacgactcg

SEQ ID NO: 983740 - DNA, 25 bp, Mus musculus
tgtgctgtcaaaaaggtacgactcg

SEQ ID NO: 983741 - DNA, 25 bp, Mus musculus
tgtgctgtggatcgccccagaagta

SEQ ID NO: 983742 - DNA, 25 bp, Mus musculus
tgtgctgtggatggccccagaagta

SEQ ID NO: 983743 - DNA, 25 bp, Mus musculus
tgtgctgttggacgaactgtactga

SEQ ID NO: 983744 - DNA, 25 bp, Mus musculus
tgtgctgttggaggaactgtactga

SEQ ID NO: 983745 - DNA, 25 bp, Mus musculus
tgtgctgtttgataagctgacagtg

SEQ ID NO: 983746 - DNA, 25 bp, Mus musculus
tgtgctgtttgatatgctgacagtg

SEQ ID NO: 983747 - DNA, 25 bp, Mus musculus
tgtgcttccagacgtttctaaggtg

SEQ ID NO: 983748 - DNA, 25 bp, Mus musculus
tgtgcttccagaggtttctaaggtg

SEQ ID NO: 983749 - DNA, 25 bp, Mus musculus
tgtgcttcctccagcatggattcat

SEQ ID NO: 983750 - DNA, 25 bp, Mus musculus
tgtgcttcctccaggatggattcat

SEQ ID NO: 983751 - DNA, 25 bp, Mus musculus
tgtgcttggtgacaaggaagagtgt

SEQ ID NO: 983752 - DNA, 25 bp, Mus musculus
tgtgcttggtgagaaggaagagtgt

SEQ ID NO: 983753 - DNA, 25 bp, Mus musculus
tgtggaaaagctcttagatcagaag

SEQ ID NO: 983754 - DNA, 25 bp, Mus musculus
tgtggaaaaggacacaatcatagag

SEQ ID NO: 983755 - DNA, 25 bp, Mus musculus
tgtggaaaaggacagaatcatagag

SEQ ID NO: 983756 - DNA, 25 bp, Mus musculus
tgtggaaaaggtcttagatcagaag

SEQ ID NO: 983757 - DNA, 25 bp, Mus musculus
tgtggaaagattcagttcaggaggg

SEQ ID NO: 983758 - DNA, 25 bp, Mus musculus
tgtggaaagattgagttcaggaggg

SEQ ID NO: 983759 - DNA, 25 bp, Mus musculus
tgtggaaaggaactgtacccagctg

SEQ ID NO: 983760 - DNA, 25 bp, Mus musculus
tgtggaaaggaagtgtacccagctg

SEQ ID NO: 983761 - DNA, 25 bp, Mus musculus
tgtggaaatccacgctgttcatcag

SEQ ID NO: 983762 - DNA, 25 bp, Mus musculus
tgtggaaatccacggcagagatgac

SEQ ID NO: 983763 - DNA, 25 bp, Mus musculus
tgtggaaatccaggctgttcatcag

SEQ ID NO: 983764 - DNA, 25 bp, Mus musculus
tgtggaaatccagggcagagatgac

SEQ ID NO: 983765 - DNA, 25 bp, Mus musculus
tgtggaaatgggcaacttctgtggc

SEQ ID NO: 983766 - DNA, 25 bp, Mus musculus
tgtggaaatgggccactttctgcat

SEQ ID NO: 983767 - DNA, 25 bp, Mus musculus
tgtggaaatggggaacttctgtggc

SEQ ID NO: 983768 - DNA, 25 bp, Mus musculus
tgtggaaatggggcactttctgcat

SEQ ID NO: 983769 - DNA, 25 bp, Mus musculus
tgtggaacgttacaacagattgttc

SEQ ID NO: 983770 - DNA, 25 bp, Mus musculus
tgtggaacgttacatcagattgttc

SEQ ID NO: 983771 - DNA, 25 bp, Mus musculus
tgtggaactgtcttaatccgtctac

SEQ ID NO: 983772 - DNA, 25 bp, Mus musculus
tgtggaactgtctttatccgtctac

SEQ ID NO: 983773 - DNA, 25 bp, Mus musculus
tgtggaagacaaagaacgacagtgg

SEQ ID NO: 983774 - DNA, 25 bp, Mus musculus
tgtggaagacaatgaacgacagtgg

SEQ ID NO: 983775 - DNA, 25 bp, Mus musculus
tgtggaagagatgaaccggacaaaa

SEQ ID NO: 983776 - DNA, 25 bp, Mus musculus
tgtggaagagttgaaccggacaaaa

SEQ ID NO: 983777 - DNA, 25 bp, Mus musculus
tgtggaagcaccttcgtgaccagaa

SEQ ID NO: 983778 - DNA, 25 bp, Mus musculus
tgtggaagcaccttggtgaccagaa

SEQ ID NO: 983779 - DNA, 25 bp, Mus musculus
tgtggaatgttacagactcagccat

SEQ ID NO: 983780 - DNA, 25 bp, Mus musculus
tgtggaatgttactacagagactca

SEQ ID NO: 983781 - DNA, 25 bp, Mus musculus
tgtggaatgttagagactcagccat

SEQ ID NO: 983782 - DNA, 25 bp, Mus musculus
tgtggaatgttagtacagagactca

SEQ ID NO: 983783 - DNA, 25 bp, Mus musculus
tgtggacaagctattctttgatctg

SEQ ID NO: 983784 - DNA, 25 bp, Mus musculus
tgtggacaagctcattgtgctcagt

SEQ ID NO: 983785 - DNA, 25 bp, Mus musculus
tgtggacaaggtattctttgatctg

SEQ ID NO: 983786 - DNA, 25 bp, Mus musculus
tgtggacaaggtcattgtgctcagt

SEQ ID NO: 983787 - DNA, 25 bp, Mus musculus
tgtggacacaggaacgcattggctg

SEQ ID NO: 983788 - DNA, 25 bp, Mus musculus
tgtggacacaggaaggcattggctg

SEQ ID NO: 983789 - DNA, 25 bp, Mus musculus
tgtggacactggaaggtctacgtct

SEQ ID NO: 983790 - DNA, 25 bp, Mus musculus
tgtggacactggtaggtctacgtct

SEQ ID NO: 983791 - DNA, 25 bp, Mus musculus
tgtggacatgatgtacggtggcatg

SEQ ID NO: 983792 - DNA, 25 bp, Mus musculus
tgtggacatgttgtacggtggcatg

SEQ ID NO: 983793 - DNA, 25 bp, Mus musculus
tgtggaccagaacctgatactacct

SEQ ID NO: 983794 - DNA, 25 bp, Mus musculus
tgtggaccagtacctgatactacct

SEQ ID NO: 983795 - DNA, 25 bp, Mus musculus
tgtggaccatcgcacgggcggaaca

SEQ ID NO: 983796 - DNA, 25 bp, Mus musculus
tgtggaccatcgcaggggcggaaca

SEQ ID NO: 983797 - DNA, 25 bp, Mus musculus
tgtggaccatcgcggtacctggaat

SEQ ID NO: 983798 - DNA, 25 bp, Mus musculus
tgtggaccatcggggtacctggaat

SEQ ID NO: 983799 - DNA, 25 bp, Mus musculus
tgtggaccctgacttccaccaggtg

SEQ ID NO: 983800 - DNA, 25 bp, Mus musculus
tgtggaccctgagttccaccaggtg

SEQ ID NO: 983801 - DNA, 25 bp, Mus musculus
tgtggacctgatggggtgacacccc

SEQ ID NO: 983802 - DNA, 25 bp, Mus musculus
tgtggacctgttggggtgacacccc

SEQ ID NO: 983803 - DNA, 25 bp, Mus musculus
tgtggacgtggaagccattttgtga

SEQ ID NO: 983804 - DNA, 25 bp, Mus musculus
tgtggacgtggaagcccttgatcct

SEQ ID NO: 983805 - DNA, 25 bp, Mus musculus
tgtggacgtggaaggcattttgtga

SEQ ID NO: 983806 - DNA, 25 bp, Mus musculus
tgtggacgtggaaggccttgatcct

SEQ ID NO: 983807 - DNA, 25 bp, Mus musculus
tgtggacttgccacctttgtcttca

SEQ ID NO: 983808 - DNA, 25 bp, Mus musculus
tgtggacttgccacgtttgtcttca

SEQ ID NO: 983809 - DNA, 25 bp, Mus musculus
tgtggagaagcgtatgcctggtttt

SEQ ID NO: 983810 - DNA, 25 bp, Mus musculus
tgtggagaagggtatgcctggtttt

SEQ ID NO: 983811 - DNA, 25 bp, Mus musculus
tgtggagatgacttggactgatgag

SEQ ID NO: 983812 - DNA, 25 bp, Mus musculus
tgtggagatgcagtatacaatggat

SEQ ID NO: 983813 - DNA, 25 bp, Mus musculus
tgtggagatggagtatacaatggat

SEQ ID NO: 983814 - DNA, 25 bp, Mus musculus
tgtggagatgtcttggactgatgag

SEQ ID NO: 983815 - DNA, 25 bp, Mus musculus
tgtggagcagcttggatggacaatg

SEQ ID NO: 983816 - DNA, 25 bp, Mus musculus
tgtggagcaggttggatggacaatg

SEQ ID NO: 983817 - DNA, 25 bp, Mus musculus
tgtggaggcgcgtatgatcgcattg

SEQ ID NO: 983818 - DNA, 25 bp, Mus musculus
tgtggaggcgggtatgatcgcattg

SEQ ID NO: 983819 - DNA, 25 bp, Mus musculus
tgtggaggctgtcgttgaatgtaat

SEQ ID NO: 983820 - DNA, 25 bp, Mus musculus
tgtggaggctgtggttgaatgtaat

SEQ ID NO: 983821 - DNA, 25 bp, Mus musculus
tgtggagggacaccaactgctttgc

SEQ ID NO: 983822 - DNA, 25 bp, Mus musculus
tgtggagggacactgacaggtttct

SEQ ID NO: 983823 - DNA, 25 bp, Mus musculus
tgtggagggacagcaactgctttgc

SEQ ID NO: 983824 - DNA, 25 bp, Mus musculus
tgtggagggacagtgacaggtttct

SEQ ID NO: 983825 - DNA, 25 bp, Mus musculus
tgtggataagcttttggaactgaaa

SEQ ID NO: 983826 - DNA, 25 bp, Mus musculus
tgtggataaggttttggaactgaaa

SEQ ID NO: 983827 - DNA, 25 bp, Mus musculus
tgtggatcacagctgcgaccgaggg

SEQ ID NO: 983828 - DNA, 25 bp, Mus musculus
tgtggatcacaggtgcgaccgaggg

SEQ ID NO: 983829 - DNA, 25 bp, Mus musculus
tgtggatccagggacgaaaggatat

SEQ ID NO: 983830 - DNA, 25 bp, Mus musculus
tgtggatccagggaggaaaggatat

SEQ ID NO: 983831 - DNA, 25 bp, Mus musculus
tgtggatccttgatcttagaatctt

SEQ ID NO: 983832 - DNA, 25 bp, Mus musculus
tgtggatccttgcgggcaggtccta

SEQ ID NO: 983833 - DNA, 25 bp, Mus musculus
tgtggatccttgggggcaggtccta

SEQ ID NO: 983834 - DNA, 25 bp, Mus musculus
tgtggatccttgttcttagaatctt

SEQ ID NO: 983835 - DNA, 25 bp, Mus musculus
tgtggatgagctcactacttcagtg

SEQ ID NO: 983836 - DNA, 25 bp, Mus musculus
tgtggatgaggtcactacttcagtg

SEQ ID NO: 983837 - DNA, 25 bp, Mus musculus
tgtggatgatgacgagatggggggt

SEQ ID NO: 983838 - DNA, 25 bp, Mus musculus
tgtggatgatgaggagatggggggt

SEQ ID NO: 983839 - DNA, 25 bp, Mus musculus
tgtggattccagatgagaagactga

SEQ ID NO: 983840 - DNA, 25 bp, Mus musculus
tgtggattccagttgagaagactga

SEQ ID NO: 983841 - DNA, 25 bp, Mus musculus
tgtggcaagaggcgatcactattta

SEQ ID NO: 983842 - DNA, 25 bp, Mus musculus
tgtggcaagaggggatcactattta

SEQ ID NO: 983843 - DNA, 25 bp, Mus musculus
tgtggcacacatcactcaactgcaa

SEQ ID NO: 983844 - DNA, 25 bp, Mus musculus
tgtggcacacttcactcaactgcaa

SEQ ID NO: 983845 - DNA, 25 bp, Mus musculus
tgtggcacagagaaatgctttgatg

SEQ ID NO: 983846 - DNA, 25 bp, Mus musculus
tgtggcacagtgaaatgctttgatg

SEQ ID NO: 983847 - DNA, 25 bp, Mus musculus
tgtggcactaagcctggtgttcccg

SEQ ID NO: 983848 - DNA, 25 bp, Mus musculus
tgtggcactaaggctggtgttcccg

SEQ ID NO: 983849 - DNA, 25 bp, Mus musculus
tgtggcacttctcatgttcagcaaa

SEQ ID NO: 983850 - DNA, 25 bp, Mus musculus
tgtggcacttctgatgttcagcaaa

SEQ ID NO: 983851 - DNA, 25 bp, Mus musculus
tgtggcagagagctcaacaggcacc

SEQ ID NO: 983852 - DNA, 25 bp, Mus musculus
tgtggcagagaggctgctgcagctg

SEQ ID NO: 983853 - DNA, 25 bp, Mus musculus
tgtggcagagagtccccacttcagc

SEQ ID NO: 983854 - DNA, 25 bp, Mus musculus
tgtggcagagtgctcaacaggcacc

SEQ ID NO: 983855 - DNA, 25 bp, Mus musculus
tgtggcagagtggctgctgcagctg

SEQ ID NO: 983856 - DNA, 25 bp, Mus musculus
tgtggcagagtgtccccacttcagc

SEQ ID NO: 983857 - DNA, 25 bp, Mus musculus
tgtggcagctatcggaaagagatac

SEQ ID NO: 983858 - DNA, 25 bp, Mus musculus
tgtggcagctatgggaaagagatac

SEQ ID NO: 983859 - DNA, 25 bp, Mus musculus
tgtggcatgttgcaatgaatgatgt

SEQ ID NO: 983860 - DNA, 25 bp, Mus musculus
tgtggcatgttggaatgaatgatgt

SEQ ID NO: 983861 - DNA, 25 bp, Mus musculus
tgtggcattaagcactgaatgcaca

SEQ ID NO: 983862 - DNA, 25 bp, Mus musculus
tgtggcattaaggactgaatgcaca

SEQ ID NO: 983863 - DNA, 25 bp, Mus musculus
tgtggccaaacccaaacttgccaat

SEQ ID NO: 983864 - DNA, 25 bp, Mus musculus
tgtggccaaacggacagtacttatt

SEQ ID NO: 983865 - DNA, 25 bp, Mus musculus
tgtggccaaagccaaacttgccaat

SEQ ID NO: 983866 - DNA, 25 bp, Mus musculus
tgtggccaaagggacagtacttatt

SEQ ID NO: 983867 - DNA, 25 bp, Mus musculus
tgtggccatcagcgctgtggcagag

SEQ ID NO: 983868 - DNA, 25 bp, Mus musculus
tgtggccatcagcggctgtggcaga

SEQ ID NO: 983869 - DNA, 25 bp, Mus musculus
tgtggccatcagggctgtggcagag

SEQ ID NO: 983870 - DNA, 25 bp, Mus musculus
tgtggccatcaggggctgtggcaga

SEQ ID NO: 983871 - DNA, 25 bp, Mus musculus
tgtggccgtactgccccttcctgca

SEQ ID NO: 983872 - DNA, 25 bp, Mus musculus
tgtggccgtagtgccccttcctgca

SEQ ID NO: 983873 - DNA, 25 bp, Mus musculus
tgtggcctgaaaccggctgtggtgt

SEQ ID NO: 983874 - DNA, 25 bp, Mus musculus
tgtggcctgaaagcggctgtggtgt

SEQ ID NO: 983875 - DNA, 25 bp, Mus musculus
tgtggcgaggagaaagcggtggaga

SEQ ID NO: 983876 - DNA, 25 bp, Mus musculus
tgtggcgaggagtaagcggtggaga

SEQ ID NO: 983877 - DNA, 25 bp, Mus musculus
tgtggcgggcgctacgtccgtctcc

SEQ ID NO: 983878 - DNA, 25 bp, Mus musculus
tgtggcgggcgctaggtccgtctcc

SEQ ID NO: 983879 - DNA, 25 bp, Mus musculus
tgtggctcagccttattatgcccgt

SEQ ID NO: 983880 - DNA, 25 bp, Mus musculus
tgtggctcaggcttattatgcccgt

SEQ ID NO: 983881 - DNA, 25 bp, Mus musculus
tgtggctcatccagtcaatccacca

SEQ ID NO: 983882 - DNA, 25 bp, Mus musculus
tgtggctcatcctgtcaatccacca

SEQ ID NO: 983883 - DNA, 25 bp, Mus musculus
tgtggctccggcagcgaagcccagc

SEQ ID NO: 983884 - DNA, 25 bp, Mus musculus
tgtggctccggcagggaagcccagc

SEQ ID NO: 983885 - DNA, 25 bp, Mus musculus
tgtggctgagtacacggcctcagag

SEQ ID NO: 983886 - DNA, 25 bp, Mus musculus
tgtggctgagtacagggcctcagag

SEQ ID NO: 983887 - DNA, 25 bp, Mus musculus
tgtggctgctcccgcaggctggcca

SEQ ID NO: 983888 - DNA, 25 bp, Mus musculus
tgtggctgctgccgcaggctggcca

SEQ ID NO: 983889 - DNA, 25 bp, Mus musculus
tgtggctggtacccctgctgatgta

SEQ ID NO: 983890 - DNA, 25 bp, Mus musculus
tgtggctggtacccgtgctgatgta

SEQ ID NO: 983891 - DNA, 25 bp, Mus musculus
tgtggctgttggcacttctggcagg

SEQ ID NO: 983892 - DNA, 25 bp, Mus musculus
tgtggctgttggcagttctggcagg

SEQ ID NO: 983893 - DNA, 25 bp, Mus musculus
tgtggcttcccagaagaatgcactg

SEQ ID NO: 983894 - DNA, 25 bp, Mus musculus
tgtggcttcccagatgaatgcactg

SEQ ID NO: 983895 - DNA, 25 bp, Mus musculus
tgtggctttgtgcgccctgtcgtcg

SEQ ID NO: 983896 - DNA, 25 bp, Mus musculus
tgtggctttgtgggccctgtcgtcg

SEQ ID NO: 983897 - DNA, 25 bp, Mus musculus
tgtgggagagagccaccatgacaac

SEQ ID NO: 983898 - DNA, 25 bp, Mus musculus
tgtgggagagaggcaccatgacaac

SEQ ID NO: 983899 - DNA, 25 bp, Mus musculus
tgtgggcattaacataagggtgtgg

SEQ ID NO: 983900 - DNA, 25 bp, Mus musculus
tgtgggcattaacgtagataagggt

SEQ ID NO: 983901 - DNA, 25 bp, Mus musculus
tgtgggcattaagataagggtgtgg

SEQ ID NO: 983902 - DNA, 25 bp, Mus musculus
tgtgggcattaaggtagataagggt

SEQ ID NO: 983903 - DNA, 25 bp, Mus musculus
tgtgggcgataaagcatcccttccc

SEQ ID NO: 983904 - DNA, 25 bp, Mus musculus
tgtgggcgataaaggatcccttccc

SEQ ID NO: 983905 - DNA, 25 bp, Mus musculus
tgtgggctccaactgcctgtggaca

SEQ ID NO: 983906 - DNA, 25 bp, Mus musculus
tgtgggctccaagtgcctgtggaca

SEQ ID NO: 983907 - DNA, 25 bp, Mus musculus
tgtggggcaaagctggtagagaaaa

SEQ ID NO: 983908 - DNA, 25 bp, Mus musculus
tgtggggcaaaggtggtagagaaaa

SEQ ID NO: 983909 - DNA, 25 bp, Mus musculus
tgtggggctctgctgtgtagatgcc

SEQ ID NO: 983910 - DNA, 25 bp, Mus musculus
tgtggggctctggtgtgtagatgcc

SEQ ID NO: 983911 - DNA, 25 bp, Mus musculus
tgtgggggcattggcgtggacagtg

SEQ ID NO: 983912 - DNA, 25 bp, Mus musculus
tgtgggggcattggggtggacagtg

SEQ ID NO: 983913 - DNA, 25 bp, Mus musculus
tgtggggtgtgcacagtgtttccct

SEQ ID NO: 983914 - DNA, 25 bp, Mus musculus
tgtggggtgtgcactgtgtttccct

SEQ ID NO: 983915 - DNA, 25 bp, Mus musculus
tgtgggtgttcaaactgaccttcag

SEQ ID NO: 983916 - DNA, 25 bp, Mus musculus
tgtgggtgttcaaagtgaccttcag

SEQ ID NO: 983917 - DNA, 25 bp, Mus musculus
tgtggtacagccaaaattggcaaag

SEQ ID NO: 983918 - DNA, 25 bp, Mus musculus
tgtggtacaggcaaaattggcaaag

SEQ ID NO: 983919 - DNA, 25 bp, Mus musculus
tgtggtcaaaccttctttggaccca

SEQ ID NO: 983920 - DNA, 25 bp, Mus musculus
tgtggtcaaagcttctttggaccca

SEQ ID NO: 983921 - DNA, 25 bp, Mus musculus
tgtggtcaagcacttaatgggcatc

SEQ ID NO: 983922 - DNA, 25 bp, Mus musculus
tgtggtcaagcagcggatccgtcta

SEQ ID NO: 983923 - DNA, 25 bp, Mus musculus
tgtggtcaagcccctggactatgag

SEQ ID NO: 983924 - DNA, 25 bp, Mus musculus
tgtggtcaagcttcttgcagaatca

SEQ ID NO: 983925 - DNA, 25 bp, Mus musculus
tgtggtcaaggacttaatgggcatc

SEQ ID NO: 983926 - DNA, 25 bp, Mus musculus
tgtggtcaaggagcggatccgtcta

SEQ ID NO: 983927 - DNA, 25 bp, Mus musculus
tgtggtcaaggccctggactatgag

SEQ ID NO: 983928 - DNA, 25 bp, Mus musculus
tgtggtcaaggttcttgcagaatca

SEQ ID NO: 983929 - DNA, 25 bp, Mus musculus
tgtggtcctggcctcgtgtgcatcg

SEQ ID NO: 983930 - DNA, 25 bp, Mus musculus
tgtggtcctggcctggtgtgcatcg

SEQ ID NO: 983931 - DNA, 25 bp, Mus musculus
tgtggtctttctcgacgagcccacc

SEQ ID NO: 983932 - DNA, 25 bp, Mus musculus
tgtggtctttctggacgagcccacc

SEQ ID NO: 983933 - DNA, 25 bp, Mus musculus
tgtggtgagccacgtcccaggacct

SEQ ID NO: 983934 - DNA, 25 bp, Mus musculus
tgtggtgagccaggtcccaggacct

SEQ ID NO: 983935 - DNA, 25 bp, Mus musculus
tgtggtgcacagcacgtactaccgc

SEQ ID NO: 983936 - DNA, 25 bp, Mus musculus
tgtggtgcacagcaggtactaccgc

SEQ ID NO: 983937 - DNA, 25 bp, Mus musculus
tgtggtgcagctgatcgaatgggtg

SEQ ID NO: 983938 - DNA, 25 bp, Mus musculus
tgtggtgcaggtgatcgaatgggtg

SEQ ID NO: 983939 - DNA, 25 bp, Mus musculus
tgtggtggaagacgagacaagtttc

SEQ ID NO: 983940 - DNA, 25 bp, Mus musculus
tgtggtggaagaggagacaagtttc

SEQ ID NO: 983941 - DNA, 25 bp, Mus musculus
tgtggtggagctcaccagtcccgcc

SEQ ID NO: 983942 - DNA, 25 bp, Mus musculus
tgtggtggaggtcaccagtcccgcc

SEQ ID NO: 983943 - DNA, 25 bp, Mus musculus
tgtggtggccagcggctggatggac

SEQ ID NO: 983944 - DNA, 25 bp, Mus musculus
tgtggtggccaggggctggatggac

SEQ ID NO: 983945 - DNA, 25 bp, Mus musculus
tgtggtggccatcgtctgggaaggc

SEQ ID NO: 983946 - DNA, 25 bp, Mus musculus
tgtggtggccatggtctgggaaggc

SEQ ID NO: 983947 - DNA, 25 bp, Mus musculus
tgtggtgggtttcacactttgaata

SEQ ID NO: 983948 - DNA, 25 bp, Mus musculus
tgtggtgggtttcagactttgaata

SEQ ID NO: 983949 - DNA, 25 bp, Mus musculus
tgtggtgtccaggaaaacctctgga

SEQ ID NO: 983950 - DNA, 25 bp, Mus musculus
tgtggtgtccaggataacctctgga

SEQ ID NO: 983951 - DNA, 25 bp, Mus musculus
tgtggtgtctgtgacgtctgtcagc

SEQ ID NO: 983952 - DNA, 25 bp, Mus musculus
tgtggtgtctgtgaggtctgtcagc

SEQ ID NO: 983953 - DNA, 25 bp, Mus musculus
tgtggttcatcggctggactgtact

SEQ ID NO: 983954 - DNA, 25 bp, Mus musculus
tgtggttcatgggctggactgtact

SEQ ID NO: 983955 - DNA, 25 bp, Mus musculus
tgtggtttcctgcctgaggaatcga

SEQ ID NO: 983956 - DNA, 25 bp, Mus musculus
tgtggtttcctggctgaggaatcga

SEQ ID NO: 983957 - DNA, 25 bp, Mus musculus
tgtggtttgcatctctgacatgctc

SEQ ID NO: 983958 - DNA, 25 bp, Mus musculus
tgtggtttgcatgtctgacatgctc

SEQ ID NO: 983959 - DNA, 25 bp, Mus musculus
tgtgtaaaagcccttaaccatggca

SEQ ID NO: 983960 - DNA, 25 bp, Mus musculus
tgtgtaaaaggccttaaccatggca

SEQ ID NO: 983961 - DNA, 25 bp, Mus musculus
tgtgtaaacaatctcctggaagtgt

SEQ ID NO: 983962 - DNA, 25 bp, Mus musculus
tgtgtaaacaatgtcctggaagtgt

SEQ ID NO: 983963 - DNA, 25 bp, Mus musculus
tgtgtaacgtgcaacgaagccagca

SEQ ID NO: 983964 - DNA, 25 bp, Mus musculus
tgtgtaacgtgcaaggaagccagca

SEQ ID NO: 983965 - DNA, 25 bp, Mus musculus
tgtgtacagaagcttacacagggac

SEQ ID NO: 983966 - DNA, 25 bp, Mus musculus
tgtgtacagaaggttacacagggac

SEQ ID NO: 983967 - DNA, 25 bp, Mus musculus
tgtgtacaggcacacttgctgatat

SEQ ID NO: 983968 - DNA, 25 bp, Mus musculus
tgtgtacaggcacagttgctgatat

SEQ ID NO: 983969 - DNA, 25 bp, Mus musculus
tgtgtacagtgacacgtatatcttt

SEQ ID NO: 983970 - DNA, 25 bp, Mus musculus
tgtgtacagtgacaggtatatcttt

SEQ ID NO: 983971 - DNA, 25 bp, Mus musculus
tgtgtacggacaagtgcacctggga

SEQ ID NO: 983972 - DNA, 25 bp, Mus musculus
tgtgtacggacatgtgcacctggga

SEQ ID NO: 983973 - DNA, 25 bp, Mus musculus
tgtgtactcgctcaaacccaagaga

SEQ ID NO: 983974 - DNA, 25 bp, Mus musculus
tgtgtactcggtcaaacccaagaga

SEQ ID NO: 983975 - DNA, 25 bp, Mus musculus
tgtgtacttcaacggaggcaagtac

SEQ ID NO: 983976 - DNA, 25 bp, Mus musculus
tgtgtacttcaagggaggcaagtac

SEQ ID NO: 983977 - DNA, 25 bp, Mus musculus
tgtgtagcagctttcaaagctgaat

SEQ ID NO: 983978 - DNA, 25 bp, Mus musculus
tgtgtagcaggtttcaaagctgaat

SEQ ID NO: 983979 - DNA, 25 bp, Mus musculus
tgtgtagcctcacgatgcctggtgt

SEQ ID NO: 983980 - DNA, 25 bp, Mus musculus
tgtgtagcctcaggatgcctggtgt

SEQ ID NO: 983981 - DNA, 25 bp, Mus musculus
tgtgtatattcttctggataaagct

SEQ ID NO: 983982 - DNA, 25 bp, Mus musculus
tgtgtatattgttctggataaagct

SEQ ID NO: 983983 - DNA, 25 bp, Mus musculus
tgtgtatcagcagctgagacagttg

SEQ ID NO: 983984 - DNA, 25 bp, Mus musculus
tgtgtatcaggagctgagacagttg

SEQ ID NO: 983985 - DNA, 25 bp, Mus musculus
tgtgtcagaggacgaaagggcatca

SEQ ID NO: 983986 - DNA, 25 bp, Mus musculus
tgtgtcagaggaggaaagggcatca

SEQ ID NO: 983987 - DNA, 25 bp, Mus musculus
tgtgtcccagatttccagaatatga

SEQ ID NO: 983988 - DNA, 25 bp, Mus musculus
tgtgtcccagttttccagaatatga

SEQ ID NO: 983989 - DNA, 25 bp, Mus musculus
tgtgtcctcgagagacccagccatt

SEQ ID NO: 983990 - DNA, 25 bp, Mus musculus
tgtgtcctcgagatttactacagag

SEQ ID NO: 983991 - DNA, 25 bp, Mus musculus
tgtgtcctcgagtgacccagccatt

SEQ ID NO: 983992 - DNA, 25 bp, Mus musculus
tgtgtcctcgagttttactacagag

SEQ ID NO: 983993 - DNA, 25 bp, Mus musculus
tgtgtcctttcacgcccggttcgct

SEQ ID NO: 983994 - DNA, 25 bp, Mus musculus
tgtgtcctttcaggcccggttcgct

SEQ ID NO: 983995 - DNA, 25 bp, Mus musculus
tgtgtcgaagggctatggatttgtc

SEQ ID NO: 983996 - DNA, 25 bp, Mus musculus
tgtgtcgaaggggtatggatttgtc

SEQ ID NO: 983997 - DNA, 25 bp, Mus musculus
tgtgtcgcacgacagctgcctgtag

SEQ ID NO: 983998 - DNA, 25 bp, Mus musculus
tgtgtcgcacgacgtggactcacat

SEQ ID NO: 983999 - DNA, 25 bp, Mus musculus
tgtgtcgcacgagagctgcctgtag

SEQ ID NO: 984000 - DNA, 25 bp, Mus musculus
tgtgtcgcacgaggtggactcacat

SEQ ID NO: 984001 - DNA, 25 bp, Mus musculus
tgtgtcggagaggctggtccaggag

SEQ ID NO: 984002 - DNA, 25 bp, Mus musculus
tgtgtcggagcctccgaagtagctg

SEQ ID NO: 984003 - DNA, 25 bp, Mus musculus
tgtgtcggaggctccgaagtagctg

SEQ ID NO: 984004 - DNA, 25 bp, Mus musculus
tgtgtcggagtggctggtccaggag

SEQ ID NO: 984005 - DNA, 25 bp, Mus musculus
tgtgtctaccagatcgtaccgggct

SEQ ID NO: 984006 - DNA, 25 bp, Mus musculus
tgtgtctaccagatggtaccgggct

SEQ ID NO: 984007 - DNA, 25 bp, Mus musculus
tgtgtctcagctgatccgcaacatg

SEQ ID NO: 984008 - DNA, 25 bp, Mus musculus
tgtgtctcaggtgatccgcaacatg

SEQ ID NO: 984009 - DNA, 25 bp, Mus musculus
tgtgtctgctggcatgcgttgctgg

SEQ ID NO: 984010 - DNA, 25 bp, Mus musculus
tgtgtctgctgggatgcgttgctgg

SEQ ID NO: 984011 - DNA, 25 bp, Mus musculus
tgtgtgacagccccacagagcaagt

SEQ ID NO: 984012 - DNA, 25 bp, Mus musculus
tgtgtgacaggcccacagagcaagt

SEQ ID NO: 984013 - DNA, 25 bp, Mus musculus
tgtgtgacgaaacgtctgtcaccta

SEQ ID NO: 984014 - DNA, 25 bp, Mus musculus
tgtgtgacgaaaggtctgtcaccta

SEQ ID NO: 984015 - DNA, 25 bp, Mus musculus
tgtgtgacttagcccaggagttaaa

SEQ ID NO: 984016 - DNA, 25 bp, Mus musculus
tgtgtgacttagctaggtgagcctg

SEQ ID NO: 984017 - DNA, 25 bp, Mus musculus
tgtgtgacttaggccaggagttaaa

SEQ ID NO: 984018 - DNA, 25 bp, Mus musculus
tgtgtgacttaggtaggtgagcctg

SEQ ID NO: 984019 - DNA, 25 bp, Mus musculus
tgtgtgagagagtggctatcttgct

SEQ ID NO: 984020 - DNA, 25 bp, Mus musculus
tgtgtgagagtgtggctatcttgct

SEQ ID NO: 984021 - DNA, 25 bp, Mus musculus
tgtgtgagagttcacggcgtccaac

SEQ ID NO: 984022 - DNA, 25 bp, Mus musculus
tgtgtgagagttcagtcctacctgc

SEQ ID NO: 984023 - DNA, 25 bp, Mus musculus
tgtgtgagagttgacggcgtccaac

SEQ ID NO: 984024 - DNA, 25 bp, Mus musculus
tgtgtgagagttgagtcctacctgc

SEQ ID NO: 984025 - DNA, 25 bp, Mus musculus
tgtgtgagtcagaggggtcatgatt

SEQ ID NO: 984026 - DNA, 25 bp, Mus musculus
tgtgtgagtcagtggggtcatgatt

SEQ ID NO: 984027 - DNA, 25 bp, Mus musculus
tgtgtgattaagcctctggactatg

SEQ ID NO: 984028 - DNA, 25 bp, Mus musculus
tgtgtgattaaggctctggactatg

SEQ ID NO: 984029 - DNA, 25 bp, Mus musculus
tgtgtgatttgccgaaatccctctt

SEQ ID NO: 984030 - DNA, 25 bp, Mus musculus
tgtgtgatttgcggaaatccctctt

SEQ ID NO: 984031 - DNA, 25 bp, Mus musculus
tgtgtgcaaaaaatccgagaggagg

SEQ ID NO: 984032 - DNA, 25 bp, Mus musculus
tgtgtgcaaataatccgagaggagg

SEQ ID NO: 984033 - DNA, 25 bp, Mus musculus
tgtgtgcaaatgacccaggatgtac

SEQ ID NO: 984034 - DNA, 25 bp, Mus musculus
tgtgtgcaaatgtcccaggatgtac

SEQ ID NO: 984035 - DNA, 25 bp, Mus musculus
tgtgtgcaaccacgtagaatgtcat

SEQ ID NO: 984036 - DNA, 25 bp, Mus musculus
tgtgtgcaaccaggtagaatgtcat

SEQ ID NO: 984037 - DNA, 25 bp, Mus musculus
tgtgtgcagaaagacctcagggact

SEQ ID NO: 984038 - DNA, 25 bp, Mus musculus
tgtgtgcagaaagagctcagggact

SEQ ID NO: 984039 - DNA, 25 bp, Mus musculus
tgtgtgcccgtgctatcgatgttga

SEQ ID NO: 984040 - DNA, 25 bp, Mus musculus
tgtgtgcccgtggtatcgatgttga

SEQ ID NO: 984041 - DNA, 25 bp, Mus musculus
tgtgtgcgacagcttggatgactac

SEQ ID NO: 984042 - DNA, 25 bp, Mus musculus
tgtgtgcgacaggttggatgactac

SEQ ID NO: 984043 - DNA, 25 bp, Mus musculus
tgtgtgctgttggacgaactgtact

SEQ ID NO: 984044 - DNA, 25 bp, Mus musculus
tgtgtgctgttggaggaactgtact

SEQ ID NO: 984045 - DNA, 25 bp, Mus musculus
tgtgtgcttctgaagaaggggtgag

SEQ ID NO: 984046 - DNA, 25 bp, Mus musculus
tgtgtgcttctgtagaaggggtgag

SEQ ID NO: 984047 - DNA, 25 bp, Mus musculus
tgtgtggaccctgacttccaccagg

SEQ ID NO: 984048 - DNA, 25 bp, Mus musculus
tgtgtggaccctgagttccaccagg

SEQ ID NO: 984049 - DNA, 25 bp, Mus musculus
tgtgtggaggcgcgtatgatcgcat

SEQ ID NO: 984050 - DNA, 25 bp, Mus musculus
tgtgtggaggcgggtatgatcgcat

SEQ ID NO: 984051 - DNA, 25 bp, Mus musculus
tgtgtggcagcaaagaaatgctgaa

SEQ ID NO: 984052 - DNA, 25 bp, Mus musculus
tgtgtggcaggaaagaaatgctgaa

SEQ ID NO: 984053 - DNA, 25 bp, Mus musculus
tgtgtggccaaacccaaacttgcca

SEQ ID NO: 984054 - DNA, 25 bp, Mus musculus
tgtgtggccaaacggacagtactta

SEQ ID NO: 984055 - DNA, 25 bp, Mus musculus
tgtgtggccaaagccaaacttgcca

SEQ ID NO: 984056 - DNA, 25 bp, Mus musculus
tgtgtggccaaagggacagtactta

SEQ ID NO: 984057 - DNA, 25 bp, Mus musculus
tgtgtgggaacacctggaaggtagg

SEQ ID NO: 984058 - DNA, 25 bp, Mus musculus
tgtgtgggaacagctggaaggtagg

SEQ ID NO: 984059 - DNA, 25 bp, Mus musculus
tgtgtgtcctttcacgcccggttcg

SEQ ID NO: 984060 - DNA, 25 bp, Mus musculus
tgtgtgtcctttcaggcccggttcg

SEQ ID NO: 984061 - DNA, 25 bp, Mus musculus
tgtgtgtcgcacgacagctgcctgt

SEQ ID NO: 984062 - DNA, 25 bp, Mus musculus
tgtgtgtcgcacgacgtggactcac

SEQ ID NO: 984063 - DNA, 25 bp, Mus musculus
tgtgtgtcgcacgagagctgcctgt

SEQ ID NO: 984064 - DNA, 25 bp, Mus musculus
tgtgtgtcgcacgaggtggactcac

SEQ ID NO: 984065 - DNA, 25 bp, Mus musculus
tgtgtgtcggagaggctggtccagg

SEQ ID NO: 984066 - DNA, 25 bp, Mus musculus
tgtgtgtcggagcctccgaagtagc

SEQ ID NO: 984067 - DNA, 25 bp, Mus musculus
tgtgtgtcggaggctccgaagtagc

SEQ ID NO: 984068 - DNA, 25 bp, Mus musculus
tgtgtgtcggagtggctggtccagg

SEQ ID NO: 984069 - DNA, 25 bp, Mus musculus
tgtgtgtctgcctcgtgcctcaatg

SEQ ID NO: 984070 - DNA, 25 bp, Mus musculus
tgtgtgtctgccttatggtagcatc

SEQ ID NO: 984071 - DNA, 25 bp, Mus musculus
tgtgtgtctgcgagaagatgaccag

SEQ ID NO: 984072 - DNA, 25 bp, Mus musculus
tgtgtgtctggctcgtgcctcaatg

SEQ ID NO: 984073 - DNA, 25 bp, Mus musculus
tgtgtgtctggcttatggtagcatc

SEQ ID NO: 984074 - DNA, 25 bp, Mus musculus
tgtgtgtctgggagaagatgaccag

SEQ ID NO: 984075 - DNA, 25 bp, Mus musculus
tgtgtgtgacagccccacagagcaa

SEQ ID NO: 984076 - DNA, 25 bp, Mus musculus
tgtgtgtgacaggcccacagagcaa

SEQ ID NO: 984077 - DNA, 25 bp, Mus musculus
tgtgtgtgacgaaacgtctgtcacc

SEQ ID NO: 984078 - DNA, 25 bp, Mus musculus
tgtgtgtgacgaaaggtctgtcacc

SEQ ID NO: 984079 - DNA, 25 bp, Mus musculus
tgtgtgtgagaaccgtcgtcgcgtt

SEQ ID NO: 984080 - DNA, 25 bp, Mus musculus
tgtgtgtgagaccagaaccgtcgtc

SEQ ID NO: 984081 - DNA, 25 bp, Mus musculus
tgtgtgtgagcaggttccccctgga

SEQ ID NO: 984082 - DNA, 25 bp, Mus musculus
tgtgtgtgaggaggttccccctgga

SEQ ID NO: 984083 - DNA, 25 bp, Mus musculus
tgtgtgtgagtaccgtcgtcgcgtt

SEQ ID NO: 984084 - DNA, 25 bp, Mus musculus
tgtgtgtgagtccagaaccgtcgtc

SEQ ID NO: 984085 - DNA, 25 bp, Mus musculus
tgtgtgtgcgatggagtttgcagtg

SEQ ID NO: 984086 - DNA, 25 bp, Mus musculus
tgtgtgtgcgttggagtttgcagtg

SEQ ID NO: 984087 - DNA, 25 bp, Mus musculus
tgtgtgtgtgtgagcgcgcgcaagc

SEQ ID NO: 984088 - DNA, 25 bp, Mus musculus
tgtgtgtgtgtgtgagcgcgcgcaa

SEQ ID NO: 984089 - DNA, 25 bp, Mus musculus
tgtgtgtgtgtgtgcgcgcgcaagc

SEQ ID NO: 984090 - DNA, 25 bp, Mus musculus
tgtgtgtgtgtgtgtgcgcgcgcaa

SEQ ID NO: 984091 - DNA, 25 bp, Mus musculus
tgtgtgttattgcactctgggcttg

SEQ ID NO: 984092 - DNA, 25 bp, Mus musculus
tgtgtgttattggactctgggcttg

SEQ ID NO: 984093 - DNA, 25 bp, Mus musculus
tgtgtgtttggacaacccagattcc

SEQ ID NO: 984094 - DNA, 25 bp, Mus musculus
tgtgtgtttggagaacccagattcc

SEQ ID NO: 984095 - DNA, 25 bp, Mus musculus
tgtgttactgagcgactttgtaaac

SEQ ID NO: 984096 - DNA, 25 bp, Mus musculus
tgtgttactgagggactttgtaaac

SEQ ID NO: 984097 - DNA, 25 bp, Mus musculus
tgtgttagagcttcgaagccgagat

SEQ ID NO: 984098 - DNA, 25 bp, Mus musculus
tgtgttagaggttcgaagccgagat

SEQ ID NO: 984099 - DNA, 25 bp, Mus musculus
tgtgttatgtggaacgctggattct

SEQ ID NO: 984100 - DNA, 25 bp, Mus musculus
tgtgttatgtggaaggctggattct

SEQ ID NO: 984101 - DNA, 25 bp, Mus musculus
tgtgttattgcactctgggcttgta

SEQ ID NO: 984102 - DNA, 25 bp, Mus musculus
tgtgttattggactctgggcttgta

SEQ ID NO: 984103 - DNA, 25 bp, Mus musculus
tgtgttcaagcctgcaaattgggag

SEQ ID NO: 984104 - DNA, 25 bp, Mus musculus
tgtgttcaaggctgcaaattgggag

SEQ ID NO: 984105 - DNA, 25 bp, Mus musculus
tgtgttcaatggcaatgttaccaat

SEQ ID NO: 984106 - DNA, 25 bp, Mus musculus
tgtgttcaatggcattgttaccaat

SEQ ID NO: 984107 - DNA, 25 bp, Mus musculus
tgtgttcacggcaatgacatcacgc

SEQ ID NO: 984108 - DNA, 25 bp, Mus musculus
tgtgttcacggctatgacatcacgc

SEQ ID NO: 984109 - DNA, 25 bp, Mus musculus
tgtgttctagactcaagaatgaata

SEQ ID NO: 984110 - DNA, 25 bp, Mus musculus
tgtgttctagtctcaagaatgaata

SEQ ID NO: 984111 - DNA, 25 bp, Mus musculus
tgtgttctgagctgccttgctgccc

SEQ ID NO: 984112 - DNA, 25 bp, Mus musculus
tgtgttctgagctggcttgctgccc

SEQ ID NO: 984113 - DNA, 25 bp, Mus musculus
tgtgttctgtagattcgagtaagag

SEQ ID NO: 984114 - DNA, 25 bp, Mus musculus
tgtgttctgtagtttcgagtaagag

SEQ ID NO: 984115 - DNA, 25 bp, Mus musculus
tgtgttgaagctgcaggaccagaca

SEQ ID NO: 984116 - DNA, 25 bp, Mus musculus
tgtgttgaaggtgcaggaccagaca

SEQ ID NO: 984117 - DNA, 25 bp, Mus musculus
tgtgttgaggagcccaccgcaacga

SEQ ID NO: 984118 - DNA, 25 bp, Mus musculus
tgtgttgaggtgcccaccgcaacga

SEQ ID NO: 984119 - DNA, 25 bp, Mus musculus
tgtgttggagatgacatcaccatgg

SEQ ID NO: 984120 - DNA, 25 bp, Mus musculus
tgtgttggagcatgatggcagccaa

SEQ ID NO: 984121 - DNA, 25 bp, Mus musculus
tgtgttggagctcctggatgacagg

SEQ ID NO: 984122 - DNA, 25 bp, Mus musculus
tgtgttggaggatgatggcagccaa

SEQ ID NO: 984123 - DNA, 25 bp, Mus musculus
tgtgttggaggtcctggatgacagg

SEQ ID NO: 984124 - DNA, 25 bp, Mus musculus
tgtgttggagttgacatcaccatgg

SEQ ID NO: 984125 - DNA, 25 bp, Mus musculus
tgtgttggcaagagagatgaagatg

SEQ ID NO: 984126 - DNA, 25 bp, Mus musculus
tgtgttggcaagaggccacagcact

SEQ ID NO: 984127 - DNA, 25 bp, Mus musculus
tgtgttggcaagtgagatgaagatg

SEQ ID NO: 984128 - DNA, 25 bp, Mus musculus
tgtgttggcaagtggccacagcact

SEQ ID NO: 984129 - DNA, 25 bp, Mus musculus
tgtgttggctcacgagggtgtgaag

SEQ ID NO: 984130 - DNA, 25 bp, Mus musculus
tgtgttggctcaggagggtgtgaag

SEQ ID NO: 984131 - DNA, 25 bp, Mus musculus
tgtgttgtctcgcttcctagtttct

SEQ ID NO: 984132 - DNA, 25 bp, Mus musculus
tgtgttgtctcggttcctagtttct

SEQ ID NO: 984133 - DNA, 25 bp, Mus musculus
tgtgtttcctctggcatatcagtac

SEQ ID NO: 984134 - DNA, 25 bp, Mus musculus
tgtgtttcctctgggatatcagtac

SEQ ID NO: 984135 - DNA, 25 bp, Mus musculus
tgtgtttcgtcagaaggtggaaatg

SEQ ID NO: 984136 - DNA, 25 bp, Mus musculus
tgtgtttcgtcagatggtggaaatg

SEQ ID NO: 984137 - DNA, 25 bp, Mus musculus
tgtgtttgagcagatttctaatagc

SEQ ID NO: 984138 - DNA, 25 bp, Mus musculus
tgtgtttgaggagatttctaatagc

SEQ ID NO: 984139 - DNA, 25 bp, Mus musculus
tgtgtttgctagagggcaatgcgag

SEQ ID NO: 984140 - DNA, 25 bp, Mus musculus
tgtgtttgctagtgggcaatgcgag

SEQ ID NO: 984141 - DNA, 25 bp, Mus musculus
tgtgtttgtgcacgcggccctggcc

SEQ ID NO: 984142 - DNA, 25 bp, Mus musculus
tgtgtttgtgcaggcggccctggcc

SEQ ID NO: 984143 - DNA, 25 bp, Mus musculus
tgtgtttgtgctcctccactctttt

SEQ ID NO: 984144 - DNA, 25 bp, Mus musculus
tgtgtttgtgctctttgctgattct

SEQ ID NO: 984145 - DNA, 25 bp, Mus musculus
tgtgtttgtggtcctccactctttt

SEQ ID NO: 984146 - DNA, 25 bp, Mus musculus
tgtgtttgtggtctttgctgattct

SEQ ID NO: 984147 - DNA, 25 bp, Mus musculus
tgttaaaccgatcttcggaggatgt

SEQ ID NO: 984148 - DNA, 25 bp, Mus musculus
tgttaaaccgttcttcggaggatgt

SEQ ID NO: 984149 - DNA, 25 bp, Mus musculus
tgttaaacctagggatgatgagact

SEQ ID NO: 984150 - DNA, 25 bp, Mus musculus
tgttaaaccttgggatgatgagact

SEQ ID NO: 984151 - DNA, 25 bp, Mus musculus
tgttaaagccaacggccattctctt

SEQ ID NO: 984152 - DNA, 25 bp, Mus musculus
tgttaaagccaagggccattctctt

SEQ ID NO: 984153 - DNA, 25 bp, Mus musculus
tgttaaagggccgatgggcgccagg

SEQ ID NO: 984154 - DNA, 25 bp, Mus musculus
tgttaaaggggcgatgggcgccagg

SEQ ID NO: 984155 - DNA, 25 bp, Mus musculus
tgttaacaatacattgcatctggat

SEQ ID NO: 984156 - DNA, 25 bp, Mus musculus
tgttaacaattcattgcatctggat

SEQ ID NO: 984157 - DNA, 25 bp, Mus musculus
tgttaagaagcaaatgatccggcta

SEQ ID NO: 984158 - DNA, 25 bp, Mus musculus
tgttaagaaggaaatgatccggcta

SEQ ID NO: 984159 - DNA, 25 bp, Mus musculus
tgttaagacaatcacggcaagaaaa

SEQ ID NO: 984160 - DNA, 25 bp, Mus musculus
tgttaagacaatcagggcaagaaaa

SEQ ID NO: 984161 - DNA, 25 bp, Mus musculus
tgttaagattcgctggtatatttga

SEQ ID NO: 984162 - DNA, 25 bp, Mus musculus
tgttaagattcggtggtatatttga

SEQ ID NO: 984163 - DNA, 25 bp, Mus musculus
tgttaatgagaacggagccttctgg

SEQ ID NO: 984164 - DNA, 25 bp, Mus musculus
tgttaatgagaagggagccttctgg

SEQ ID NO: 984165 - DNA, 25 bp, Mus musculus
tgttaattcaggctcctcatcctaa

SEQ ID NO: 984166 - DNA, 25 bp, Mus musculus
tgttaattcaggctgctcatcctaa

SEQ ID NO: 984167 - DNA, 25 bp, Mus musculus
tgttacaaagattatacgagaaaat

SEQ ID NO: 984168 - DNA, 25 bp, Mus musculus
tgttacaaagtttatacgagaaaat

SEQ ID NO: 984169 - DNA, 25 bp, Mus musculus
tgttacagaccccgacagcatatgg

SEQ ID NO: 984170 - DNA, 25 bp, Mus musculus
tgttacagacgccgacagcatatgg

SEQ ID NO: 984171 - DNA, 25 bp, Mus musculus
tgttaccaagcctgcagagaagcag

SEQ ID NO: 984172 - DNA, 25 bp, Mus musculus
tgttaccaaggctgcagagaagcag

SEQ ID NO: 984173 - DNA, 25 bp, Mus musculus
tgttactaacagcaagttcaatgtc

SEQ ID NO: 984174 - DNA, 25 bp, Mus musculus
tgttactaacaggaagttcaatgtc

SEQ ID NO: 984175 - DNA, 25 bp, Mus musculus
tgttactatgtttacggcagtgctt

SEQ ID NO: 984176 - DNA, 25 bp, Mus musculus
tgttactatgtttagggcagtgctt

SEQ ID NO: 984177 - DNA, 25 bp, Mus musculus
tgttactgagaacgtcctggcggct

SEQ ID NO: 984178 - DNA, 25 bp, Mus musculus
tgttactgagaaggtcctggcggct

SEQ ID NO: 984179 - DNA, 25 bp, Mus musculus
tgttactgagcgactttgtaaacag

SEQ ID NO: 984180 - DNA, 25 bp, Mus musculus
tgttactgagggactttgtaaacag

SEQ ID NO: 984181 - DNA, 25 bp, Mus musculus
tgttactgtccaggagacacaatgt

SEQ ID NO: 984182 - DNA, 25 bp, Mus musculus
tgttactgtccaggtgacacaatgt

SEQ ID NO: 984183 - DNA, 25 bp, Mus musculus
tgttagaaacaaatcggatggaaga

SEQ ID NO: 984184 - DNA, 25 bp, Mus musculus
tgttagaaacaaatcgtgaagaaga

SEQ ID NO: 984185 - DNA, 25 bp, Mus musculus
tgttagaaacaaatgggatggaaga

SEQ ID NO: 984186 - DNA, 25 bp, Mus musculus
tgttagaaacaaatggtgaagaaga

SEQ ID NO: 984187 - DNA, 25 bp, Mus musculus
tgttagacattgcatgccgccttgg

SEQ ID NO: 984188 - DNA, 25 bp, Mus musculus
tgttagacattgcctgcggttctgg

SEQ ID NO: 984189 - DNA, 25 bp, Mus musculus
tgttagacattggatgccgccttgg

SEQ ID NO: 984190 - DNA, 25 bp, Mus musculus
tgttagacattggctgcggttctgg

SEQ ID NO: 984191 - DNA, 25 bp, Mus musculus
tgttagagagctggcagaaagcgac

SEQ ID NO: 984192 - DNA, 25 bp, Mus musculus
tgttagagaggtggcagaaagcgac

SEQ ID NO: 984193 - DNA, 25 bp, Mus musculus
tgttagcaaattctctgtctgctca

SEQ ID NO: 984194 - DNA, 25 bp, Mus musculus
tgttagcaaattgtctgtctgctca

SEQ ID NO: 984195 - DNA, 25 bp, Mus musculus
tgttagtcagagccacctgtataga

SEQ ID NO: 984196 - DNA, 25 bp, Mus musculus
tgttagtcagtgccacctgtataga

SEQ ID NO: 984197 - DNA, 25 bp, Mus musculus
tgttagtctcagagcatagctctct

SEQ ID NO: 984198 - DNA, 25 bp, Mus musculus
tgttagtctcagaggatagctctct

SEQ ID NO: 984199 - DNA, 25 bp, Mus musculus
tgttatacctcccgcttatacaact

SEQ ID NO: 984200 - DNA, 25 bp, Mus musculus
tgttatacctccggcttatacaact

SEQ ID NO: 984201 - DNA, 25 bp, Mus musculus
tgttatatcaagtctccgacacagc

SEQ ID NO: 984202 - DNA, 25 bp, Mus musculus
tgttatatcatgtctccgacacagc

SEQ ID NO: 984203 - DNA, 25 bp, Mus musculus
tgttatcagaagccccaacttgaat

SEQ ID NO: 984204 - DNA, 25 bp, Mus musculus
tgttatcagaaggcccaacttgaat

SEQ ID NO: 984205 - DNA, 25 bp, Mus musculus
tgttatctcactatcctttgtgaga

SEQ ID NO: 984206 - DNA, 25 bp, Mus musculus
tgttatctcactttcctttgtgaga

SEQ ID NO: 984207 - DNA, 25 bp, Mus musculus
tgttatgtggaacgctggattcttt

SEQ ID NO: 984208 - DNA, 25 bp, Mus musculus
tgttatgtggaaggctggattcttt

SEQ ID NO: 984209 - DNA, 25 bp, Mus musculus
tgttattctggactccccacccaaa

SEQ ID NO: 984210 - DNA, 25 bp, Mus musculus
tgttattctggagtccccacccaaa

SEQ ID NO: 984211 - DNA, 25 bp, Mus musculus
tgttattgaaagcgtatgaatctcc

SEQ ID NO: 984212 - DNA, 25 bp, Mus musculus
tgttattgaaagctgacattcccac

SEQ ID NO: 984213 - DNA, 25 bp, Mus musculus
tgttattgaaagggtatgaatctcc

SEQ ID NO: 984214 - DNA, 25 bp, Mus musculus
tgttattgaaaggtgacattcccac

SEQ ID NO: 984215 - DNA, 25 bp, Mus musculus
tgttattgtagacacgtactggcat

SEQ ID NO: 984216 - DNA, 25 bp, Mus musculus
tgttattgtagacaggtactggcat

SEQ ID NO: 984217 - DNA, 25 bp, Mus musculus
tgttcaaaacctatgatgctggaag

SEQ ID NO: 984218 - DNA, 25 bp, Mus musculus
tgttcaaaacgtatgatgctggaag

SEQ ID NO: 984219 - DNA, 25 bp, Mus musculus
tgttcaaaagagcatgggctcacaa

SEQ ID NO: 984220 - DNA, 25 bp, Mus musculus
tgttcaaaagccaccccagagacag

SEQ ID NO: 984221 - DNA, 25 bp, Mus musculus
tgttcaaaaggcaccccagagacag

SEQ ID NO: 984222 - DNA, 25 bp, Mus musculus
tgttcaaaagtgcatgggctcacaa

SEQ ID NO: 984223 - DNA, 25 bp, Mus musculus
tgttcaaaatcgaacaccaaacagc

SEQ ID NO: 984224 - DNA, 25 bp, Mus musculus
tgttcaaaatggaacaccaaacagc

SEQ ID NO: 984225 - DNA, 25 bp, Mus musculus
tgttcaaaccaacagtggcctccct

SEQ ID NO: 984226 - DNA, 25 bp, Mus musculus
tgttcaaaccaagagtggcctccct

SEQ ID NO: 984227 - DNA, 25 bp, Mus musculus
tgttcaaccctgactctaaggggct

SEQ ID NO: 984228 - DNA, 25 bp, Mus musculus
tgttcaaccctgtctctaaggggct

SEQ ID NO: 984229 - DNA, 25 bp, Mus musculus
tgttcaagcaagaacgcacttgcta

SEQ ID NO: 984230 - DNA, 25 bp, Mus musculus
tgttcaagcaagaaggcacttgcta

SEQ ID NO: 984231 - DNA, 25 bp, Mus musculus
tgttcaatggcaatgttaccaatca

SEQ ID NO: 984232 - DNA, 25 bp, Mus musculus
tgttcaatggcattgttaccaatca

SEQ ID NO: 984233 - DNA, 25 bp, Mus musculus
tgttcacatcagcacgaacgtcatc

SEQ ID NO: 984234 - DNA, 25 bp, Mus musculus
tgttcacatcagcactgcctgcaga

SEQ ID NO: 984235 - DNA, 25 bp, Mus musculus
tgttcacatcagcaggaacgtcatc

SEQ ID NO: 984236 - DNA, 25 bp, Mus musculus
tgttcacatcagcagtgcctgcaga

SEQ ID NO: 984237 - DNA, 25 bp, Mus musculus
tgttcacctatgcctgcacgtggga

SEQ ID NO: 984238 - DNA, 25 bp, Mus musculus
tgttcacctatggctgcacgtggga

SEQ ID NO: 984239 - DNA, 25 bp, Mus musculus
tgttcacctcagatgcctgtggtct

SEQ ID NO: 984240 - DNA, 25 bp, Mus musculus
tgttcacctcagttgcctgtggtct

SEQ ID NO: 984241 - DNA, 25 bp, Mus musculus
tgttcactcagacgcagccatggaa

SEQ ID NO: 984242 - DNA, 25 bp, Mus musculus
tgttcactcagaggcagccatggaa

SEQ ID NO: 984243 - DNA, 25 bp, Mus musculus
tgttcacttcagctattgacctcat

SEQ ID NO: 984244 - DNA, 25 bp, Mus musculus
tgttcacttcagctgtggacctcgt

SEQ ID NO: 984245 - DNA, 25 bp, Mus musculus
tgttcacttcaggtattgacctcat

SEQ ID NO: 984246 - DNA, 25 bp, Mus musculus
tgttcacttcaggtgtggacctcgt

SEQ ID NO: 984247 - DNA, 25 bp, Mus musculus
tgttcagaagaaaacatgatggagt

SEQ ID NO: 984248 - DNA, 25 bp, Mus musculus
tgttcagaagaaaagatgatggagt

SEQ ID NO: 984249 - DNA, 25 bp, Mus musculus
tgttcagacgtgctctggacagctc

SEQ ID NO: 984250 - DNA, 25 bp, Mus musculus
tgttcagacgtggtctggacagctc

SEQ ID NO: 984251 - DNA, 25 bp, Mus musculus
tgttcagcagaatattcaacagaac

SEQ ID NO: 984252 - DNA, 25 bp, Mus musculus
tgttcagcagctccagtgtcccatg

SEQ ID NO: 984253 - DNA, 25 bp, Mus musculus
tgttcagcaggtccagtgtcccatg

SEQ ID NO: 984254 - DNA, 25 bp, Mus musculus
tgttcagcagtatattcaacagaac

SEQ ID NO: 984255 - DNA, 25 bp, Mus musculus
tgttcagcccagacacagctgtggt

SEQ ID NO: 984256 - DNA, 25 bp, Mus musculus
tgttcagcccagtcacagctgtggt

SEQ ID NO: 984257 - DNA, 25 bp, Mus musculus
tgttcaggagcttgcagaaggagct

SEQ ID NO: 984258 - DNA, 25 bp, Mus musculus
tgttcaggaggttgcagaaggagct

SEQ ID NO: 984259 - DNA, 25 bp, Mus musculus
tgttcagtcagaagatgactcaggc

SEQ ID NO: 984260 - DNA, 25 bp, Mus musculus
tgttcagtcagatgatgactcaggc

SEQ ID NO: 984261 - DNA, 25 bp, Mus musculus
tgttcatcgataccctgatgcaatt

SEQ ID NO: 984262 - DNA, 25 bp, Mus musculus
tgttcatcgataccgtgatgcaatt

SEQ ID NO: 984263 - DNA, 25 bp, Mus musculus
tgttccacaagatacgagtaggtgc

SEQ ID NO: 984264 - DNA, 25 bp, Mus musculus
tgttccacaagataggagtaggtgc

SEQ ID NO: 984265 - DNA, 25 bp, Mus musculus
tgttccactccctctttgccattgg

SEQ ID NO: 984266 - DNA, 25 bp, Mus musculus
tgttccactccgatcaagtttgtgg

SEQ ID NO: 984267 - DNA, 25 bp, Mus musculus
tgttccactcgctctttgccattgg

SEQ ID NO: 984268 - DNA, 25 bp, Mus musculus
tgttccactcggatcaagtttgtgg

SEQ ID NO: 984269 - DNA, 25 bp, Mus musculus
tgttccagaggacgtactacaagcc

SEQ ID NO: 984270 - DNA, 25 bp, Mus musculus
tgttccagaggaggtactacaagcc

SEQ ID NO: 984271 - DNA, 25 bp, Mus musculus
tgttccagcgcacctttgaaccaga

SEQ ID NO: 984272 - DNA, 25 bp, Mus musculus
tgttccagcgcagctttgaaccaga

SEQ ID NO: 984273 - DNA, 25 bp, Mus musculus
tgttccagtctacacacacctgcta

SEQ ID NO: 984274 - DNA, 25 bp, Mus musculus
tgttccagtctacagacacctgcta

SEQ ID NO: 984275 - DNA, 25 bp, Mus musculus
tgttccatcccaacatctatcctga

SEQ ID NO: 984276 - DNA, 25 bp, Mus musculus
tgttccatcccaacttctatcctga

SEQ ID NO: 984277 - DNA, 25 bp, Mus musculus
tgttcccaggcaaattccatcaagc

SEQ ID NO: 984278 - DNA, 25 bp, Mus musculus
tgttcccagggaaattccatcaagc

SEQ ID NO: 984279 - DNA, 25 bp, Mus musculus
tgttccgagaaacgtgataattgat

SEQ ID NO: 984280 - DNA, 25 bp, Mus musculus
tgttccgagaaaggtgataattgat

SEQ ID NO: 984281 - DNA, 25 bp, Mus musculus
tgttccgcgacgcccgtgccttcgc

SEQ ID NO: 984282 - DNA, 25 bp, Mus musculus
tgttccgcgacgccggtgccttcgc

SEQ ID NO: 984283 - DNA, 25 bp, Mus musculus
tgttccgtcggaagcctctcttctg

SEQ ID NO: 984284 - DNA, 25 bp, Mus musculus
tgttccgtcggatgcctctcttctg

SEQ ID NO: 984285 - DNA, 25 bp, Mus musculus
tgttcctccagggaccctatgacac

SEQ ID NO: 984286 - DNA, 25 bp, Mus musculus
tgttcctccagggagcctatgacac

SEQ ID NO: 984287 - DNA, 25 bp, Mus musculus
tgttcctgccagactgggtttgtca

SEQ ID NO: 984288 - DNA, 25 bp, Mus musculus
tgttcctgccagtctgggtttgtca

SEQ ID NO: 984289 - DNA, 25 bp, Mus musculus
tgttcctgggagatcgtatgggcgt

SEQ ID NO: 984290 - DNA, 25 bp, Mus musculus
tgttcctgggagatggtatgggcgt

SEQ ID NO: 984291 - DNA, 25 bp, Mus musculus
tgttcgagagaaaacgaggttggaa

SEQ ID NO: 984292 - DNA, 25 bp, Mus musculus
tgttcgagagaaaaggaggttggaa

SEQ ID NO: 984293 - DNA, 25 bp, Mus musculus
tgttcgaggacacgtgtccttttat

SEQ ID NO: 984294 - DNA, 25 bp, Mus musculus
tgttcgaggacaggtgtccttttat

SEQ ID NO: 984295 - DNA, 25 bp, Mus musculus
tgttcgtctttgcgggctatactgg

SEQ ID NO: 984296 - DNA, 25 bp, Mus musculus
tgttcgtctttgggggctatactgg

SEQ ID NO: 984297 - DNA, 25 bp, Mus musculus
tgttcgtgagcattagtgatcagaa

SEQ ID NO: 984298 - DNA, 25 bp, Mus musculus
tgttcgtgaggattagtgatcagaa

SEQ ID NO: 984299 - DNA, 25 bp, Mus musculus
tgttcgtgcgctcttttgatggatt

SEQ ID NO: 984300 - DNA, 25 bp, Mus musculus
tgttcgtgcggtcttttgatggatt

SEQ ID NO: 984301 - DNA, 25 bp, Mus musculus
tgttcgtgtgtctccgtaacatttg

SEQ ID NO: 984302 - DNA, 25 bp, Mus musculus
tgttcgtgtgtctcggtaacatttg

SEQ ID NO: 984303 - DNA, 25 bp, Mus musculus
tgttctacacatcatagaagatgga

SEQ ID NO: 984304 - DNA, 25 bp, Mus musculus
tgttctacacatgatagaagatgga

SEQ ID NO: 984305 - DNA, 25 bp, Mus musculus
tgttctataaaagaccatgggtaca

SEQ ID NO: 984306 - DNA, 25 bp, Mus musculus
tgttctataaaagacgtatatatta

SEQ ID NO: 984307 - DNA, 25 bp, Mus musculus
tgttctataaaagagcatgggtaca

SEQ ID NO: 984308 - DNA, 25 bp, Mus musculus
tgttctataaaagaggtatatatta

SEQ ID NO: 984309 - DNA, 25 bp, Mus musculus
tgttctattggtcgaatccatgaag

SEQ ID NO: 984310 - DNA, 25 bp, Mus musculus
tgttctattggtggaatccatgaag

SEQ ID NO: 984311 - DNA, 25 bp, Mus musculus
tgttctcatcctcacatatcagcct

SEQ ID NO: 984312 - DNA, 25 bp, Mus musculus
tgttctcatcctcagatatcagcct

SEQ ID NO: 984313 - DNA, 25 bp, Mus musculus
tgttctcccgcacgagggatctgat

SEQ ID NO: 984314 - DNA, 25 bp, Mus musculus
tgttctcccggacgagggatctgat

SEQ ID NO: 984315 - DNA, 25 bp, Mus musculus
tgttctcttggacttctgacgggaa

SEQ ID NO: 984316 - DNA, 25 bp, Mus musculus
tgttctcttggagttctgacgggaa

SEQ ID NO: 984317 - DNA, 25 bp, Mus musculus
tgttctgaaactgcttcagatctgc

SEQ ID NO: 984318 - DNA, 25 bp, Mus musculus
tgttctgaaagtctgccccgattca

SEQ ID NO: 984319 - DNA, 25 bp, Mus musculus
tgttctgaaagtgcttcagatctgc

SEQ ID NO: 984320 - DNA, 25 bp, Mus musculus
tgttctgaaagtgtgccccgattca

SEQ ID NO: 984321 - DNA, 25 bp, Mus musculus
tgttctgagctgccttgctgcccat

SEQ ID NO: 984322 - DNA, 25 bp, Mus musculus
tgttctgagctggcttgctgcccat

SEQ ID NO: 984323 - DNA, 25 bp, Mus musculus
tgttctgatctgcgtttggacaaag

SEQ ID NO: 984324 - DNA, 25 bp, Mus musculus
tgttctgatctgggtttggacaaag

SEQ ID NO: 984325 - DNA, 25 bp, Mus musculus
tgttctgcagctacatttgtcaagg

SEQ ID NO: 984326 - DNA, 25 bp, Mus musculus
tgttctgcaggtacatttgtcaagg

SEQ ID NO: 984327 - DNA, 25 bp, Mus musculus
tgttctgtagattcgagtaagagta

SEQ ID NO: 984328 - DNA, 25 bp, Mus musculus
tgttctgtagtttcgagtaagagta

SEQ ID NO: 984329 - DNA, 25 bp, Mus musculus
tgttctgtatccttcctgcgggcac

SEQ ID NO: 984330 - DNA, 25 bp, Mus musculus
tgttctgtatgcttcctgcgggcac

SEQ ID NO: 984331 - DNA, 25 bp, Mus musculus
tgttctgtgcaaactgggtcgctgc

SEQ ID NO: 984332 - DNA, 25 bp, Mus musculus
tgttctgtgcaatctgggtcgctgc

SEQ ID NO: 984333 - DNA, 25 bp, Mus musculus
tgttctgtgctgccttcaaggtgaa

SEQ ID NO: 984334 - DNA, 25 bp, Mus musculus
tgttctgtgctggcttcaaggtgaa

SEQ ID NO: 984335 - DNA, 25 bp, Mus musculus
tgttcttcccagcctcctggtggat

SEQ ID NO: 984336 - DNA, 25 bp, Mus musculus
tgttcttcccaggctcctggtggat

SEQ ID NO: 984337 - DNA, 25 bp, Mus musculus
tgttcttgatatacatgataatcag

SEQ ID NO: 984338 - DNA, 25 bp, Mus musculus
tgttcttgatccataacaaactgaa

SEQ ID NO: 984339 - DNA, 25 bp, Mus musculus
tgttcttgatgcataacaaactgaa

SEQ ID NO: 984340 - DNA, 25 bp, Mus musculus
tgttcttgatttacatgataatcag

SEQ ID NO: 984341 - DNA, 25 bp, Mus musculus
tgttcttggaggagggcaatgcgag

SEQ ID NO: 984342 - DNA, 25 bp, Mus musculus
tgttcttggaggtgggcaatgcgag

SEQ ID NO: 984343 - DNA, 25 bp, Mus musculus
tgttgaaaagcacgccttcaaacaa

SEQ ID NO: 984344 - DNA, 25 bp, Mus musculus
tgttgaaaagcaggccttcaaacaa

SEQ ID NO: 984345 - DNA, 25 bp, Mus musculus
tgttgaacagctctcggtgctgcag

SEQ ID NO: 984346 - DNA, 25 bp, Mus musculus
tgttgaacaggtctcggtgctgcag

SEQ ID NO: 984347 - DNA, 25 bp, Mus musculus
tgttgaccgaaaccacagccatctt

SEQ ID NO: 984348 - DNA, 25 bp, Mus musculus
tgttgaccgaaagcacagccatctt

SEQ ID NO: 984349 - DNA, 25 bp, Mus musculus
tgttgagaatcttccgcggcaggcc

SEQ ID NO: 984350 - DNA, 25 bp, Mus musculus
tgttgagaatcttcggcggcaggcc

SEQ ID NO: 984351 - DNA, 25 bp, Mus musculus
tgttgagacccacgtactaaatcaa

SEQ ID NO: 984352 - DNA, 25 bp, Mus musculus
tgttgagacccaggtactaaatcaa

SEQ ID NO: 984353 - DNA, 25 bp, Mus musculus
tgttgagctactcacgcctgcctac

SEQ ID NO: 984354 - DNA, 25 bp, Mus musculus
tgttgagctactcacgtcaaggctt

SEQ ID NO: 984355 - DNA, 25 bp, Mus musculus
tgttgagctactcaggcctgcctac

SEQ ID NO: 984356 - DNA, 25 bp, Mus musculus
tgttgagctactcaggtcaaggctt

SEQ ID NO: 984357 - DNA, 25 bp, Mus musculus
tgttgcaagacaaccatccttccgt

SEQ ID NO: 984358 - DNA, 25 bp, Mus musculus
tgttgcaagagaaccatccttccgt

SEQ ID NO: 984359 - DNA, 25 bp, Mus musculus
tgttgcacagaaaaaattacaagat

SEQ ID NO: 984360 - DNA, 25 bp, Mus musculus
tgttgcacagtaaaaattacaagat

SEQ ID NO: 984361 - DNA, 25 bp, Mus musculus
tgttgcactgcccatcatcaacagc

SEQ ID NO: 984362 - DNA, 25 bp, Mus musculus
tgttgcactggccatcatcaacagc

SEQ ID NO: 984363 - DNA, 25 bp, Mus musculus
tgttgccaaattcgctccacttacc

SEQ ID NO: 984364 - DNA, 25 bp, Mus musculus
tgttgccaaattggctccacttacc

SEQ ID NO: 984365 - DNA, 25 bp, Mus musculus
tgttgccaacaacgctacgctgtgt

SEQ ID NO: 984366 - DNA, 25 bp, Mus musculus
tgttgccaacaaggctacgctgtgt

SEQ ID NO: 984367 - DNA, 25 bp, Mus musculus
tgttgcccagcttctcctgtgtgtt

SEQ ID NO: 984368 - DNA, 25 bp, Mus musculus
tgttgcccaggttctcctgtgtgtt

SEQ ID NO: 984369 - DNA, 25 bp, Mus musculus
tgttgcccggtgttcgacatatgaa

SEQ ID NO: 984370 - DNA, 25 bp, Mus musculus
tgttgcccggtgttggacatatgaa

SEQ ID NO: 984371 - DNA, 25 bp, Mus musculus
tgttgccgtgacctttgcagatcaa

SEQ ID NO: 984372 - DNA, 25 bp, Mus musculus
tgttgccgtgtcctttgcagatcaa

SEQ ID NO: 984373 - DNA, 25 bp, Mus musculus
tgttgcctaaaaccatgaatagact

SEQ ID NO: 984374 - DNA, 25 bp, Mus musculus
tgttgcctaataccatgaatagact

SEQ ID NO: 984375 - DNA, 25 bp, Mus musculus
tgttgcgacaaggtcaaggagatca

SEQ ID NO: 984376 - DNA, 25 bp, Mus musculus
tgttgcgacatggtcaaggagatca

SEQ ID NO: 984377 - DNA, 25 bp, Mus musculus
tgttgcgagctctgcttgctggttg

SEQ ID NO: 984378 - DNA, 25 bp, Mus musculus
tgttgcgagctctggttgctggttg

SEQ ID NO: 984379 - DNA, 25 bp, Mus musculus
tgttgctaaagccgctattaaatcc

SEQ ID NO: 984380 - DNA, 25 bp, Mus musculus
tgttgctaaagcggctattaaatcc

SEQ ID NO: 984381 - DNA, 25 bp, Mus musculus
tgttgctaagcacaaggcctgtagt

SEQ ID NO: 984382 - DNA, 25 bp, Mus musculus
tgttgctaaggacaaggcctgtagt

SEQ ID NO: 984383 - DNA, 25 bp, Mus musculus
tgttgctatgcacaccgagtttcca

SEQ ID NO: 984384 - DNA, 25 bp, Mus musculus
tgttgctatggacaccgagtttcca

SEQ ID NO: 984385 - DNA, 25 bp, Mus musculus
tgttgctctgacgatcctgaccgtc

SEQ ID NO: 984386 - DNA, 25 bp, Mus musculus
tgttgctctgtcgatcctgaccgtc

SEQ ID NO: 984387 - DNA, 25 bp, Mus musculus
tgttgctgctcactcgattgctggt

SEQ ID NO: 984388 - DNA, 25 bp, Mus musculus
tgttgctgctcactggattgctggt

SEQ ID NO: 984389 - DNA, 25 bp, Mus musculus
tgttgctgctggcgtctgcgagctt

SEQ ID NO: 984390 - DNA, 25 bp, Mus musculus
tgttgctgctggggtctgcgagctt

SEQ ID NO: 984391 - DNA, 25 bp, Mus musculus
tgttgctggacacaaccggatccag

SEQ ID NO: 984392 - DNA, 25 bp, Mus musculus
tgttgctggagacaaccggatccag

SEQ ID NO: 984393 - DNA, 25 bp, Mus musculus
tgttgctgtcagcaacccatgtgat

SEQ ID NO: 984394 - DNA, 25 bp, Mus musculus
tgttgctgtcaggaacccatgtgat

SEQ ID NO: 984395 - DNA, 25 bp, Mus musculus
tgttgctgtgatcatgctccttacg

SEQ ID NO: 984396 - DNA, 25 bp, Mus musculus
tgttgctgtgatgatgctccttacg

SEQ ID NO: 984397 - DNA, 25 bp, Mus musculus
tgttgcttcccacaggaagtcacag

SEQ ID NO: 984398 - DNA, 25 bp, Mus musculus
tgttgcttcccagaggaagtcacag

SEQ ID NO: 984399 - DNA, 25 bp, Mus musculus
tgttggacagattgtaggtgaagtg

SEQ ID NO: 984400 - DNA, 25 bp, Mus musculus
tgttggacagtttgtaggtgaagtg

SEQ ID NO: 984401 - DNA, 25 bp, Mus musculus
tgttggactcagaggccactactta

SEQ ID NO: 984402 - DNA, 25 bp, Mus musculus
tgttggactcagtggccactactta

SEQ ID NO: 984403 - DNA, 25 bp, Mus musculus
tgttggagagagcggtctggcaggc

SEQ ID NO: 984404 - DNA, 25 bp, Mus musculus
tgttggagagaggggtctggcaggc

SEQ ID NO: 984405 - DNA, 25 bp, Mus musculus
tgttggagagctgatcacaagtgaa

SEQ ID NO: 984406 - DNA, 25 bp, Mus musculus
tgttggagaggtgatcacaagtgaa

SEQ ID NO: 984407 - DNA, 25 bp, Mus musculus
tgttggatgctgagcacatcgtgaa

SEQ ID NO: 984408 - DNA, 25 bp, Mus musculus
tgttggatgctgagcatattgtagg

SEQ ID NO: 984409 - DNA, 25 bp, Mus musculus
tgttggatgctgagcgcactctgag

SEQ ID NO: 984410 - DNA, 25 bp, Mus musculus
tgttggatgctgaggacatcgtgaa

SEQ ID NO: 984411 - DNA, 25 bp, Mus musculus
tgttggatgctgaggatattgtagg

SEQ ID NO: 984412 - DNA, 25 bp, Mus musculus
tgttggatgctgagggcactctgag

SEQ ID NO: 984413 - DNA, 25 bp, Mus musculus
tgttggattgatcggggcagagaca

SEQ ID NO: 984414 - DNA, 25 bp, Mus musculus
tgttggattgttcggggcagagaca

SEQ ID NO: 984415 - DNA, 25 bp, Mus musculus
tgttggcaagagagatgaagatgct

SEQ ID NO: 984416 - DNA, 25 bp, Mus musculus
tgttggcaagaggccacagcactat

SEQ ID NO: 984417 - DNA, 25 bp, Mus musculus
tgttggcaagtgagatgaagatgct

SEQ ID NO: 984418 - DNA, 25 bp, Mus musculus
tgttggcaagtggccacagcactat

SEQ ID NO: 984419 - DNA, 25 bp, Mus musculus
tgttggcctatacgaagtttggtga

SEQ ID NO: 984420 - DNA, 25 bp, Mus musculus
tgttggcctataggaagtttggtga

SEQ ID NO: 984421 - DNA, 25 bp, Mus musculus
tgttggcggcgtgaccccagatcat

SEQ ID NO: 984422 - DNA, 25 bp, Mus musculus
tgttggcggcgtgagcccagatcat

SEQ ID NO: 984423 - DNA, 25 bp, Mus musculus
tgttggctaaaggcgatttgaccac

SEQ ID NO: 984424 - DNA, 25 bp, Mus musculus
tgttggctaatggcgatttgaccac

SEQ ID NO: 984425 - DNA, 25 bp, Mus musculus
tgttggctatagagaagtgcatgcg

SEQ ID NO: 984426 - DNA, 25 bp, Mus musculus
tgttggctatagtgaagtgcatgcg

SEQ ID NO: 984427 - DNA, 25 bp, Mus musculus
tgttggctgaatctttgttaactga

SEQ ID NO: 984428 - DNA, 25 bp, Mus musculus
tgttggctgaatgtttgttaactga

SEQ ID NO: 984429 - DNA, 25 bp, Mus musculus
tgttggctgcacagcaggtgtgcaa

SEQ ID NO: 984430 - DNA, 25 bp, Mus musculus
tgttggctgcactgcaggtgtgcaa

SEQ ID NO: 984431 - DNA, 25 bp, Mus musculus
tgttggctgctgctgctaatgtgca

SEQ ID NO: 984432 - DNA, 25 bp, Mus musculus
tgttggctgctggtgctaatgtgca

SEQ ID NO: 984433 - DNA, 25 bp, Mus musculus
tgttggcttgtgctctatgttcaga

SEQ ID NO: 984434 - DNA, 25 bp, Mus musculus
tgttggcttgtggtctatgttcaga

SEQ ID NO: 984435 - DNA, 25 bp, Mus musculus
tgttggctttgccacgatggaatca

SEQ ID NO: 984436 - DNA, 25 bp, Mus musculus
tgttggctttgccaggatggaatca

SEQ ID NO: 984437 - DNA, 25 bp, Mus musculus
tgttgggagagaagtggttgctcct

SEQ ID NO: 984438 - DNA, 25 bp, Mus musculus
tgttgggagagatgtggttgctcct

SEQ ID NO: 984439 - DNA, 25 bp, Mus musculus
tgttgggccccacggctatggaact

SEQ ID NO: 984440 - DNA, 25 bp, Mus musculus
tgttgggccccagggctatggaact

SEQ ID NO: 984441 - DNA, 25 bp, Mus musculus
tgttggtgagactgaactcaaagtg

SEQ ID NO: 984442 - DNA, 25 bp, Mus musculus
tgttggtgagtctgaactcaaagtg

SEQ ID NO: 984443 - DNA, 25 bp, Mus musculus
tgttggtgctagcaccccctgtcat

SEQ ID NO: 984444 - DNA, 25 bp, Mus musculus
tgttggtgctaggaccccctgtcat

SEQ ID NO: 984445 - DNA, 25 bp, Mus musculus
tgttggtggcaccgatggcaatgtg

SEQ ID NO: 984446 - DNA, 25 bp, Mus musculus
tgttggtggcacggatggcaatgtg

SEQ ID NO: 984447 - DNA, 25 bp, Mus musculus
tgttggttcacaccctggaatacat

SEQ ID NO: 984448 - DNA, 25 bp, Mus musculus
tgttggttcacagcctggaatacat

SEQ ID NO: 984449 - DNA, 25 bp, Mus musculus
tgttgtaccccacgcattgggcatg

SEQ ID NO: 984450 - DNA, 25 bp, Mus musculus
tgttgtaccccaggcattgggcatg

SEQ ID NO: 984451 - DNA, 25 bp, Mus musculus
tgttgtcaagctttgatctcatttt

SEQ ID NO: 984452 - DNA, 25 bp, Mus musculus
tgttgtcaaggtttgatctcatttt

SEQ ID NO: 984453 - DNA, 25 bp, Mus musculus
tgttgtcctgctgggtaccagagtc

SEQ ID NO: 984454 - DNA, 25 bp, Mus musculus
tgttgtcctggtgggtaccagagtc

SEQ ID NO: 984455 - DNA, 25 bp, Mus musculus
tgttgtctcgcttcctagtttctac

SEQ ID NO: 984456 - DNA, 25 bp, Mus musculus
tgttgtctcggttcctagtttctac

SEQ ID NO: 984457 - DNA, 25 bp, Mus musculus
tgttgtggatccttcatcttagaat

SEQ ID NO: 984458 - DNA, 25 bp, Mus musculus
tgttgtggatccttcggggcaggtc

SEQ ID NO: 984459 - DNA, 25 bp, Mus musculus
tgttgtggatccttgatcttagaat

SEQ ID NO: 984460 - DNA, 25 bp, Mus musculus
tgttgtggatccttgggggcaggtc

SEQ ID NO: 984461 - DNA, 25 bp, Mus musculus
tgttgtggctcaaaaggaccgtccc

SEQ ID NO: 984462 - DNA, 25 bp, Mus musculus
tgttgtggctgaaaaggaccgtccc

SEQ ID NO: 984463 - DNA, 25 bp, Mus musculus
tgttgttgctgctgcggtctgcgag

SEQ ID NO: 984464 - DNA, 25 bp, Mus musculus
tgttgttgctgctggggtctgcgag

SEQ ID NO: 984465 - DNA, 25 bp, Mus musculus
tgttgttgctggagacaaccggatc

SEQ ID NO: 984466 - DNA, 25 bp, Mus musculus
tgttgttgctggtgacaaccggatc

SEQ ID NO: 984467 - DNA, 25 bp, Mus musculus
tgttgtttcgctcttcattacagtc

SEQ ID NO: 984468 - DNA, 25 bp, Mus musculus
tgttgtttcggtcttcattacagtc

SEQ ID NO: 984469 - DNA, 25 bp, Mus musculus
tgtttaacagaattgcagaaacgtg

SEQ ID NO: 984470 - DNA, 25 bp, Mus musculus
tgtttaacagtattgcagaaacgtg

SEQ ID NO: 984471 - DNA, 25 bp, Mus musculus
tgtttaataaagtagattatgaacg

SEQ ID NO: 984472 - DNA, 25 bp, Mus musculus
tgtttaataatgtagattatgaacg

SEQ ID NO: 984473 - DNA, 25 bp, Mus musculus
tgtttaatgcaagacagatgctgag

SEQ ID NO: 984474 - DNA, 25 bp, Mus musculus
tgtttaatgcaagagagatgctgag

SEQ ID NO: 984475 - DNA, 25 bp, Mus musculus
tgtttaatggttgacaggtgtggcg

SEQ ID NO: 984476 - DNA, 25 bp, Mus musculus
tgtttaatggttgagaggtgtggcg

SEQ ID NO: 984477 - DNA, 25 bp, Mus musculus
tgtttaccagcaagccatgaatcaa

SEQ ID NO: 984478 - DNA, 25 bp, Mus musculus
tgtttaccaggaagccatgaatcaa

SEQ ID NO: 984479 - DNA, 25 bp, Mus musculus
tgtttactggatgtccgatcaaaac

SEQ ID NO: 984480 - DNA, 25 bp, Mus musculus
tgtttactggttgtccgatcaaaac

SEQ ID NO: 984481 - DNA, 25 bp, Mus musculus
tgtttagctacacgaagcagtttga

SEQ ID NO: 984482 - DNA, 25 bp, Mus musculus
tgtttagctacacgagcatctggac

SEQ ID NO: 984483 - DNA, 25 bp, Mus musculus
tgtttagctacaggaagcagtttga

SEQ ID NO: 984484 - DNA, 25 bp, Mus musculus
tgtttagctacaggagcatctggac

SEQ ID NO: 984485 - DNA, 25 bp, Mus musculus
tgtttatcagaactttccagagtgt

SEQ ID NO: 984486 - DNA, 25 bp, Mus musculus
tgtttatcagaagtttccagagtgt

SEQ ID NO: 984487 - DNA, 25 bp, Mus musculus
tgtttatgacagcttttggaatgac

SEQ ID NO: 984488 - DNA, 25 bp, Mus musculus
tgtttatgacaggttttggaatgac

SEQ ID NO: 984489 - DNA, 25 bp, Mus musculus
tgtttatgataccggacgaacaggg

SEQ ID NO: 984490 - DNA, 25 bp, Mus musculus
tgtttatgatacgggacgaacaggg

SEQ ID NO: 984491 - DNA, 25 bp, Mus musculus
tgtttcacagcgaagcagatgatgt

SEQ ID NO: 984492 - DNA, 25 bp, Mus musculus
tgtttcacagggaagcagatgatgt

SEQ ID NO: 984493 - DNA, 25 bp, Mus musculus
tgtttcagaaagcaaaaccacattg

SEQ ID NO: 984494 - DNA, 25 bp, Mus musculus
tgtttcagaaaggaaaaccacattg

SEQ ID NO: 984495 - DNA, 25 bp, Mus musculus
tgtttccaacccaacctcttttgtg

SEQ ID NO: 984496 - DNA, 25 bp, Mus musculus
tgtttccaacccaagctcttttgtg

SEQ ID NO: 984497 - DNA, 25 bp, Mus musculus
tgtttccactgcatggcctgcagga

SEQ ID NO: 984498 - DNA, 25 bp, Mus musculus
tgtttccactgcttggcctgcagga

SEQ ID NO: 984499 - DNA, 25 bp, Mus musculus
tgtttcccgcggccaaggcacgagt

SEQ ID NO: 984500 - DNA, 25 bp, Mus musculus
tgtttcccgcggctgtcctggctgt

SEQ ID NO: 984501 - DNA, 25 bp, Mus musculus
tgtttcccgcgggcaaggcacgagt

SEQ ID NO: 984502 - DNA, 25 bp, Mus musculus
tgtttcccgcgggtgtcctggctgt

SEQ ID NO: 984503 - DNA, 25 bp, Mus musculus
tgtttccgaaatgacctggaatttt

SEQ ID NO: 984504 - DNA, 25 bp, Mus musculus
tgtttccgaaatgagctggaatttt

SEQ ID NO: 984505 - DNA, 25 bp, Mus musculus
tgtttcctctggcatatcagtaccc

SEQ ID NO: 984506 - DNA, 25 bp, Mus musculus
tgtttcctctgggatatcagtaccc

SEQ ID NO: 984507 - DNA, 25 bp, Mus musculus
tgtttcggccagcagtcctactgtg

SEQ ID NO: 984508 - DNA, 25 bp, Mus musculus
tgtttcggccaggagtcctactgtg

SEQ ID NO: 984509 - DNA, 25 bp, Mus musculus
tgtttcgtcagaaggtggaaatgac

SEQ ID NO: 984510 - DNA, 25 bp, Mus musculus
tgtttcgtcagatggtggaaatgac

SEQ ID NO: 984511 - DNA, 25 bp, Mus musculus
tgtttctctgcgccaggtatcagag

SEQ ID NO: 984512 - DNA, 25 bp, Mus musculus
tgtttctctgcgcctggtatcagag

SEQ ID NO: 984513 - DNA, 25 bp, Mus musculus
tgtttctgcaaacaacagaacagtc

SEQ ID NO: 984514 - DNA, 25 bp, Mus musculus
tgtttctgcaaagaacagaacagtc

SEQ ID NO: 984515 - DNA, 25 bp, Mus musculus
tgtttctgctgacgagagcaatggc

SEQ ID NO: 984516 - DNA, 25 bp, Mus musculus
tgtttctgctgaggagagcaatggc

SEQ ID NO: 984517 - DNA, 25 bp, Mus musculus
tgtttgagaagctgcgtatcagtac

SEQ ID NO: 984518 - DNA, 25 bp, Mus musculus
tgtttgagaagctgggtatcagtac

SEQ ID NO: 984519 - DNA, 25 bp, Mus musculus
tgtttgatatcctgacagtggaaga

SEQ ID NO: 984520 - DNA, 25 bp, Mus musculus
tgtttgatatgctgacagtggaaga

SEQ ID NO: 984521 - DNA, 25 bp, Mus musculus
tgtttgcaagaatgcatcttaacag

SEQ ID NO: 984522 - DNA, 25 bp, Mus musculus
tgtttgcaagctatccattatgatg

SEQ ID NO: 984523 - DNA, 25 bp, Mus musculus
tgtttgcaaggtatccattatgatg

SEQ ID NO: 984524 - DNA, 25 bp, Mus musculus
tgtttgcaagtatgcatcttaacag

SEQ ID NO: 984525 - DNA, 25 bp, Mus musculus
tgtttgcaatttctctcttcattta

SEQ ID NO: 984526 - DNA, 25 bp, Mus musculus
tgtttgcaatttgtctcttcattta

SEQ ID NO: 984527 - DNA, 25 bp, Mus musculus
tgtttgcagtctctcaagcttttaa

SEQ ID NO: 984528 - DNA, 25 bp, Mus musculus
tgtttgcagtctgtcaagcttttaa

SEQ ID NO: 984529 - DNA, 25 bp, Mus musculus
tgtttgccaagatcaggtggatcgc

SEQ ID NO: 984530 - DNA, 25 bp, Mus musculus
tgtttgccaagatcatgatccagtt

SEQ ID NO: 984531 - DNA, 25 bp, Mus musculus
tgtttgccaagatctggtggatcgc

SEQ ID NO: 984532 - DNA, 25 bp, Mus musculus
tgtttgccaagatcttgatccagtt

SEQ ID NO: 984533 - DNA, 25 bp, Mus musculus
tgtttgcctgcgaaatgctcataaa

SEQ ID NO: 984534 - DNA, 25 bp, Mus musculus
tgtttgcctgggaaatgctcataaa

SEQ ID NO: 984535 - DNA, 25 bp, Mus musculus
tgtttgctagagggcaatgcgagca

SEQ ID NO: 984536 - DNA, 25 bp, Mus musculus
tgtttgctagtgggcaatgcgagca

SEQ ID NO: 984537 - DNA, 25 bp, Mus musculus
tgtttgctgtggcaatcaagaatgc

SEQ ID NO: 984538 - DNA, 25 bp, Mus musculus
tgtttgctgtgggaatcaagaatgc

SEQ ID NO: 984539 - DNA, 25 bp, Mus musculus
tgtttggaccacgacattctcgagt

SEQ ID NO: 984540 - DNA, 25 bp, Mus musculus
tgtttggaccacgagattctcgagt

SEQ ID NO: 984541 - DNA, 25 bp, Mus musculus
tgtttgtttacacgaaagatgtagc

SEQ ID NO: 984542 - DNA, 25 bp, Mus musculus
tgtttgtttacaggaaagatgtagc

SEQ ID NO: 984543 - DNA, 25 bp, Mus musculus
tgttttaaaatacaccgtatgcatg

SEQ ID NO: 984544 - DNA, 25 bp, Mus musculus
tgttttaaaatacagcgtatgcatg

SEQ ID NO: 984545 - DNA, 25 bp, Mus musculus
tgttttatcctgctctctaataaag

SEQ ID NO: 984546 - DNA, 25 bp, Mus musculus
tgttttatcctggtctctaataaag

SEQ ID NO: 984547 - DNA, 25 bp, Mus musculus
tgttttcaacagagacgaagagcga

SEQ ID NO: 984548 - DNA, 25 bp, Mus musculus
tgttttcaacagtgacgaagagcga

SEQ ID NO: 984549 - DNA, 25 bp, Mus musculus
tgttttccgactcgtgaccaaccgc

SEQ ID NO: 984550 - DNA, 25 bp, Mus musculus
tgttttccgactggtgaccaaccgc

SEQ ID NO: 984551 - DNA, 25 bp, Mus musculus
tgttttctggagagacactagcaga

SEQ ID NO: 984552 - DNA, 25 bp, Mus musculus
tgttttctggagtgacactagcaga

SEQ ID NO: 984553 - DNA, 25 bp, Mus musculus
tgttttctgtcaagacaccatgatt

SEQ ID NO: 984554 - DNA, 25 bp, Mus musculus
tgttttctgtcatgacaccatgatt

SEQ ID NO: 984555 - DNA, 25 bp, Mus musculus
tgttttggtcttaccgtaccagcca

SEQ ID NO: 984556 - DNA, 25 bp, Mus musculus
tgttttggtcttacggtaccagcca

SEQ ID NO: 984557 - DNA, 25 bp, Mus musculus
tgttttgtgaagagtacccagtatt

SEQ ID NO: 984558 - DNA, 25 bp, Mus musculus
tgttttgtgaagcctggatggtgga

SEQ ID NO: 984559 - DNA, 25 bp, Mus musculus
tgttttgtgaaggctggatggtgga

SEQ ID NO: 984560 - DNA, 25 bp, Mus musculus
tgttttgtgaagtgtacccagtatt

SEQ ID NO: 984561 - DNA, 25 bp, Mus musculus
tgtttttacaagccgaggagaagac

SEQ ID NO: 984562 - DNA, 25 bp, Mus musculus
tgtttttacaaggcgaggagaagac

SEQ ID NO: 984563 - DNA, 25 bp, Mus musculus
tgtttttaggctgcagccggaagtg

SEQ ID NO: 984564 - DNA, 25 bp, Mus musculus
tgtttttagggtgcagccggaagtg

SEQ ID NO: 984565 - DNA, 25 bp, Mus musculus
tgtttttgaaaataattggcaacca

SEQ ID NO: 984566 - DNA, 25 bp, Mus musculus
tgtttttgaaaatatttggcaacca

SEQ ID NO: 984567 - DNA, 25 bp, Mus musculus
tgtttttgagcaatctgaagaactt

SEQ ID NO: 984568 - DNA, 25 bp, Mus musculus
tgtttttgaggaatctgaagaactt

SEQ ID NO: 984569 - DNA, 25 bp, Mus musculus
ttaaaaacagctgtcctggagcctc

SEQ ID NO: 984570 - DNA, 25 bp, Mus musculus
ttaaaaacaggtgtcctggagcctc

SEQ ID NO: 984571 - DNA, 25 bp, Mus musculus
ttaaaacaagaaactccatcaagct

SEQ ID NO: 984572 - DNA, 25 bp, Mus musculus
ttaaaacaagtaactccatcaagct

SEQ ID NO: 984573 - DNA, 25 bp, Mus musculus
ttaaaacaggatcacgagtttgatt

SEQ ID NO: 984574 - DNA, 25 bp, Mus musculus
ttaaaacaggatcaggagtttgatt

SEQ ID NO: 984575 - DNA, 25 bp, Mus musculus
ttaaaatcagcaaattttgccaaag

SEQ ID NO: 984576 - DNA, 25 bp, Mus musculus
ttaaaatcagccagggagaagaaac

SEQ ID NO: 984577 - DNA, 25 bp, Mus musculus
ttaaaatcaggaaattttgccaaag

SEQ ID NO: 984578 - DNA, 25 bp, Mus musculus
ttaaaatcaggcagggagaagaaac

SEQ ID NO: 984579 - DNA, 25 bp, Mus musculus
ttaaaatggagatacgcttgccaga

SEQ ID NO: 984580 - DNA, 25 bp, Mus musculus
ttaaaatggagataggcttgccaga

SEQ ID NO: 984581 - DNA, 25 bp, Mus musculus
ttaaaatgtgaacgctgtggattaa

SEQ ID NO: 984582 - DNA, 25 bp, Mus musculus
ttaaaatgtgaaggctgtggattaa

SEQ ID NO: 984583 - DNA, 25 bp, Mus musculus
ttaaacaacctacagcttcaggatc

SEQ ID NO: 984584 - DNA, 25 bp, Mus musculus
ttaaacaacctagagcttcaggatc

SEQ ID NO: 984585 - DNA, 25 bp, Mus musculus
ttaaacctggcaggactcacaaacg

SEQ ID NO: 984586 - DNA, 25 bp, Mus musculus
ttaaacctgggaggactcacaaacg

SEQ ID NO: 984587 - DNA, 25 bp, Mus musculus
ttaaacgccacaactctgatgctca

SEQ ID NO: 984588 - DNA, 25 bp, Mus musculus
ttaaacgccacatctctgatgctca

SEQ ID NO: 984589 - DNA, 25 bp, Mus musculus
ttaaacttacatcaaaattatatta

SEQ ID NO: 984590 - DNA, 25 bp, Mus musculus
ttaaacttacatctttgaggattgc

SEQ ID NO: 984591 - DNA, 25 bp, Mus musculus
ttaaacttacatgaaaattatatta

SEQ ID NO: 984592 - DNA, 25 bp, Mus musculus
ttaaacttacatgtttgaggattgc

SEQ ID NO: 984593 - DNA, 25 bp, Mus musculus
ttaaacttccagatttgaagaggaa

SEQ ID NO: 984594 - DNA, 25 bp, Mus musculus
ttaaacttccagttttgaagaggaa

SEQ ID NO: 984595 - DNA, 25 bp, Mus musculus
ttaaagaacaaagaccagaaccaca

SEQ ID NO: 984596 - DNA, 25 bp, Mus musculus
ttaaagaacaaagagcagaaccaca

SEQ ID NO: 984597 - DNA, 25 bp, Mus musculus
ttaaagaatgtggacccactgtatg

SEQ ID NO: 984598 - DNA, 25 bp, Mus musculus
ttaaagaatgtggagccactgtatg

SEQ ID NO: 984599 - DNA, 25 bp, Mus musculus
ttaaagatgacaaacccaccatttg

SEQ ID NO: 984600 - DNA, 25 bp, Mus musculus
ttaaagatgacaaagccaccatttg

SEQ ID NO: 984601 - DNA, 25 bp, Mus musculus
ttaaagcatgtgatgtctaacacag

SEQ ID NO: 984602 - DNA, 25 bp, Mus musculus
ttaaagcatgtgttgtctaacacag

SEQ ID NO: 984603 - DNA, 25 bp, Mus musculus
ttaaagctgctgcgcaaagccacgg

SEQ ID NO: 984604 - DNA, 25 bp, Mus musculus
ttaaagctgctgcggaaagccacgg

SEQ ID NO: 984605 - DNA, 25 bp, Mus musculus
ttaaaggaatcgagacgggtgctga

SEQ ID NO: 984606 - DNA, 25 bp, Mus musculus
ttaaaggaatcgtgacgggtgctga

SEQ ID NO: 984607 - DNA, 25 bp, Mus musculus
ttaaaggagaagcaggtgaacgtga

SEQ ID NO: 984608 - DNA, 25 bp, Mus musculus
ttaaaggagaaggaggtgaacgtga

SEQ ID NO: 984609 - DNA, 25 bp, Mus musculus
ttaaaggcacagcaagcggaacagg

SEQ ID NO: 984610 - DNA, 25 bp, Mus musculus
ttaaaggcacaggaagcggaacagg

SEQ ID NO: 984611 - DNA, 25 bp, Mus musculus
ttaaagtgtgaacattgtggcatga

SEQ ID NO: 984612 - DNA, 25 bp, Mus musculus
ttaaagtgtgaagattgtggcatga

SEQ ID NO: 984613 - DNA, 25 bp, Mus musculus
ttaaagtttgagctgggatgtgtgt

SEQ ID NO: 984614 - DNA, 25 bp, Mus musculus
ttaaagtttgaggtgggatgtgtgt

SEQ ID NO: 984615 - DNA, 25 bp, Mus musculus
ttaaatcatcaccacaataagcctg

SEQ ID NO: 984616 - DNA, 25 bp, Mus musculus
ttaaatcatcaccagaataagcctg

SEQ ID NO: 984617 - DNA, 25 bp, Mus musculus
ttaaatctaacactcgtgaatatgt

SEQ ID NO: 984618 - DNA, 25 bp, Mus musculus
ttaaatctaacactggtgaatatgt

SEQ ID NO: 984619 - DNA, 25 bp, Mus musculus
ttaaatgacaacaattgacatatat

SEQ ID NO: 984620 - DNA, 25 bp, Mus musculus
ttaaatgacatcaattgacatatat

SEQ ID NO: 984621 - DNA, 25 bp, Mus musculus
ttaaatgtacagactaaatccagtg

SEQ ID NO: 984622 - DNA, 25 bp, Mus musculus
ttaaatgtacagtctaaatccagtg

SEQ ID NO: 984623 - DNA, 25 bp, Mus musculus
ttaaatgtagagcttgtggtgtgaa

SEQ ID NO: 984624 - DNA, 25 bp, Mus musculus
ttaaatgtagaggttgtggtgtgaa

SEQ ID NO: 984625 - DNA, 25 bp, Mus musculus
ttaaatttgcaaattcgttcattcc

SEQ ID NO: 984626 - DNA, 25 bp, Mus musculus
ttaaatttgcaatttcgttcattcc

SEQ ID NO: 984627 - DNA, 25 bp, Mus musculus
ttaacaagcacaatgggtgtgtttt

SEQ ID NO: 984628 - DNA, 25 bp, Mus musculus
ttaacaagcacattgggtgtgtttt

SEQ ID NO: 984629 - DNA, 25 bp, Mus musculus
ttaacaccattgaacgtcctcaact

SEQ ID NO: 984630 - DNA, 25 bp, Mus musculus
ttaacaccattgaaggtcctcaact

SEQ ID NO: 984631 - DNA, 25 bp, Mus musculus
ttaacagaaaagcagtgtgtgaggg

SEQ ID NO: 984632 - DNA, 25 bp, Mus musculus
ttaacagaaaaggagtgtgtgaggg

SEQ ID NO: 984633 - DNA, 25 bp, Mus musculus
ttaacagcccagcgcaatgtggctg

SEQ ID NO: 984634 - DNA, 25 bp, Mus musculus
ttaacagcccagggcaatgtggctg

SEQ ID NO: 984635 - DNA, 25 bp, Mus musculus
ttaacaggccatcgatgcccgggta

SEQ ID NO: 984636 - DNA, 25 bp, Mus musculus
ttaacaggccatggatgcccgggta

SEQ ID NO: 984637 - DNA, 25 bp, Mus musculus
ttaaccagaaagctgatctgtaaat

SEQ ID NO: 984638 - DNA, 25 bp, Mus musculus
ttaaccagaaaggtgatctgtaaat

SEQ ID NO: 984639 - DNA, 25 bp, Mus musculus
ttaaccatgacccggaactgtgggg

SEQ ID NO: 984640 - DNA, 25 bp, Mus musculus
ttaaccatgaccgggaactgtgggg

SEQ ID NO: 984641 - DNA, 25 bp, Mus musculus
ttaaccttgaacatattgctaccag

SEQ ID NO: 984642 - DNA, 25 bp, Mus musculus
ttaaccttgaacttattgctaccag

SEQ ID NO: 984643 - DNA, 25 bp, Mus musculus
ttaacgggcataaacgttacatata

SEQ ID NO: 984644 - DNA, 25 bp, Mus musculus
ttaacgggcataaaggttacatata

SEQ ID NO: 984645 - DNA, 25 bp, Mus musculus
ttaactaccaagcatctatatttgc

SEQ ID NO: 984646 - DNA, 25 bp, Mus musculus
ttaactaccaaggatctatatttgc

SEQ ID NO: 984647 - DNA, 25 bp, Mus musculus
ttaactccagtgaacgtcattcagc

SEQ ID NO: 984648 - DNA, 25 bp, Mus musculus
ttaactccagtgaaggtcattcagc

SEQ ID NO: 984649 - DNA, 25 bp, Mus musculus
ttaactgagaaacatctccaagagg

SEQ ID NO: 984650 - DNA, 25 bp, Mus musculus
ttaactgagaaagatctccaagagg

SEQ ID NO: 984651 - DNA, 25 bp, Mus musculus
ttaactgcttggcttctccatataa

SEQ ID NO: 984652 - DNA, 25 bp, Mus musculus
ttaactgcttgggttctccatataa

SEQ ID NO: 984653 - DNA, 25 bp, Mus musculus
ttaactggaaagaatgtcttgattg

SEQ ID NO: 984654 - DNA, 25 bp, Mus musculus
ttaactggaaagcatataattgaca

SEQ ID NO: 984655 - DNA, 25 bp, Mus musculus
ttaactggaaaggatataattgaca

SEQ ID NO: 984656 - DNA, 25 bp, Mus musculus
ttaactggaaagtatgtcttgattg

SEQ ID NO: 984657 - DNA, 25 bp, Mus musculus
ttaagaaagcttcacgtttggaatg

SEQ ID NO: 984658 - DNA, 25 bp, Mus musculus
ttaagaaagcttcaggtttggaatg

SEQ ID NO: 984659 - DNA, 25 bp, Mus musculus
ttaagaagaaagcactgacagacga

SEQ ID NO: 984660 - DNA, 25 bp, Mus musculus
ttaagaagaaagcagcacacacagg

SEQ ID NO: 984661 - DNA, 25 bp, Mus musculus
ttaagaagaaaggactgacagacga

SEQ ID NO: 984662 - DNA, 25 bp, Mus musculus
ttaagaagaaaggagcacacacagg

SEQ ID NO: 984663 - DNA, 25 bp, Mus musculus
ttaagaaggcaaatcctatgctgga

SEQ ID NO: 984664 - DNA, 25 bp, Mus musculus
ttaagaaggcaaatgctatgctgga

SEQ ID NO: 984665 - DNA, 25 bp, Mus musculus
ttaagacaagtgcttgctatgggac

SEQ ID NO: 984666 - DNA, 25 bp, Mus musculus
ttaagacaagtggttgctatgggac

SEQ ID NO: 984667 - DNA, 25 bp, Mus musculus
ttaagacaatcacggcaagaaaatt

SEQ ID NO: 984668 - DNA, 25 bp, Mus musculus
ttaagacaatcagggcaagaaaatt

SEQ ID NO: 984669 - DNA, 25 bp, Mus musculus
ttaagactggcctgctgcaaaaatg

SEQ ID NO: 984670 - DNA, 25 bp, Mus musculus
ttaagactgggctgctgcaaaaatg

SEQ ID NO: 984671 - DNA, 25 bp, Mus musculus
ttaagagaagctgttaggagtggat

SEQ ID NO: 984672 - DNA, 25 bp, Mus musculus
ttaagagaaggtgttaggagtggat

SEQ ID NO: 984673 - DNA, 25 bp, Mus musculus
ttaagagagctagaagtgcagcatc

SEQ ID NO: 984674 - DNA, 25 bp, Mus musculus
ttaagagagctagatgtgcagcatc

SEQ ID NO: 984675 - DNA, 25 bp, Mus musculus
ttaagaggagctccttgttcaccaa

SEQ ID NO: 984676 - DNA, 25 bp, Mus musculus
ttaagaggaggtccttgttcaccaa

SEQ ID NO: 984677 - DNA, 25 bp, Mus musculus
ttaagattcgctggtatatttgaat

SEQ ID NO: 984678 - DNA, 25 bp, Mus musculus
ttaagattcggtggtatatttgaat

SEQ ID NO: 984679 - DNA, 25 bp, Mus musculus
ttaagattgtctggagatggctgca

SEQ ID NO: 984680 - DNA, 25 bp, Mus musculus
ttaagattgtctggtgatggctgca

SEQ ID NO: 984681 - DNA, 25 bp, Mus musculus
ttaagcaagtgcaaccaatagctgt

SEQ ID NO: 984682 - DNA, 25 bp, Mus musculus
ttaagcaagtgcaacgcaaaggcag

SEQ ID NO: 984683 - DNA, 25 bp, Mus musculus
ttaagcaagtgcaacgtttctgaaa

SEQ ID NO: 984684 - DNA, 25 bp, Mus musculus
ttaagcaagtgcaagcaatagctgt

SEQ ID NO: 984685 - DNA, 25 bp, Mus musculus
ttaagcaagtgcaaggcaaaggcag

SEQ ID NO: 984686 - DNA, 25 bp, Mus musculus
ttaagcaagtgcaaggtttctgaaa

SEQ ID NO: 984687 - DNA, 25 bp, Mus musculus
ttaagcataaagcgaggtgcagaac

SEQ ID NO: 984688 - DNA, 25 bp, Mus musculus
ttaagcataaagggaggtgcagaac

SEQ ID NO: 984689 - DNA, 25 bp, Mus musculus
ttaagcccacagagaccacaagtag

SEQ ID NO: 984690 - DNA, 25 bp, Mus musculus
ttaagcccacagtgaccacaagtag

SEQ ID NO: 984691 - DNA, 25 bp, Mus musculus
ttaagcctgtgtcgagtggttttgg

SEQ ID NO: 984692 - DNA, 25 bp, Mus musculus
ttaagcctgtgtggagtggttttgg

SEQ ID NO: 984693 - DNA, 25 bp, Mus musculus
ttaagcgtcgtgcaagatttcctgc

SEQ ID NO: 984694 - DNA, 25 bp, Mus musculus
ttaagcgtcgtgcatgatttcctgc

SEQ ID NO: 984695 - DNA, 25 bp, Mus musculus
ttaaggaatgcacggacattcctgt

SEQ ID NO: 984696 - DNA, 25 bp, Mus musculus
ttaaggaatgcagggacattcctgt

SEQ ID NO: 984697 - DNA, 25 bp, Mus musculus
ttaaggatatcgatcgccgccctgt

SEQ ID NO: 984698 - DNA, 25 bp, Mus musculus
ttaaggatatcgatggccgccctgt

SEQ ID NO: 984699 - DNA, 25 bp, Mus musculus
ttaaggattcctagatctcgaggct

SEQ ID NO: 984700 - DNA, 25 bp, Mus musculus
ttaaggattccttgatctcgaggct

SEQ ID NO: 984701 - DNA, 25 bp, Mus musculus
ttaaggggagagctcctgctttctg

SEQ ID NO: 984702 - DNA, 25 bp, Mus musculus
ttaaggggagaggtcctgctttctg

SEQ ID NO: 984703 - DNA, 25 bp, Mus musculus
ttaaggttgcaaccttgctggtgaa

SEQ ID NO: 984704 - DNA, 25 bp, Mus musculus
ttaaggttgcaagcttgctggtgaa

SEQ ID NO: 984705 - DNA, 25 bp, Mus musculus
ttaagtacagagaacgtcggacact

SEQ ID NO: 984706 - DNA, 25 bp, Mus musculus
ttaagtacagagaaggtcggacact

SEQ ID NO: 984707 - DNA, 25 bp, Mus musculus
ttaagtgaagagcgcattcaaggac

SEQ ID NO: 984708 - DNA, 25 bp, Mus musculus
ttaagtgaagagggcattcaaggac

SEQ ID NO: 984709 - DNA, 25 bp, Mus musculus
ttaatactgcttaagtatttttctg

SEQ ID NO: 984710 - DNA, 25 bp, Mus musculus
ttaatactgctttagtatttttctg

SEQ ID NO: 984711 - DNA, 25 bp, Mus musculus
ttaatatgcgtccggaccagtccaa

SEQ ID NO: 984712 - DNA, 25 bp, Mus musculus
ttaatatgcgtcgggaccagtccaa

SEQ ID NO: 984713 - DNA, 25 bp, Mus musculus
ttaatcagcaagatggaagccctcg

SEQ ID NO: 984714 - DNA, 25 bp, Mus musculus
ttaatcagcaagttggaagccctcg

SEQ ID NO: 984715 - DNA, 25 bp, Mus musculus
ttaatcagttcaagtctgttatctc

SEQ ID NO: 984716 - DNA, 25 bp, Mus musculus
ttaatcagttcatgtctgttatctc

SEQ ID NO: 984717 - DNA, 25 bp, Mus musculus
ttaatgacagagatacttggtcgtc

SEQ ID NO: 984718 - DNA, 25 bp, Mus musculus
ttaatgacagagttacttggtcgtc

SEQ ID NO: 984719 - DNA, 25 bp, Mus musculus
ttaatgagatccacacattagcttt

SEQ ID NO: 984720 - DNA, 25 bp, Mus musculus
ttaatgagatcctcacattagcttt

SEQ ID NO: 984721 - DNA, 25 bp, Mus musculus
ttaatgcaagagagatgctgaggat

SEQ ID NO: 984722 - DNA, 25 bp, Mus musculus
ttaatgcaagagtgatgctgaggat

SEQ ID NO: 984723 - DNA, 25 bp, Mus musculus
ttaatgggtatcaatataaagctca

SEQ ID NO: 984724 - DNA, 25 bp, Mus musculus
ttaatgggtatctatataaagctca

SEQ ID NO: 984725 - DNA, 25 bp, Mus musculus
ttaatggtagcaaattaaaatgtcc

SEQ ID NO: 984726 - DNA, 25 bp, Mus musculus
ttaatggtagcatattaaaatgtcc

SEQ ID NO: 984727 - DNA, 25 bp, Mus musculus
ttaatggttgagaggtgtggcgaag

SEQ ID NO: 984728 - DNA, 25 bp, Mus musculus
ttaatggttgagtggtgtggcgaag

SEQ ID NO: 984729 - DNA, 25 bp, Mus musculus
ttaatgtcagccataacaaactgaa

SEQ ID NO: 984730 - DNA, 25 bp, Mus musculus
ttaatgtcaggcataacaaactgaa

SEQ ID NO: 984731 - DNA, 25 bp, Mus musculus
ttaatgttacagccatacagtcatc

SEQ ID NO: 984732 - DNA, 25 bp, Mus musculus
ttaatgttacaggcatacagtcatc

SEQ ID NO: 984733 - DNA, 25 bp, Mus musculus
ttaattagagcaggttcgccttcgc

SEQ ID NO: 984734 - DNA, 25 bp, Mus musculus
ttaattagaggaggttcgccttcgc

SEQ ID NO: 984735 - DNA, 25 bp, Mus musculus
ttaattcaggctcctcatcctaaat

SEQ ID NO: 984736 - DNA, 25 bp, Mus musculus
ttaattcaggctgctcatcctaaat

SEQ ID NO: 984737 - DNA, 25 bp, Mus musculus
ttaattgcgcaacgcatcaacgtca

SEQ ID NO: 984738 - DNA, 25 bp, Mus musculus
ttaattgcgcaaggcatcaacgtca

SEQ ID NO: 984739 - DNA, 25 bp, Mus musculus
ttaattggtgaaaacagcaatccag

SEQ ID NO: 984740 - DNA, 25 bp, Mus musculus
ttaattggtgaaaagagcaatccag

SEQ ID NO: 984741 - DNA, 25 bp, Mus musculus
ttaatttgaccgaggacatgtatgc

SEQ ID NO: 984742 - DNA, 25 bp, Mus musculus
ttaatttgacggaggacatgtatgc

SEQ ID NO: 984743 - DNA, 25 bp, Mus musculus
ttaatttgtctaaactgggattgag

SEQ ID NO: 984744 - DNA, 25 bp, Mus musculus
ttaatttgtctatactgggattgag

SEQ ID NO: 984745 - DNA, 25 bp, Mus musculus
ttaattttctatcgtgccattaacc

SEQ ID NO: 984746 - DNA, 25 bp, Mus musculus
ttaattttctatggtgccattaacc

SEQ ID NO: 984747 - DNA, 25 bp, Mus musculus
ttacaaaaagatgttcgcagatgcc

SEQ ID NO: 984748 - DNA, 25 bp, Mus musculus
ttacaaaaagttgttcgcagatgcc

SEQ ID NO: 984749 - DNA, 25 bp, Mus musculus
ttacaaaaccaacaatgcccagcaa

SEQ ID NO: 984750 - DNA, 25 bp, Mus musculus
ttacaaaaccaagaatgcccagcaa

SEQ ID NO: 984751 - DNA, 25 bp, Mus musculus
ttacaaacagatattcagaaacttc

SEQ ID NO: 984752 - DNA, 25 bp, Mus musculus
ttacaaacagattgttctaacaggc

SEQ ID NO: 984753 - DNA, 25 bp, Mus musculus
ttacaaacagttattcagaaacttc

SEQ ID NO: 984754 - DNA, 25 bp, Mus musculus
ttacaaacagtttgttctaacaggc

SEQ ID NO: 984755 - DNA, 25 bp, Mus musculus
ttacaaccaacacaccaacgacaaa

SEQ ID NO: 984756 - DNA, 25 bp, Mus musculus
ttacaaccaacagaccaacgacaaa

SEQ ID NO: 984757 - DNA, 25 bp, Mus musculus
ttacaaccagagggcatgaagagat

SEQ ID NO: 984758 - DNA, 25 bp, Mus musculus
ttacaaccagagttttcctccctcg

SEQ ID NO: 984759 - DNA, 25 bp, Mus musculus
ttacaaccagtgggcatgaagagat

SEQ ID NO: 984760 - DNA, 25 bp, Mus musculus
ttacaaccagtgttttcctccctcg

SEQ ID NO: 984761 - DNA, 25 bp, Mus musculus
ttacaacctggaaccggcacacggt

SEQ ID NO: 984762 - DNA, 25 bp, Mus musculus
ttacaacctggaacgggcacacggt

SEQ ID NO: 984763 - DNA, 25 bp, Mus musculus
ttacaagataaacctcacttcaatt

SEQ ID NO: 984764 - DNA, 25 bp, Mus musculus
ttacaagataaagctcacttcaatt

SEQ ID NO: 984765 - DNA, 25 bp, Mus musculus
ttacaaggccttcaagacagacagt

SEQ ID NO: 984766 - DNA, 25 bp, Mus musculus
ttacaaggccttcatgacagacagt

SEQ ID NO: 984767 - DNA, 25 bp, Mus musculus
ttacaataagattacatctcgctta

SEQ ID NO: 984768 - DNA, 25 bp, Mus musculus
ttacaataagcggtggtacagaatc

SEQ ID NO: 984769 - DNA, 25 bp, Mus musculus
ttacaataaggggtggtacagaatc

SEQ ID NO: 984770 - DNA, 25 bp, Mus musculus
ttacaataagtttacatctcgctta

SEQ ID NO: 984771 - DNA, 25 bp, Mus musculus
ttacaatcaacggctcagtgcacca

SEQ ID NO: 984772 - DNA, 25 bp, Mus musculus
ttacaatcaagggctcagtgcacca

SEQ ID NO: 984773 - DNA, 25 bp, Mus musculus
ttacaatgctcacccctttggctcg

SEQ ID NO: 984774 - DNA, 25 bp, Mus musculus
ttacaatgctcagccctttggctcg

SEQ ID NO: 984775 - DNA, 25 bp, Mus musculus
ttacaattacagcggatttgacatt

SEQ ID NO: 984776 - DNA, 25 bp, Mus musculus
ttacaattacaggggatttgacatt

SEQ ID NO: 984777 - DNA, 25 bp, Mus musculus
ttacacacacagcattggagagctt

SEQ ID NO: 984778 - DNA, 25 bp, Mus musculus
ttacacacacaggattggagagctt

SEQ ID NO: 984779 - DNA, 25 bp, Mus musculus
ttacacacagcatttaattgtgatg

SEQ ID NO: 984780 - DNA, 25 bp, Mus musculus
ttacacacaggatttaattgtgatg

SEQ ID NO: 984781 - DNA, 25 bp, Mus musculus
ttacacagtccgcgtgtattcagcc

SEQ ID NO: 984782 - DNA, 25 bp, Mus musculus
ttacacagtccgggtgtattcagcc

SEQ ID NO: 984783 - DNA, 25 bp, Mus musculus
ttacacatcaaacgtttggtgtact

SEQ ID NO: 984784 - DNA, 25 bp, Mus musculus
ttacacatcaaaggtttggtgtact

SEQ ID NO: 984785 - DNA, 25 bp, Mus musculus
ttacacattgctcgacatggtgcag

SEQ ID NO: 984786 - DNA, 25 bp, Mus musculus
ttacacattgctggacatggtgcag

SEQ ID NO: 984787 - DNA, 25 bp, Mus musculus
ttacaccaagattctgggctaatat

SEQ ID NO: 984788 - DNA, 25 bp, Mus musculus
ttacaccaagtttctgggctaatat

SEQ ID NO: 984789 - DNA, 25 bp, Mus musculus
ttacacccacgaaaaggcaaatccc

SEQ ID NO: 984790 - DNA, 25 bp, Mus musculus
ttacacccacgaaatggcaaatccc

SEQ ID NO: 984791 - DNA, 25 bp, Mus musculus
ttacacccagcaatcccaggatcca

SEQ ID NO: 984792 - DNA, 25 bp, Mus musculus
ttacacccaggaatcccaggatcca

SEQ ID NO: 984793 - DNA, 25 bp, Mus musculus
ttacacccgtcaaaaatgaataccc

SEQ ID NO: 984794 - DNA, 25 bp, Mus musculus
ttacacccgtcaaatatgaataccc

SEQ ID NO: 984795 - DNA, 25 bp, Mus musculus
ttacacgaccagagcagcccctgga

SEQ ID NO: 984796 - DNA, 25 bp, Mus musculus
ttacacgaccagtgcagcccctgga

SEQ ID NO: 984797 - DNA, 25 bp, Mus musculus
ttacagaaaaataaagttgatttag

SEQ ID NO: 984798 - DNA, 25 bp, Mus musculus
ttacagaaaaataatgttgatttag

SEQ ID NO: 984799 - DNA, 25 bp, Mus musculus
ttacagaagacacgaacccgctttg

SEQ ID NO: 984800 - DNA, 25 bp, Mus musculus
ttacagaagacaggaacccgctttg

SEQ ID NO: 984801 - DNA, 25 bp, Mus musculus
ttacagaatgcacacgaacgactaa

SEQ ID NO: 984802 - DNA, 25 bp, Mus musculus
ttacagaatgcacaggaacgactaa

SEQ ID NO: 984803 - DNA, 25 bp, Mus musculus
ttacagacacatcttatccaagtgc

SEQ ID NO: 984804 - DNA, 25 bp, Mus musculus
ttacagacacatgttatccaagtgc

SEQ ID NO: 984805 - DNA, 25 bp, Mus musculus
ttacagacggcctgactcctcacta

SEQ ID NO: 984806 - DNA, 25 bp, Mus musculus
ttacagacggcctttgctgttggtg

SEQ ID NO: 984807 - DNA, 25 bp, Mus musculus
ttacagacgggctgactcctcacta

SEQ ID NO: 984808 - DNA, 25 bp, Mus musculus
ttacagacgggctttgctgttggtg

SEQ ID NO: 984809 - DNA, 25 bp, Mus musculus
ttacagaggatcccctattaagtcg

SEQ ID NO: 984810 - DNA, 25 bp, Mus musculus
ttacagaggatcgcctattaagtcg

SEQ ID NO: 984811 - DNA, 25 bp, Mus musculus
ttacagatccagcgagcatggcact

SEQ ID NO: 984812 - DNA, 25 bp, Mus musculus
ttacagatccagggagcatggcact

SEQ ID NO: 984813 - DNA, 25 bp, Mus musculus
ttacagcacacacgcagaggtgtta

SEQ ID NO: 984814 - DNA, 25 bp, Mus musculus
ttacagcacacaggcagaggtgtta

SEQ ID NO: 984815 - DNA, 25 bp, Mus musculus
ttacagcccaagcagccacctagat

SEQ ID NO: 984816 - DNA, 25 bp, Mus musculus
ttacagcccaaggagccacctagat

SEQ ID NO: 984817 - DNA, 25 bp, Mus musculus
ttacagcgagcaactgcgtgagacc

SEQ ID NO: 984818 - DNA, 25 bp, Mus musculus
ttacagcgaggaactgcgtgagacc

SEQ ID NO: 984819 - DNA, 25 bp, Mus musculus
ttacagctagttcatcactatttca

SEQ ID NO: 984820 - DNA, 25 bp, Mus musculus
ttacagctagttgatcactatttca

SEQ ID NO: 984821 - DNA, 25 bp, Mus musculus
ttacagctcttgatgtctcgcctgg

SEQ ID NO: 984822 - DNA, 25 bp, Mus musculus
ttacagctcttgttgtctcgcctgg

SEQ ID NO: 984823 - DNA, 25 bp, Mus musculus
ttacaggacccagaccaagtccaca

SEQ ID NO: 984824 - DNA, 25 bp, Mus musculus
ttacaggacccagagcaagtccaca

SEQ ID NO: 984825 - DNA, 25 bp, Mus musculus
ttacaggaggatgtgccagccattg

SEQ ID NO: 984826 - DNA, 25 bp, Mus musculus
ttacaggaggttgtgccagccattg

SEQ ID NO: 984827 - DNA, 25 bp, Mus musculus
ttacaggataagatagtgaaagaaa

SEQ ID NO: 984828 - DNA, 25 bp, Mus musculus
ttacaggataagttagtgaaagaaa

SEQ ID NO: 984829 - DNA, 25 bp, Mus musculus
ttacaggatagacactaatgctcat

SEQ ID NO: 984830 - DNA, 25 bp, Mus musculus
ttacaggatagagactaatgctcat

SEQ ID NO: 984831 - DNA, 25 bp, Mus musculus
ttacagggaccagtcattgacaggc

SEQ ID NO: 984832 - DNA, 25 bp, Mus musculus
ttacagggaccagtgattgacaggc

SEQ ID NO: 984833 - DNA, 25 bp, Mus musculus
ttacagtactatggcgatgtctgtg

SEQ ID NO: 984834 - DNA, 25 bp, Mus musculus
ttacagtactatggggatgtctgtg

SEQ ID NO: 984835 - DNA, 25 bp, Mus musculus
ttacagttagagaactcgtacctgt

SEQ ID NO: 984836 - DNA, 25 bp, Mus musculus
ttacagttagagtactcgtacctgt

SEQ ID NO: 984837 - DNA, 25 bp, Mus musculus
ttacataaaagacgaactcattata

SEQ ID NO: 984838 - DNA, 25 bp, Mus musculus
ttacataaaagaggaactcattata

SEQ ID NO: 984839 - DNA, 25 bp, Mus musculus
ttacatactgccacaagccgaaaga

SEQ ID NO: 984840 - DNA, 25 bp, Mus musculus
ttacatactggcacaagccgaaaga

SEQ ID NO: 984841 - DNA, 25 bp, Mus musculus
ttacatatgcagacatcaagcccta

SEQ ID NO: 984842 - DNA, 25 bp, Mus musculus
ttacatatgcagcaatctccacaca

SEQ ID NO: 984843 - DNA, 25 bp, Mus musculus
ttacatatgcaggaatctccacaca

SEQ ID NO: 984844 - DNA, 25 bp, Mus musculus
ttacatatgcagtcatcaagcccta

SEQ ID NO: 984845 - DNA, 25 bp, Mus musculus
ttacatccagcgattcatagaaacc

SEQ ID NO: 984846 - DNA, 25 bp, Mus musculus
ttacatccagcgtttcatagaaacc

SEQ ID NO: 984847 - DNA, 25 bp, Mus musculus
ttacatggtagagtcgtataccaaa

SEQ ID NO: 984848 - DNA, 25 bp, Mus musculus
ttacatggtagagtggtataccaaa

SEQ ID NO: 984849 - DNA, 25 bp, Mus musculus
ttacatgtgatgagagttctactgt

SEQ ID NO: 984850 - DNA, 25 bp, Mus musculus
ttacatgtgatgtgagttctactgt

SEQ ID NO: 984851 - DNA, 25 bp, Mus musculus
ttacatgtgcaacgcgtcatccagg

SEQ ID NO: 984852 - DNA, 25 bp, Mus musculus
ttacatgtgcaactgcgtcatccag

SEQ ID NO: 984853 - DNA, 25 bp, Mus musculus
ttacatgtgcaaggcgtcatccagg

SEQ ID NO: 984854 - DNA, 25 bp, Mus musculus
ttacatgtgcaagtgcgtcatccag

SEQ ID NO: 984855 - DNA, 25 bp, Mus musculus
ttacattgagctggtgaaggctgca

SEQ ID NO: 984856 - DNA, 25 bp, Mus musculus
ttacattgaggtggtgaaggctgca

SEQ ID NO: 984857 - DNA, 25 bp, Mus musculus
ttacattgcaatcgatgagtttcat

SEQ ID NO: 984858 - DNA, 25 bp, Mus musculus
ttacattgcaatggatgagtttcat

SEQ ID NO: 984859 - DNA, 25 bp, Mus musculus
ttacatttacgacctgatcaaagag

SEQ ID NO: 984860 - DNA, 25 bp, Mus musculus
ttacatttacgagctgatcaaagag

SEQ ID NO: 984861 - DNA, 25 bp, Mus musculus
ttacatttctagggcctgcacccta

SEQ ID NO: 984862 - DNA, 25 bp, Mus musculus
ttacatttctgacggcctgcaccct

SEQ ID NO: 984863 - DNA, 25 bp, Mus musculus
ttacatttctgagggcctgcaccct

SEQ ID NO: 984864 - DNA, 25 bp, Mus musculus
ttacatttcttgggcctgcacccta

SEQ ID NO: 984865 - DNA, 25 bp, Mus musculus
ttaccaaatgcaacaccgagcgtct

SEQ ID NO: 984866 - DNA, 25 bp, Mus musculus
ttaccaaatggaacaccgagcgtct

SEQ ID NO: 984867 - DNA, 25 bp, Mus musculus
ttaccaagcctgcaatctggtgaca

SEQ ID NO: 984868 - DNA, 25 bp, Mus musculus
ttaccaagcctggaatctggtgaca

SEQ ID NO: 984869 - DNA, 25 bp, Mus musculus
ttaccaagtgacaacgtgcttacag

SEQ ID NO: 984870 - DNA, 25 bp, Mus musculus
ttaccaagtgacaaggtgcttacag

SEQ ID NO: 984871 - DNA, 25 bp, Mus musculus
ttaccaatagttcacacatcctaca

SEQ ID NO: 984872 - DNA, 25 bp, Mus musculus
ttaccaatagttcagacatcctaca

SEQ ID NO: 984873 - DNA, 25 bp, Mus musculus
ttaccacctcccaacattccacttt

SEQ ID NO: 984874 - DNA, 25 bp, Mus musculus
ttaccacctcccaagattccacttt

SEQ ID NO: 984875 - DNA, 25 bp, Mus musculus
ttaccacctgtgctggactggtgat

SEQ ID NO: 984876 - DNA, 25 bp, Mus musculus
ttaccacctgtggtggactggtgat

SEQ ID NO: 984877 - DNA, 25 bp, Mus musculus
ttaccacgggattgaatattgcctg

SEQ ID NO: 984878 - DNA, 25 bp, Mus musculus
ttaccacgggattgtatattgcctg

SEQ ID NO: 984879 - DNA, 25 bp, Mus musculus
ttaccagcttctatagaggaagggt

SEQ ID NO: 984880 - DNA, 25 bp, Mus musculus
ttaccagcttctattgaggaagggt

SEQ ID NO: 984881 - DNA, 25 bp, Mus musculus
ttaccatcatcacacacaccacggc

SEQ ID NO: 984882 - DNA, 25 bp, Mus musculus
ttaccatcatcacacattctcgagc

SEQ ID NO: 984883 - DNA, 25 bp, Mus musculus
ttaccatcatcacagacaccacggc

SEQ ID NO: 984884 - DNA, 25 bp, Mus musculus
ttaccatcatcacagattctcgagc

SEQ ID NO: 984885 - DNA, 25 bp, Mus musculus
ttaccatccccacgtcactggatgg

SEQ ID NO: 984886 - DNA, 25 bp, Mus musculus
ttaccatccccaggtcactggatgg

SEQ ID NO: 984887 - DNA, 25 bp, Mus musculus
ttaccattgaccagcctgtgcagat

SEQ ID NO: 984888 - DNA, 25 bp, Mus musculus
ttaccattgaccaggctgtgcagat

SEQ ID NO: 984889 - DNA, 25 bp, Mus musculus
ttacccaaagcccacctggaagcag

SEQ ID NO: 984890 - DNA, 25 bp, Mus musculus
ttacccaaaggccacctggaagcag

SEQ ID NO: 984891 - DNA, 25 bp, Mus musculus
ttacccactcaaaacttcttcagtg

SEQ ID NO: 984892 - DNA, 25 bp, Mus musculus
ttacccactcaaaagttcttcagtg

SEQ ID NO: 984893 - DNA, 25 bp, Mus musculus
ttacccattttctcaatgagtattg

SEQ ID NO: 984894 - DNA, 25 bp, Mus musculus
ttacccattttctctatgagtattg

SEQ ID NO: 984895 - DNA, 25 bp, Mus musculus
ttaccgatggatctggtggccctcc

SEQ ID NO: 984896 - DNA, 25 bp, Mus musculus
ttaccgatggttctggtggccctcc

SEQ ID NO: 984897 - DNA, 25 bp, Mus musculus
ttacctaagagacgtgagcgcttac

SEQ ID NO: 984898 - DNA, 25 bp, Mus musculus
ttacctaagagaggtgagcgcttac

SEQ ID NO: 984899 - DNA, 25 bp, Mus musculus
ttacctccagaacccgctcagttgt

SEQ ID NO: 984900 - DNA, 25 bp, Mus musculus
ttacctccagtacccgctcagttgt

SEQ ID NO: 984901 - DNA, 25 bp, Mus musculus
ttacctctccaactgcttgtatgtc

SEQ ID NO: 984902 - DNA, 25 bp, Mus musculus
ttacctctccaagtgcttgtatgtc

SEQ ID NO: 984903 - DNA, 25 bp, Mus musculus
ttacctcttcagcctctgtgttccg

SEQ ID NO: 984904 - DNA, 25 bp, Mus musculus
ttacctcttcaggctctgtgttccg

SEQ ID NO: 984905 - DNA, 25 bp, Mus musculus
ttacctgccacactgctgagtacgt

SEQ ID NO: 984906 - DNA, 25 bp, Mus musculus
ttacctgccacagtgctgagtacgt

SEQ ID NO: 984907 - DNA, 25 bp, Mus musculus
ttacctgcgacccacccattcattg

SEQ ID NO: 984908 - DNA, 25 bp, Mus musculus
ttacctgcgacccacgtgcctggct

SEQ ID NO: 984909 - DNA, 25 bp, Mus musculus
ttacctgcgacccagccattcattg

SEQ ID NO: 984910 - DNA, 25 bp, Mus musculus
ttacctgcgacccaggtgcctggct

SEQ ID NO: 984911 - DNA, 25 bp, Mus musculus
ttacctgctcagcacaatcgggttg

SEQ ID NO: 984912 - DNA, 25 bp, Mus musculus
ttacctgctcagcagaatcgggttg

SEQ ID NO: 984913 - DNA, 25 bp, Mus musculus
ttacctggtggacaatgatggagaa

SEQ ID NO: 984914 - DNA, 25 bp, Mus musculus
ttacctggtggacattgatggagaa

SEQ ID NO: 984915 - DNA, 25 bp, Mus musculus
ttaccttgccagcagactacggata

SEQ ID NO: 984916 - DNA, 25 bp, Mus musculus
ttaccttgccaggagactacggata

SEQ ID NO: 984917 - DNA, 25 bp, Mus musculus
ttacctttgcagaaagaagaatcct

SEQ ID NO: 984918 - DNA, 25 bp, Mus musculus
ttacctttgcagtaagaagaatcct

SEQ ID NO: 984919 - DNA, 25 bp, Mus musculus
ttacgaacggagacacagttcgatc

SEQ ID NO: 984920 - DNA, 25 bp, Mus musculus
ttacgaacggagtcacagttcgatc

SEQ ID NO: 984921 - DNA, 25 bp, Mus musculus
ttacgaagtgatgggagtctgatgt

SEQ ID NO: 984922 - DNA, 25 bp, Mus musculus
ttacgaagtgttgggagtctgatgt

SEQ ID NO: 984923 - DNA, 25 bp, Mus musculus
ttacgactacagaagtgacctctag

SEQ ID NO: 984924 - DNA, 25 bp, Mus musculus
ttacgactacagaagtgacctctgg

SEQ ID NO: 984925 - DNA, 25 bp, Mus musculus
ttacgactacagtagtgacctctag

SEQ ID NO: 984926 - DNA, 25 bp, Mus musculus
ttacgactacagtagtgacctctgg

SEQ ID NO: 984927 - DNA, 25 bp, Mus musculus
ttacgatgaacacgtagctgcacaa

SEQ ID NO: 984928 - DNA, 25 bp, Mus musculus
ttacgatgaacaggtagctgcacaa

SEQ ID NO: 984929 - DNA, 25 bp, Mus musculus
ttacgctgggcactacgtcggtgac

SEQ ID NO: 984930 - DNA, 25 bp, Mus musculus
ttacgctgggcagtacgtcggtgac

SEQ ID NO: 984931 - DNA, 25 bp, Mus musculus
ttacggagccagccatgagaagttg

SEQ ID NO: 984932 - DNA, 25 bp, Mus musculus
ttacggagccaggcatgagaagttg

SEQ ID NO: 984933 - DNA, 25 bp, Mus musculus
ttacggagggcactaaatcgtcctg

SEQ ID NO: 984934 - DNA, 25 bp, Mus musculus
ttacggagggcagtaaatcgtcctg

SEQ ID NO: 984935 - DNA, 25 bp, Mus musculus
ttacgtcatgaactatgagatgtcc

SEQ ID NO: 984936 - DNA, 25 bp, Mus musculus
ttacgtcatgtactatgagatgtcc

SEQ ID NO: 984937 - DNA, 25 bp, Mus musculus
ttacgtgaagagagggcacatctgc

SEQ ID NO: 984938 - DNA, 25 bp, Mus musculus
ttacgtgaagagtgggcacatctgc

SEQ ID NO: 984939 - DNA, 25 bp, Mus musculus
ttacgttcactccagacctatgaaa

SEQ ID NO: 984940 - DNA, 25 bp, Mus musculus
ttacgttcactcgagacctatgaaa

SEQ ID NO: 984941 - DNA, 25 bp, Mus musculus
ttactaaaacagccatcaggaaaga

SEQ ID NO: 984942 - DNA, 25 bp, Mus musculus
ttactaaaacaggcatcaggaaaga

SEQ ID NO: 984943 - DNA, 25 bp, Mus musculus
ttactaacagcaagttcaatgtcgg

SEQ ID NO: 984944 - DNA, 25 bp, Mus musculus
ttactaacaggaagttcaatgtcgg

SEQ ID NO: 984945 - DNA, 25 bp, Mus musculus
ttactaatcaaaatacgcctactat

SEQ ID NO: 984946 - DNA, 25 bp, Mus musculus
ttactaatcaaactggacccaacag

SEQ ID NO: 984947 - DNA, 25 bp, Mus musculus
ttactaatcaaagtggacccaacag

SEQ ID NO: 984948 - DNA, 25 bp, Mus musculus
ttactaatcaaattacgcctactat

SEQ ID NO: 984949 - DNA, 25 bp, Mus musculus
ttactacaagcaagctgcccaagct

SEQ ID NO: 984950 - DNA, 25 bp, Mus musculus
ttactacaaggaagctgcccaagct

SEQ ID NO: 984951 - DNA, 25 bp, Mus musculus
ttactacatagcaggcttttttctc

SEQ ID NO: 984952 - DNA, 25 bp, Mus musculus
ttactacatagctggcttttttctc

SEQ ID NO: 984953 - DNA, 25 bp, Mus musculus
ttactatcaaagaattctgcagatg

SEQ ID NO: 984954 - DNA, 25 bp, Mus musculus
ttactatcaaagtattctgcagatg

SEQ ID NO: 984955 - DNA, 25 bp, Mus musculus
ttactatgaaaacggatggatcttt

SEQ ID NO: 984956 - DNA, 25 bp, Mus musculus
ttactatgaaaacgtgacgtgcaca

SEQ ID NO: 984957 - DNA, 25 bp, Mus musculus
ttactatgaaaagggatggatcttt

SEQ ID NO: 984958 - DNA, 25 bp, Mus musculus
ttactatgaaaaggtgacgtgcaca

SEQ ID NO: 984959 - DNA, 25 bp, Mus musculus
ttactatgtttacggcagtgcttga

SEQ ID NO: 984960 - DNA, 25 bp, Mus musculus
ttactatgtttagggcagtgcttga

SEQ ID NO: 984961 - DNA, 25 bp, Mus musculus
ttactcaaccagcgtgaacacttcg

SEQ ID NO: 984962 - DNA, 25 bp, Mus musculus
ttactcaaccagggtgaacacttcg

SEQ ID NO: 984963 - DNA, 25 bp, Mus musculus
ttactccaccaacgcttacctgatg

SEQ ID NO: 984964 - DNA, 25 bp, Mus musculus
ttactccaccaaggcttacctgatg

SEQ ID NO: 984965 - DNA, 25 bp, Mus musculus
ttactccatggaagatttggcaagt

SEQ ID NO: 984966 - DNA, 25 bp, Mus musculus
ttactccatggatgatttggcaagt

SEQ ID NO: 984967 - DNA, 25 bp, Mus musculus
ttactcccccatccagaagatttag

SEQ ID NO: 984968 - DNA, 25 bp, Mus musculus
ttactcccccatgcagaagatttag

SEQ ID NO: 984969 - DNA, 25 bp, Mus musculus
ttactcccggcagcagtacgttttg

SEQ ID NO: 984970 - DNA, 25 bp, Mus musculus
ttactcccggcagctgtacgttttg

SEQ ID NO: 984971 - DNA, 25 bp, Mus musculus
ttactcctgctgcgggctggagaat

SEQ ID NO: 984972 - DNA, 25 bp, Mus musculus
ttactcctgctgggggctggagaat

SEQ ID NO: 984973 - DNA, 25 bp, Mus musculus
ttactcgcagagagatgagtcagaa

SEQ ID NO: 984974 - DNA, 25 bp, Mus musculus
ttactcgcagcgcaacaaagaatca

SEQ ID NO: 984975 - DNA, 25 bp, Mus musculus
ttactcgcagggcaacaaagaatca

SEQ ID NO: 984976 - DNA, 25 bp, Mus musculus
ttactcgcagtgagatgagtcagaa

SEQ ID NO: 984977 - DNA, 25 bp, Mus musculus
ttactcggcaaacatggctcacatg

SEQ ID NO: 984978 - DNA, 25 bp, Mus musculus
ttactcggcaaagatggctcacatg

SEQ ID NO: 984979 - DNA, 25 bp, Mus musculus
ttactctcaacacatcacagtcagt

SEQ ID NO: 984980 - DNA, 25 bp, Mus musculus
ttactctcaacagatcacagtcagt

SEQ ID NO: 984981 - DNA, 25 bp, Mus musculus
ttactctgacaaaaaggatgcaccc

SEQ ID NO: 984982 - DNA, 25 bp, Mus musculus
ttactctgacaaaatggatgcaccc

SEQ ID NO: 984983 - DNA, 25 bp, Mus musculus
ttactgacagcttttgcctaccaaa

SEQ ID NO: 984984 - DNA, 25 bp, Mus musculus
ttactgacaggttttgcctaccaaa

SEQ ID NO: 984985 - DNA, 25 bp, Mus musculus
ttactgagccccggaacaggctccg

SEQ ID NO: 984986 - DNA, 25 bp, Mus musculus
ttactgagccccggtacaggctccg

SEQ ID NO: 984987 - DNA, 25 bp, Mus musculus
ttactgatcgaaatgaaagaattca

SEQ ID NO: 984988 - DNA, 25 bp, Mus musculus
ttactgatcgaattgaaagaattca

SEQ ID NO: 984989 - DNA, 25 bp, Mus musculus
ttactgcacttgacaccatggtatg

SEQ ID NO: 984990 - DNA, 25 bp, Mus musculus
ttactgcacttgtcaccatggtatg

SEQ ID NO: 984991 - DNA, 25 bp, Mus musculus
ttactgctaccgccatcttagaact

SEQ ID NO: 984992 - DNA, 25 bp, Mus musculus
ttactgctaccgctgtggcaatgtg

SEQ ID NO: 984993 - DNA, 25 bp, Mus musculus
ttactgctaccggcatcttagaact

SEQ ID NO: 984994 - DNA, 25 bp, Mus musculus
ttactgctaccggtgtggcaatgtg

SEQ ID NO: 984995 - DNA, 25 bp, Mus musculus
ttactgctgccctaccagggtcgga

SEQ ID NO: 984996 - DNA, 25 bp, Mus musculus
ttactgctgccctacggtcggagct

SEQ ID NO: 984997 - DNA, 25 bp, Mus musculus
ttactgctgccctagcagggtcgga

SEQ ID NO: 984998 - DNA, 25 bp, Mus musculus
ttactgctgccctagggtcggagct

SEQ ID NO: 984999 - DNA, 25 bp, Mus musculus
ttactggatgatgcagtaaaaagaa

SEQ ID NO: 985000 - DNA, 25 bp, Mus musculus
ttactggatgatgctgtaaaaagaa

SEQ ID NO: 985001 - DNA, 25 bp, Mus musculus
ttactgtccaggagacacaatgtaa

SEQ ID NO: 985002 - DNA, 25 bp, Mus musculus
ttactgtccaggtgacacaatgtaa

SEQ ID NO: 985003 - DNA, 25 bp, Mus musculus
ttactgtgagataaattgtcagaaa

SEQ ID NO: 985004 - DNA, 25 bp, Mus musculus
ttactgtgagattaattgtcagaaa

SEQ ID NO: 985005 - DNA, 25 bp, Mus musculus
ttactgtgctggagccccccagtca

SEQ ID NO: 985006 - DNA, 25 bp, Mus musculus
ttactgtgctggtgccccccagtca

SEQ ID NO: 985007 - DNA, 25 bp, Mus musculus
ttactgtggccacgatcgacgtgtc

SEQ ID NO: 985008 - DNA, 25 bp, Mus musculus
ttactgtggccaggatcgacgtgtc

SEQ ID NO: 985009 - DNA, 25 bp, Mus musculus
ttacttagtgcagagaacagatact

SEQ ID NO: 985010 - DNA, 25 bp, Mus musculus
ttacttagtgctgagacgtggaatc

SEQ ID NO: 985011 - DNA, 25 bp, Mus musculus
ttacttagtggagagaacagatact

SEQ ID NO: 985012 - DNA, 25 bp, Mus musculus
ttacttagtggtgagacgtggaatc

SEQ ID NO: 985013 - DNA, 25 bp, Mus musculus
ttacttatacagcaggcctgatgga

SEQ ID NO: 985014 - DNA, 25 bp, Mus musculus
ttacttatacagccctgatggaatt

SEQ ID NO: 985015 - DNA, 25 bp, Mus musculus
ttacttatacaggaggcctgatgga

SEQ ID NO: 985016 - DNA, 25 bp, Mus musculus
ttacttatacaggcctgatggaatt

SEQ ID NO: 985017 - DNA, 25 bp, Mus musculus
ttacttcaagcgcctgtggaagtca

SEQ ID NO: 985018 - DNA, 25 bp, Mus musculus
ttacttcaagggcctgtggaagtca

SEQ ID NO: 985019 - DNA, 25 bp, Mus musculus
ttacttgcagatggaaaagattttg

SEQ ID NO: 985020 - DNA, 25 bp, Mus musculus
ttacttgcagttggaaaagattttg

SEQ ID NO: 985021 - DNA, 25 bp, Mus musculus
ttactttaagacagagcacaaattg

SEQ ID NO: 985022 - DNA, 25 bp, Mus musculus
ttactttaagagcacaaattggaga

SEQ ID NO: 985023 - DNA, 25 bp, Mus musculus
ttactttaagcacaaattggagatc

SEQ ID NO: 985024 - DNA, 25 bp, Mus musculus
ttactttaaggacaaattggagatc

SEQ ID NO: 985025 - DNA, 25 bp, Mus musculus
ttactttaagtcagagcacaaattg

SEQ ID NO: 985026 - DNA, 25 bp, Mus musculus
ttactttaagtgcacaaattggaga

SEQ ID NO: 985027 - DNA, 25 bp, Mus musculus
ttactttcaacatcaaagtggctag

SEQ ID NO: 985028 - DNA, 25 bp, Mus musculus
ttactttcaagatcaaagtggctag

SEQ ID NO: 985029 - DNA, 25 bp, Mus musculus
ttactttcaatggacagccgtgcag

SEQ ID NO: 985030 - DNA, 25 bp, Mus musculus
ttactttcaatggagagccgtgcag

SEQ ID NO: 985031 - DNA, 25 bp, Mus musculus
ttactttcagataacgttccgagaa

SEQ ID NO: 985032 - DNA, 25 bp, Mus musculus
ttactttcagataaggttccgagaa

SEQ ID NO: 985033 - DNA, 25 bp, Mus musculus
ttactttgtcaactttctggatgct

SEQ ID NO: 985034 - DNA, 25 bp, Mus musculus
ttactttgtcaagtttctggatgct

SEQ ID NO: 985035 - DNA, 25 bp, Mus musculus
ttacttttataacgctgtgtgcaag

SEQ ID NO: 985036 - DNA, 25 bp, Mus musculus
ttacttttataaggctgtgtgcaag

SEQ ID NO: 985037 - DNA, 25 bp, Mus musculus
ttagaaaaaaagctggacatgagca

SEQ ID NO: 985038 - DNA, 25 bp, Mus musculus
ttagaaaaaaaggtggacatgagca

SEQ ID NO: 985039 - DNA, 25 bp, Mus musculus
ttagaaacaaatcggatggaagact

SEQ ID NO: 985040 - DNA, 25 bp, Mus musculus
ttagaaacaaatcgtgaagaagatg

SEQ ID NO: 985041 - DNA, 25 bp, Mus musculus
ttagaaacaaatgggatggaagact

SEQ ID NO: 985042 - DNA, 25 bp, Mus musculus
ttagaaacaaatggtgaagaagatg

SEQ ID NO: 985043 - DNA, 25 bp, Mus musculus
ttagaaattgaagacggcaaactgg

SEQ ID NO: 985044 - DNA, 25 bp, Mus musculus
ttagaaattgaagagggcaaactgg

SEQ ID NO: 985045 - DNA, 25 bp, Mus musculus
ttagaaccagaacagccaccaacca

SEQ ID NO: 985046 - DNA, 25 bp, Mus musculus
ttagaaccagaacatgccatctcat

SEQ ID NO: 985047 - DNA, 25 bp, Mus musculus
ttagaaccagaacgagcaccgtact

SEQ ID NO: 985048 - DNA, 25 bp, Mus musculus
ttagaaccagaagagccaccaacca

SEQ ID NO: 985049 - DNA, 25 bp, Mus musculus
ttagaaccagaagatgccatctcat

SEQ ID NO: 985050 - DNA, 25 bp, Mus musculus
ttagaaccagaaggagcaccgtact

SEQ ID NO: 985051 - DNA, 25 bp, Mus musculus
ttagaactgcagatattccgaggaa

SEQ ID NO: 985052 - DNA, 25 bp, Mus musculus
ttagaactgcagttattccgaggaa

SEQ ID NO: 985053 - DNA, 25 bp, Mus musculus
ttagaagaagagctctggatgttct

SEQ ID NO: 985054 - DNA, 25 bp, Mus musculus
ttagaagaagtgctctggatgttct

SEQ ID NO: 985055 - DNA, 25 bp, Mus musculus
ttagaagatttacatctttcaagca

SEQ ID NO: 985056 - DNA, 25 bp, Mus musculus
ttagaagatttagatctttcaagca

SEQ ID NO: 985057 - DNA, 25 bp, Mus musculus
ttagaagctctgaatgacaaaaagc

SEQ ID NO: 985058 - DNA, 25 bp, Mus musculus
ttagaagctctgtatgacaaaaagc

SEQ ID NO: 985059 - DNA, 25 bp, Mus musculus
ttagaattagacagttcatcatcat

SEQ ID NO: 985060 - DNA, 25 bp, Mus musculus
ttagaattagtcagttcatcatcat

SEQ ID NO: 985061 - DNA, 25 bp, Mus musculus
ttagacaagcagaacgtggtgaagc

SEQ ID NO: 985062 - DNA, 25 bp, Mus musculus
ttagacaagcagaaggtggtgaagc

SEQ ID NO: 985063 - DNA, 25 bp, Mus musculus
ttagacagagagaatcggatatcac

SEQ ID NO: 985064 - DNA, 25 bp, Mus musculus
ttagacagagtgaatcggatatcac

SEQ ID NO: 985065 - DNA, 25 bp, Mus musculus
ttagaccatgaggtgaccatcatca

SEQ ID NO: 985066 - DNA, 25 bp, Mus musculus
ttagaccatgccacccgatggcctc

SEQ ID NO: 985067 - DNA, 25 bp, Mus musculus
ttagaccatggcacccgatggcctc

SEQ ID NO: 985068 - DNA, 25 bp, Mus musculus
ttagaccatgtggtgaccatcatca

SEQ ID NO: 985069 - DNA, 25 bp, Mus musculus
ttagacttggatccttgggatgctg

SEQ ID NO: 985070 - DNA, 25 bp, Mus musculus
ttagacttggatgcttgggatgctg

SEQ ID NO: 985071 - DNA, 25 bp, Mus musculus
ttagacttggccagcgagccacagc

SEQ ID NO: 985072 - DNA, 25 bp, Mus musculus
ttagacttggccagggagccacagc

SEQ ID NO: 985073 - DNA, 25 bp, Mus musculus
ttagagcaaagacgataaaggagaa

SEQ ID NO: 985074 - DNA, 25 bp, Mus musculus
ttagagcaaagaggataaaggagaa

SEQ ID NO: 985075 - DNA, 25 bp, Mus musculus
ttagagcctatgcatctgactgtag

SEQ ID NO: 985076 - DNA, 25 bp, Mus musculus
ttagagcctatggatctgactgtag

SEQ ID NO: 985077 - DNA, 25 bp, Mus musculus
ttagagcctgaacacagagctgaaa

SEQ ID NO: 985078 - DNA, 25 bp, Mus musculus
ttagagcctgaacagagagctgaaa

SEQ ID NO: 985079 - DNA, 25 bp, Mus musculus
ttagagtaattacgcaacaggttcc

SEQ ID NO: 985080 - DNA, 25 bp, Mus musculus
ttagagtaattaggcaacaggttcc

SEQ ID NO: 985081 - DNA, 25 bp, Mus musculus
ttagataacagacctgcacgaaacc

SEQ ID NO: 985082 - DNA, 25 bp, Mus musculus
ttagataacagagctgcacgaaacc

SEQ ID NO: 985083 - DNA, 25 bp, Mus musculus
ttagatgatcagagtggtaagaaaa

SEQ ID NO: 985084 - DNA, 25 bp, Mus musculus
ttagatgatcagtgtggtaagaaaa

SEQ ID NO: 985085 - DNA, 25 bp, Mus musculus
ttagatgatgttggagatctgaaaa

SEQ ID NO: 985086 - DNA, 25 bp, Mus musculus
ttagatgatgttggtgatctgaaaa

SEQ ID NO: 985087 - DNA, 25 bp, Mus musculus
ttagatgcagatgggagaagctgta

SEQ ID NO: 985088 - DNA, 25 bp, Mus musculus
ttagatgcagttgggagaagctgta

SEQ ID NO: 985089 - DNA, 25 bp, Mus musculus
ttagatggctcaaacgcaataataa

SEQ ID NO: 985090 - DNA, 25 bp, Mus musculus
ttagatggctcaaaggcaataataa

SEQ ID NO: 985091 - DNA, 25 bp, Mus musculus
ttagatttagacattcaaacacaac

SEQ ID NO: 985092 - DNA, 25 bp, Mus musculus
ttagatttagtcattcaaacacaac

SEQ ID NO: 985093 - DNA, 25 bp, Mus musculus
ttagcaaattctctgtctgctcacc

SEQ ID NO: 985094 - DNA, 25 bp, Mus musculus
ttagcaaattgtctgtctgctcacc

SEQ ID NO: 985095 - DNA, 25 bp, Mus musculus
ttagcaaggccactgatctagagaa

SEQ ID NO: 985096 - DNA, 25 bp, Mus musculus
ttagcaaggccagtgatctagagaa

SEQ ID NO: 985097 - DNA, 25 bp, Mus musculus
ttagcagaaatgaaatgggctcggt

SEQ ID NO: 985098 - DNA, 25 bp, Mus musculus
ttagcagaaatgaattgggctcggt

SEQ ID NO: 985099 - DNA, 25 bp, Mus musculus
ttagcagaacagctgtttggatttg

SEQ ID NO: 985100 - DNA, 25 bp, Mus musculus
ttagcagaacaggtgtttggatttg

SEQ ID NO: 985101 - DNA, 25 bp, Mus musculus
ttagcatcggcacgacagcagcgct

SEQ ID NO: 985102 - DNA, 25 bp, Mus musculus
ttagcatcggcaggacagcagcgct

SEQ ID NO: 985103 - DNA, 25 bp, Mus musculus
ttagcatggcagatgaaccggacaa

SEQ ID NO: 985104 - DNA, 25 bp, Mus musculus
ttagcatggcagttgaaccggacaa

SEQ ID NO: 985105 - DNA, 25 bp, Mus musculus
ttagcattccttttccccctcatat

SEQ ID NO: 985106 - DNA, 25 bp, Mus musculus
ttagcattccttttgcccctcatat

SEQ ID NO: 985107 - DNA, 25 bp, Mus musculus
ttagccaagacacatcggcgatagc

SEQ ID NO: 985108 - DNA, 25 bp, Mus musculus
ttagccaagacagatcggcgatagc

SEQ ID NO: 985109 - DNA, 25 bp, Mus musculus
ttagccgagcgtaacatcccctgct

SEQ ID NO: 985110 - DNA, 25 bp, Mus musculus
ttagccgagcgtaacgctgatggat

SEQ ID NO: 985111 - DNA, 25 bp, Mus musculus
ttagccgagcgtaagatcccctgct

SEQ ID NO: 985112 - DNA, 25 bp, Mus musculus
ttagccgagcgtaaggctgatggat

SEQ ID NO: 985113 - DNA, 25 bp, Mus musculus
ttagcctctaagaactgtgttcacc

SEQ ID NO: 985114 - DNA, 25 bp, Mus musculus
ttagcctctaagaagtgtgttcacc

SEQ ID NO: 985115 - DNA, 25 bp, Mus musculus
ttagccttggccaacgccaggttat

SEQ ID NO: 985116 - DNA, 25 bp, Mus musculus
ttagccttggccaaggccaggttat

SEQ ID NO: 985117 - DNA, 25 bp, Mus musculus
ttagcctttgagctgtgcctgcagt

SEQ ID NO: 985118 - DNA, 25 bp, Mus musculus
ttagcctttgaggtgtgcctgcagt

SEQ ID NO: 985119 - DNA, 25 bp, Mus musculus
ttagcgagcaggccgtaagaacaag

SEQ ID NO: 985120 - DNA, 25 bp, Mus musculus
ttagcgagcagggcgtaagaacaag

SEQ ID NO: 985121 - DNA, 25 bp, Mus musculus
ttagctacagcaagcagtttgagcc

SEQ ID NO: 985122 - DNA, 25 bp, Mus musculus
ttagctacagcagcatctggacccg

SEQ ID NO: 985123 - DNA, 25 bp, Mus musculus
ttagctacaggaagcagtttgagcc

SEQ ID NO: 985124 - DNA, 25 bp, Mus musculus
ttagctacaggagcatctggacccg

SEQ ID NO: 985125 - DNA, 25 bp, Mus musculus
ttagctacagtaaaagcccatccaa

SEQ ID NO: 985126 - DNA, 25 bp, Mus musculus
ttagctacagtaaatgcccatccaa

SEQ ID NO: 985127 - DNA, 25 bp, Mus musculus
ttagctccggcactgtggaggcgct

SEQ ID NO: 985128 - DNA, 25 bp, Mus musculus
ttagctccgggactgtggaggcgct

SEQ ID NO: 985129 - DNA, 25 bp, Mus musculus
ttagctgggacctacctgaactacc

SEQ ID NO: 985130 - DNA, 25 bp, Mus musculus
ttagctgggacctacgtatcacaag

SEQ ID NO: 985131 - DNA, 25 bp, Mus musculus
ttagctgggacctagctgaactacc

SEQ ID NO: 985132 - DNA, 25 bp, Mus musculus
ttagctgggacctaggtatcacaag

SEQ ID NO: 985133 - DNA, 25 bp, Mus musculus
ttaggaaaaccaatcgctcaccctg

SEQ ID NO: 985134 - DNA, 25 bp, Mus musculus
ttaggaaaaccaatggctcaccctg

SEQ ID NO: 985135 - DNA, 25 bp, Mus musculus
ttaggagcgaactgacaggccgtgg

SEQ ID NO: 985136 - DNA, 25 bp, Mus musculus
ttaggagcgatctgacaggccgtgg

SEQ ID NO: 985137 - DNA, 25 bp, Mus musculus
ttaggcagctcacgctcagggaaga

SEQ ID NO: 985138 - DNA, 25 bp, Mus musculus
ttaggcagctcaggctcagggaaga

SEQ ID NO: 985139 - DNA, 25 bp, Mus musculus
ttaggccgcggacgtcacaggctct

SEQ ID NO: 985140 - DNA, 25 bp, Mus musculus
ttaggccgcggaggtcacaggctct

SEQ ID NO: 985141 - DNA, 25 bp, Mus musculus
ttaggtaaatgacatcatgattctg

SEQ ID NO: 985142 - DNA, 25 bp, Mus musculus
ttaggtaaatgagatcatgattctg

SEQ ID NO: 985143 - DNA, 25 bp, Mus musculus
ttaggtcgagaatccttagacgacc

SEQ ID NO: 985144 - DNA, 25 bp, Mus musculus
ttaggtcgagtatccttagacgacc

SEQ ID NO: 985145 - DNA, 25 bp, Mus musculus
ttaggtgatccacgttttgtggtct

SEQ ID NO: 985146 - DNA, 25 bp, Mus musculus
ttaggtgatccaggttttgtggtct

SEQ ID NO: 985147 - DNA, 25 bp, Mus musculus
ttagtatcaaaacttctctattctc

SEQ ID NO: 985148 - DNA, 25 bp, Mus musculus
ttagtatcaaaagttctctattctc

SEQ ID NO: 985149 - DNA, 25 bp, Mus musculus
ttagtatgctgtcacatccccctgt

SEQ ID NO: 985150 - DNA, 25 bp, Mus musculus
ttagtatgctgtcagatccccctgt

SEQ ID NO: 985151 - DNA, 25 bp, Mus musculus
ttagtcacggagaactgctggagtg

SEQ ID NO: 985152 - DNA, 25 bp, Mus musculus
ttagtcacggagaagtgctggagtg

SEQ ID NO: 985153 - DNA, 25 bp, Mus musculus
ttagtcctcagacgccagttgttgc

SEQ ID NO: 985154 - DNA, 25 bp, Mus musculus
ttagtcctcagaggccagttgttgc

SEQ ID NO: 985155 - DNA, 25 bp, Mus musculus
ttagtcctgggaaacgtgtggtatc

SEQ ID NO: 985156 - DNA, 25 bp, Mus musculus
ttagtcctgggaaaggtgtggtatc

SEQ ID NO: 985157 - DNA, 25 bp, Mus musculus
ttagtctcagagcatagctctctac

SEQ ID NO: 985158 - DNA, 25 bp, Mus musculus
ttagtctcagaggatagctctctac

SEQ ID NO: 985159 - DNA, 25 bp, Mus musculus
ttagtgacccagcaaatgtgggttt

SEQ ID NO: 985160 - DNA, 25 bp, Mus musculus
ttagtgacccaggaaatgtgggttt

SEQ ID NO: 985161 - DNA, 25 bp, Mus musculus
ttagtgcttaagctagggaacatcc

SEQ ID NO: 985162 - DNA, 25 bp, Mus musculus
ttagtgcttaaggtagggaacatcc

SEQ ID NO: 985163 - DNA, 25 bp, Mus musculus
ttagtggaagaaagcacattgtagt

SEQ ID NO: 985164 - DNA, 25 bp, Mus musculus
ttagtggaagaatgcacattgtagt

SEQ ID NO: 985165 - DNA, 25 bp, Mus musculus
ttagtgttgaatctcagaattatat

SEQ ID NO: 985166 - DNA, 25 bp, Mus musculus
ttagtgttgaatctgagaattatat

SEQ ID NO: 985167 - DNA, 25 bp, Mus musculus
ttagttgacccacgccctgattttg

SEQ ID NO: 985168 - DNA, 25 bp, Mus musculus
ttagttgacccaggccctgattttg

SEQ ID NO: 985169 - DNA, 25 bp, Mus musculus
ttagttgttcaacagaaaccattta

SEQ ID NO: 985170 - DNA, 25 bp, Mus musculus
ttagttgttcaacatgggagaatga

SEQ ID NO: 985171 - DNA, 25 bp, Mus musculus
ttagttgttcaagagaaaccattta

SEQ ID NO: 985172 - DNA, 25 bp, Mus musculus
ttagttgttcaagatgggagaatga

SEQ ID NO: 985173 - DNA, 25 bp, Mus musculus
ttataaaaagccacagaagaatgag

SEQ ID NO: 985174 - DNA, 25 bp, Mus musculus
ttataaaaaggcacagaagaatgag

SEQ ID NO: 985175 - DNA, 25 bp, Mus musculus
ttataaaaatctgctgtatcttgga

SEQ ID NO: 985176 - DNA, 25 bp, Mus musculus
ttataaaaatgtcaatcaagaagtg

SEQ ID NO: 985177 - DNA, 25 bp, Mus musculus
ttataaaaatgtgaatcaagaagtg

SEQ ID NO: 985178 - DNA, 25 bp, Mus musculus
ttataaaaatgtgctgtatcttgga

SEQ ID NO: 985179 - DNA, 25 bp, Mus musculus
ttataaaatgctgtgactatcaagg

SEQ ID NO: 985180 - DNA, 25 bp, Mus musculus
ttataaaatggtgtgactatcaagg

SEQ ID NO: 985181 - DNA, 25 bp, Mus musculus
ttataaagaaagaagatcatcaaag

SEQ ID NO: 985182 - DNA, 25 bp, Mus musculus
ttataaagaaagtagatcatcaaag

SEQ ID NO: 985183 - DNA, 25 bp, Mus musculus
ttataacaaactcgatgcagagaat

SEQ ID NO: 985184 - DNA, 25 bp, Mus musculus
ttataacaaactggatgcagagaat

SEQ ID NO: 985185 - DNA, 25 bp, Mus musculus
ttataacaagcccaccgatgatatt

SEQ ID NO: 985186 - DNA, 25 bp, Mus musculus
ttataacaaggccaccgatgatatt

SEQ ID NO: 985187 - DNA, 25 bp, Mus musculus
ttataacatttgatgtgactggacc

SEQ ID NO: 985188 - DNA, 25 bp, Mus musculus
ttataacatttgttgtgactggacc

SEQ ID NO: 985189 - DNA, 25 bp, Mus musculus
ttataactaccacatgccaccgcag

SEQ ID NO: 985190 - DNA, 25 bp, Mus musculus
ttataactaccacgcttatacaact

SEQ ID NO: 985191 - DNA, 25 bp, Mus musculus
ttataactaccagatgccaccgcag

SEQ ID NO: 985192 - DNA, 25 bp, Mus musculus
ttataactaccaggcttatacaact

SEQ ID NO: 985193 - DNA, 25 bp, Mus musculus
ttataagaaccagctgcaccgccat

SEQ ID NO: 985194 - DNA, 25 bp, Mus musculus
ttataagaacgagctgcaccgccat

SEQ ID NO: 985195 - DNA, 25 bp, Mus musculus
ttataagtaaagagaacccatcttc

SEQ ID NO: 985196 - DNA, 25 bp, Mus musculus
ttataagtaaagtgaacccatcttc

SEQ ID NO: 985197 - DNA, 25 bp, Mus musculus
ttataatgagccaaagggtgtgtat

SEQ ID NO: 985198 - DNA, 25 bp, Mus musculus
ttataatgaggcaaagggtgtgtat

SEQ ID NO: 985199 - DNA, 25 bp, Mus musculus
ttatacaagaccagcggttcaagga

SEQ ID NO: 985200 - DNA, 25 bp, Mus musculus
ttatacaagaccaggggttcaagga

SEQ ID NO: 985201 - DNA, 25 bp, Mus musculus
ttatacacagctgcaaactcgtagt

SEQ ID NO: 985202 - DNA, 25 bp, Mus musculus
ttatacacaggtgcaaactcgtagt

SEQ ID NO: 985203 - DNA, 25 bp, Mus musculus
ttatacggctcgcagacaccaaatg

SEQ ID NO: 985204 - DNA, 25 bp, Mus musculus
ttatacggctcggagacaccaaatg

SEQ ID NO: 985205 - DNA, 25 bp, Mus musculus
ttatactggaagaagaaacagtcaa

SEQ ID NO: 985206 - DNA, 25 bp, Mus musculus
ttatactggaagtagaaacagtcaa

SEQ ID NO: 985207 - DNA, 25 bp, Mus musculus
ttatagataaagaacatttaatcac

SEQ ID NO: 985208 - DNA, 25 bp, Mus musculus
ttatagataaagaagatttaatcac

SEQ ID NO: 985209 - DNA, 25 bp, Mus musculus
ttatagtccttatgagtggcaaatg

SEQ ID NO: 985210 - DNA, 25 bp, Mus musculus
ttatagtccttatgtgtggcaaatg

SEQ ID NO: 985211 - DNA, 25 bp, Mus musculus
ttatagtctgattcctttctccttg

SEQ ID NO: 985212 - DNA, 25 bp, Mus musculus
ttatagtctgtttcctttctccttg

SEQ ID NO: 985213 - DNA, 25 bp, Mus musculus
ttatatcccgctggacttgctggag

SEQ ID NO: 985214 - DNA, 25 bp, Mus musculus
ttatatcccggtggacttgctggag

SEQ ID NO: 985215 - DNA, 25 bp, Mus musculus
ttatatgaatgcaacgatcagacca

SEQ ID NO: 985216 - DNA, 25 bp, Mus musculus
ttatatgaatgcaaggatcagacca

SEQ ID NO: 985217 - DNA, 25 bp, Mus musculus
ttatatgatgctcaaacattaatgg

SEQ ID NO: 985218 - DNA, 25 bp, Mus musculus
ttatatgatgctgaaacattaatgg

SEQ ID NO: 985219 - DNA, 25 bp, Mus musculus
ttatatgcaataacaagctgcagtt

SEQ ID NO: 985220 - DNA, 25 bp, Mus musculus
ttatatgcaatatcaagctgcagtt

SEQ ID NO: 985221 - DNA, 25 bp, Mus musculus
ttatatggagcaaaaaatgggctac

SEQ ID NO: 985222 - DNA, 25 bp, Mus musculus
ttatatggagcaaaagtatgaatta

SEQ ID NO: 985223 - DNA, 25 bp, Mus musculus
ttatatggagcaaataatgggctac

SEQ ID NO: 985224 - DNA, 25 bp, Mus musculus
ttatatggagcaaatgtatgaatta

SEQ ID NO: 985225 - DNA, 25 bp, Mus musculus
ttatattcaaccagctgtgaccata

SEQ ID NO: 985226 - DNA, 25 bp, Mus musculus
ttatattcaacctgctgtgaccata

SEQ ID NO: 985227 - DNA, 25 bp, Mus musculus
ttatcaaaagacttccaactgaata

SEQ ID NO: 985228 - DNA, 25 bp, Mus musculus
ttatcaaaagcatgcttcatgatga

SEQ ID NO: 985229 - DNA, 25 bp, Mus musculus
ttatcaaaaggatgcttcatgatga

SEQ ID NO: 985230 - DNA, 25 bp, Mus musculus
ttatcaaaagtcttccaactgaata

SEQ ID NO: 985231 - DNA, 25 bp, Mus musculus
ttatcaatgcagattttcccttccc

SEQ ID NO: 985232 - DNA, 25 bp, Mus musculus
ttatcaatgcagtttttcccttccc

SEQ ID NO: 985233 - DNA, 25 bp, Mus musculus
ttatcaccagcttctgcaaggggcg

SEQ ID NO: 985234 - DNA, 25 bp, Mus musculus
ttatcaccaggttctgcaaggggcg

SEQ ID NO: 985235 - DNA, 25 bp, Mus musculus
ttatcacccaagcttcagacaatga

SEQ ID NO: 985236 - DNA, 25 bp, Mus musculus
ttatcacccaaggttcagacaatga

SEQ ID NO: 985237 - DNA, 25 bp, Mus musculus
ttatcactttcaaacgcatctagtc

SEQ ID NO: 985238 - DNA, 25 bp, Mus musculus
ttatcactttcaaaggcatctagtc

SEQ ID NO: 985239 - DNA, 25 bp, Mus musculus
ttatcagaagattccagagtgtgga

SEQ ID NO: 985240 - DNA, 25 bp, Mus musculus
ttatcagaagccccaacttgaataa

SEQ ID NO: 985241 - DNA, 25 bp, Mus musculus
ttatcagaaggcccaacttgaataa

SEQ ID NO: 985242 - DNA, 25 bp, Mus musculus
ttatcagaagtttccagagtgtgga

SEQ ID NO: 985243 - DNA, 25 bp, Mus musculus
ttatcagcagctgaacacagagctc

SEQ ID NO: 985244 - DNA, 25 bp, Mus musculus
ttatcagcaggtgaacacagagctc

SEQ ID NO: 985245 - DNA, 25 bp, Mus musculus
ttatcagctgaacgctccctggctg

SEQ ID NO: 985246 - DNA, 25 bp, Mus musculus
ttatcagctgaaggctccctggctg

SEQ ID NO: 985247 - DNA, 25 bp, Mus musculus
ttatcagtctcaccatcctcatgtg

SEQ ID NO: 985248 - DNA, 25 bp, Mus musculus
ttatcagtctcagcatcctcatgtg

SEQ ID NO: 985249 - DNA, 25 bp, Mus musculus
ttatcatcaaaactcgaagtttggt

SEQ ID NO: 985250 - DNA, 25 bp, Mus musculus
ttatcatcaaaactggaagtttggt

SEQ ID NO: 985251 - DNA, 25 bp, Mus musculus
ttatcatccttaccaagagatgtcg

SEQ ID NO: 985252 - DNA, 25 bp, Mus musculus
ttatcatccttagcaagagatgtcg

SEQ ID NO: 985253 - DNA, 25 bp, Mus musculus
ttatcatcgggaaacgcgctgccta

SEQ ID NO: 985254 - DNA, 25 bp, Mus musculus
ttatcatcgggaaaggcgctgccta

SEQ ID NO: 985255 - DNA, 25 bp, Mus musculus
ttatcattctcactagtgggaagtg

SEQ ID NO: 985256 - DNA, 25 bp, Mus musculus
ttatcattctcacttgtgggaagtg

SEQ ID NO: 985257 - DNA, 25 bp, Mus musculus
ttatcatttaagaaaacatataaca

SEQ ID NO: 985258 - DNA, 25 bp, Mus musculus
ttatcatttaagtaaacatataaca

SEQ ID NO: 985259 - DNA, 25 bp, Mus musculus
ttatccaagccactgcccgccacta

SEQ ID NO: 985260 - DNA, 25 bp, Mus musculus
ttatccaagccagtgcccgccacta

SEQ ID NO: 985261 - DNA, 25 bp, Mus musculus
ttatccaatgctacatggactccat

SEQ ID NO: 985262 - DNA, 25 bp, Mus musculus
ttatccaatggtacatggactccat

SEQ ID NO: 985263 - DNA, 25 bp, Mus musculus
ttatccagcaatcatgttcgtgtca

SEQ ID NO: 985264 - DNA, 25 bp, Mus musculus
ttatccagcaatgatgttcgtgtca

SEQ ID NO: 985265 - DNA, 25 bp, Mus musculus
ttatccataaacaccgcttttttca

SEQ ID NO: 985266 - DNA, 25 bp, Mus musculus
ttatccataaacacggcttttttca

SEQ ID NO: 985267 - DNA, 25 bp, Mus musculus
ttatccccttatcacagcctgcccc

SEQ ID NO: 985268 - DNA, 25 bp, Mus musculus
ttatccccttatcagagcctgcccc

SEQ ID NO: 985269 - DNA, 25 bp, Mus musculus
ttatcctatgcacactcatgaacaa

SEQ ID NO: 985270 - DNA, 25 bp, Mus musculus
ttatcctatgcagactcatgaacaa

SEQ ID NO: 985271 - DNA, 25 bp, Mus musculus
ttatcctgtgctgtgagtgttgagt

SEQ ID NO: 985272 - DNA, 25 bp, Mus musculus
ttatcctgtggtgtgagtgttgagt

SEQ ID NO: 985273 - DNA, 25 bp, Mus musculus
ttatctacatttcacacatcccgct

SEQ ID NO: 985274 - DNA, 25 bp, Mus musculus
ttatctacatttcacatcctcctac

SEQ ID NO: 985275 - DNA, 25 bp, Mus musculus
ttatctacatttcagacatcccgct

SEQ ID NO: 985276 - DNA, 25 bp, Mus musculus
ttatctacatttcagatcctcctac

SEQ ID NO: 985277 - DNA, 25 bp, Mus musculus
ttatctcactatcctttgtgagatc

SEQ ID NO: 985278 - DNA, 25 bp, Mus musculus
ttatctcactttcctttgtgagatc

SEQ ID NO: 985279 - DNA, 25 bp, Mus musculus
ttatctctgttgcggcttcacacct

SEQ ID NO: 985280 - DNA, 25 bp, Mus musculus
ttatctctgttggggcttcacacct

SEQ ID NO: 985281 - DNA, 25 bp, Mus musculus
ttatctgcaaatcagattgtgtaga

SEQ ID NO: 985282 - DNA, 25 bp, Mus musculus
ttatctgcaattcagattgtgtaga

SEQ ID NO: 985283 - DNA, 25 bp, Mus musculus
ttatcttaagaggacgtccttgttc

SEQ ID NO: 985284 - DNA, 25 bp, Mus musculus
ttatcttaagaggaggtccttgttc

SEQ ID NO: 985285 - DNA, 25 bp, Mus musculus
ttatcttgaaaaccatactcccaca

SEQ ID NO: 985286 - DNA, 25 bp, Mus musculus
ttatcttgaaaagcatactcccaca

SEQ ID NO: 985287 - DNA, 25 bp, Mus musculus
ttatgaaagcagcgcttacatacct

SEQ ID NO: 985288 - DNA, 25 bp, Mus musculus
ttatgaaagcagggcttacatacct

SEQ ID NO: 985289 - DNA, 25 bp, Mus musculus
ttatgaacagatcaagcgggccatc

SEQ ID NO: 985290 - DNA, 25 bp, Mus musculus
ttatgaacagttcaagcgggccatc

SEQ ID NO: 985291 - DNA, 25 bp, Mus musculus
ttatgaagaaaacgatggatcatgc

SEQ ID NO: 985292 - DNA, 25 bp, Mus musculus
ttatgaagaaaaggatggatcatgc

SEQ ID NO: 985293 - DNA, 25 bp, Mus musculus
ttatgaattagttccagatgacctt

SEQ ID NO: 985294 - DNA, 25 bp, Mus musculus
ttatgaattagttcgagatgacctt

SEQ ID NO: 985295 - DNA, 25 bp, Mus musculus
ttatgacaaacaattttcagtatgg

SEQ ID NO: 985296 - DNA, 25 bp, Mus musculus
ttatgacaaacatttttcagtatgg

SEQ ID NO: 985297 - DNA, 25 bp, Mus musculus
ttatgagcagcatcagtatgagact

SEQ ID NO: 985298 - DNA, 25 bp, Mus musculus
ttatgagcagcctataactactcct

SEQ ID NO: 985299 - DNA, 25 bp, Mus musculus
ttatgagcaggatcagtatgagact

SEQ ID NO: 985300 - DNA, 25 bp, Mus musculus
ttatgagcaggctataactactcct

SEQ ID NO: 985301 - DNA, 25 bp, Mus musculus
ttatgaggatctatgatgcctattt

SEQ ID NO: 985302 - DNA, 25 bp, Mus musculus
ttatgaggatgtatgatgcctattt

SEQ ID NO: 985303 - DNA, 25 bp, Mus musculus
ttatgaggtgacagaaatgcttctc

SEQ ID NO: 985304 - DNA, 25 bp, Mus musculus
ttatgaggtgtcagaaatgcttctc

SEQ ID NO: 985305 - DNA, 25 bp, Mus musculus
ttatgatagaattttcagtgaatat

SEQ ID NO: 985306 - DNA, 25 bp, Mus musculus
ttatgatagatttttcagtgaatat

SEQ ID NO: 985307 - DNA, 25 bp, Mus musculus
ttatgatgagcccaagcacgtgagg

SEQ ID NO: 985308 - DNA, 25 bp, Mus musculus
ttatgatgaggccaagcacgtgagg

SEQ ID NO: 985309 - DNA, 25 bp, Mus musculus
ttatgcacacagcgacctgaagccc

SEQ ID NO: 985310 - DNA, 25 bp, Mus musculus
ttatgcacacagggacctgaagccc

SEQ ID NO: 985311 - DNA, 25 bp, Mus musculus
ttatgcactgctgaatcttgctaca

SEQ ID NO: 985312 - DNA, 25 bp, Mus musculus
ttatgcactggtgaatcttgctaca

SEQ ID NO: 985313 - DNA, 25 bp, Mus musculus
ttatgcagatagctagccgagagac

SEQ ID NO: 985314 - DNA, 25 bp, Mus musculus
ttatgcagataggtagccgagagac

SEQ ID NO: 985315 - DNA, 25 bp, Mus musculus
ttatgcaggagacgtgcagtatgat

SEQ ID NO: 985316 - DNA, 25 bp, Mus musculus
ttatgcaggagaggtgcagtatgat

SEQ ID NO: 985317 - DNA, 25 bp, Mus musculus
ttatgcagttgtgtcactatgcaag

SEQ ID NO: 985318 - DNA, 25 bp, Mus musculus
ttatgcagttgtgtgactatgcaag

SEQ ID NO: 985319 - DNA, 25 bp, Mus musculus
ttatgcatgctgctatggaaaagtt

SEQ ID NO: 985320 - DNA, 25 bp, Mus musculus
ttatgcatgctggtatggaaaagtt

SEQ ID NO: 985321 - DNA, 25 bp, Mus musculus
ttatgccaaagacatgaaggagtca

SEQ ID NO: 985322 - DNA, 25 bp, Mus musculus
ttatgccaaagagatgaaggagtca

SEQ ID NO: 985323 - DNA, 25 bp, Mus musculus
ttatgcccagctcatccttggaatc

SEQ ID NO: 985324 - DNA, 25 bp, Mus musculus
ttatgcccagctccaggctatgccc

SEQ ID NO: 985325 - DNA, 25 bp, Mus musculus
ttatgcccaggtcatccttggaatc

SEQ ID NO: 985326 - DNA, 25 bp, Mus musculus
ttatgcccaggtccaggctatgccc

SEQ ID NO: 985327 - DNA, 25 bp, Mus musculus
ttatgcctgacagacgggaatgtgt

SEQ ID NO: 985328 - DNA, 25 bp, Mus musculus
ttatgcctgacagaggggaatgtgt

SEQ ID NO: 985329 - DNA, 25 bp, Mus musculus
ttatgcctttgaccggggagacaat

SEQ ID NO: 985330 - DNA, 25 bp, Mus musculus
ttatgcctttgagcggggagacaat

SEQ ID NO: 985331 - DNA, 25 bp, Mus musculus
ttatgctagcagcctagcagaaatg

SEQ ID NO: 985332 - DNA, 25 bp, Mus musculus
ttatgctagcaggctagcagaaatg

SEQ ID NO: 985333 - DNA, 25 bp, Mus musculus
ttatgctcaacgaaggatatgagaa

SEQ ID NO: 985334 - DNA, 25 bp, Mus musculus
ttatgctcaaggaaggatatgagaa

SEQ ID NO: 985335 - DNA, 25 bp, Mus musculus
ttatgctggagacggccttgaaggt

SEQ ID NO: 985336 - DNA, 25 bp, Mus musculus
ttatgctggagagggccttgaaggt

SEQ ID NO: 985337 - DNA, 25 bp, Mus musculus
ttatgctggcaacgtgctctaccag

SEQ ID NO: 985338 - DNA, 25 bp, Mus musculus
ttatgctggcaaggtgctctaccag

SEQ ID NO: 985339 - DNA, 25 bp, Mus musculus
ttatggacagcactgaaagacttgc

SEQ ID NO: 985340 - DNA, 25 bp, Mus musculus
ttatggacaggactgaaagacttgc

SEQ ID NO: 985341 - DNA, 25 bp, Mus musculus
ttatggatctttctatcgaatgtca

SEQ ID NO: 985342 - DNA, 25 bp, Mus musculus
ttatggatctttgtatcgaatgtca

SEQ ID NO: 985343 - DNA, 25 bp, Mus musculus
ttatggccaatgagggtggatttct

SEQ ID NO: 985344 - DNA, 25 bp, Mus musculus
ttatggccaatgtgggtggatttct

SEQ ID NO: 985345 - DNA, 25 bp, Mus musculus
ttatggcgaggacccatcaagcaaa

SEQ ID NO: 985346 - DNA, 25 bp, Mus musculus
ttatggcgaggacgaggtgtagccc

SEQ ID NO: 985347 - DNA, 25 bp, Mus musculus
ttatggcgaggagccatcaagcaaa

SEQ ID NO: 985348 - DNA, 25 bp, Mus musculus
ttatggcgaggaggaggtgtagccc

SEQ ID NO: 985349 - DNA, 25 bp, Mus musculus
ttatgggaatgacagcgtcttcgtg

SEQ ID NO: 985350 - DNA, 25 bp, Mus musculus
ttatgggaatgagagcgtcttcgtg

SEQ ID NO: 985351 - DNA, 25 bp, Mus musculus
ttatgggatgaaaccgttctgtgat

SEQ ID NO: 985352 - DNA, 25 bp, Mus musculus
ttatgggatgaaacggttctgtgat

SEQ ID NO: 985353 - DNA, 25 bp, Mus musculus
ttatgggggacccacgccagagtcc

SEQ ID NO: 985354 - DNA, 25 bp, Mus musculus
ttatgggggacccaggccagagtcc

SEQ ID NO: 985355 - DNA, 25 bp, Mus musculus
ttatgggtatttcgtgctatacatt

SEQ ID NO: 985356 - DNA, 25 bp, Mus musculus
ttatgggtatttggtgctatacatt

SEQ ID NO: 985357 - DNA, 25 bp, Mus musculus
ttatgtcaggagatcaccttttcca

SEQ ID NO: 985358 - DNA, 25 bp, Mus musculus
ttatgtcaggagttcaccttttcca

SEQ ID NO: 985359 - DNA, 25 bp, Mus musculus
ttatgtccaccacatctccaagatg

SEQ ID NO: 985360 - DNA, 25 bp, Mus musculus
ttatgtccaccagatctccaagatg

SEQ ID NO: 985361 - DNA, 25 bp, Mus musculus
ttatgttgctatcgacaccgagttt

SEQ ID NO: 985362 - DNA, 25 bp, Mus musculus
ttatgttgctatggacaccgagttt

SEQ ID NO: 985363 - DNA, 25 bp, Mus musculus
ttatgtttggagcccatgacaccac

SEQ ID NO: 985364 - DNA, 25 bp, Mus musculus
ttatgtttggaggccatgacaccac

SEQ ID NO: 985365 - DNA, 25 bp, Mus musculus
ttattaaacgcatggctcccagcat

SEQ ID NO: 985366 - DNA, 25 bp, Mus musculus
ttattaaacggatggctcccagcat

SEQ ID NO: 985367 - DNA, 25 bp, Mus musculus
ttattaattcagctgatgctagact

SEQ ID NO: 985368 - DNA, 25 bp, Mus musculus
ttattaattcaggtgatgctagact

SEQ ID NO: 985369 - DNA, 25 bp, Mus musculus
ttattacaagcgcgaactttcctgc

SEQ ID NO: 985370 - DNA, 25 bp, Mus musculus
ttattacaagggcgaactttcctgc

SEQ ID NO: 985371 - DNA, 25 bp, Mus musculus
ttattagcaaagctgccaatgtgaa

SEQ ID NO: 985372 - DNA, 25 bp, Mus musculus
ttattagcaaaggtgccaatgtgaa

SEQ ID NO: 985373 - DNA, 25 bp, Mus musculus
ttattagcctttgacgtgtgcctgc

SEQ ID NO: 985374 - DNA, 25 bp, Mus musculus
ttattagcctttgaggtgtgcctgc

SEQ ID NO: 985375 - DNA, 25 bp, Mus musculus
ttattcaaggcctggtgtgtgcctt

SEQ ID NO: 985376 - DNA, 25 bp, Mus musculus
ttattcaaggcgtgtggaatattat

SEQ ID NO: 985377 - DNA, 25 bp, Mus musculus
ttattcaagggctggtgtgtgcctt

SEQ ID NO: 985378 - DNA, 25 bp, Mus musculus
ttattcaaggggtgtggaatattat

SEQ ID NO: 985379 - DNA, 25 bp, Mus musculus
ttattcacagccaaacgcactcctt

SEQ ID NO: 985380 - DNA, 25 bp, Mus musculus
ttattcacagcccacgttttctgct

SEQ ID NO: 985381 - DNA, 25 bp, Mus musculus
ttattcacagcccaggttttctgct

SEQ ID NO: 985382 - DNA, 25 bp, Mus musculus
ttattcacaggcaaacgcactcctt

SEQ ID NO: 985383 - DNA, 25 bp, Mus musculus
ttattccaaacacacccagccaatg

SEQ ID NO: 985384 - DNA, 25 bp, Mus musculus
ttattccaaacacacccccagccag

SEQ ID NO: 985385 - DNA, 25 bp, Mus musculus
ttattccaaacacagccagccaatg

SEQ ID NO: 985386 - DNA, 25 bp, Mus musculus
ttattccaaacacagccccagccag

SEQ ID NO: 985387 - DNA, 25 bp, Mus musculus
ttattccaaggcattatctcttgat

SEQ ID NO: 985388 - DNA, 25 bp, Mus musculus
ttattccaaggctttatctcttgat

SEQ ID NO: 985389 - DNA, 25 bp, Mus musculus
ttattccatactagtgggcagcagt

SEQ ID NO: 985390 - DNA, 25 bp, Mus musculus
ttattccatagtagtgggcagcagt

SEQ ID NO: 985391 - DNA, 25 bp, Mus musculus
ttattctatgcctagaaaatgccca

SEQ ID NO: 985392 - DNA, 25 bp, Mus musculus
ttattctatggctagaaaatgccca

SEQ ID NO: 985393 - DNA, 25 bp, Mus musculus
ttattctcagcacgatgcccaggaa

SEQ ID NO: 985394 - DNA, 25 bp, Mus musculus
ttattctcagcaggatgcccaggaa

SEQ ID NO: 985395 - DNA, 25 bp, Mus musculus
ttattcttgtgtcacgaactagtgg

SEQ ID NO: 985396 - DNA, 25 bp, Mus musculus
ttattcttgtgtcaggaactagtgg

SEQ ID NO: 985397 - DNA, 25 bp, Mus musculus
ttattgaaagctgacattcccactg

SEQ ID NO: 985398 - DNA, 25 bp, Mus musculus
ttattgaaaggtgacattcccactg

SEQ ID NO: 985399 - DNA, 25 bp, Mus musculus
ttattgatgaaatacactctttcct

SEQ ID NO: 985400 - DNA, 25 bp, Mus musculus
ttattgatgaaatagactctttcct

SEQ ID NO: 985401 - DNA, 25 bp, Mus musculus
ttattgatgaagctgtagaagtgtt

SEQ ID NO: 985402 - DNA, 25 bp, Mus musculus
ttattgatgaaggtgtagaagtgtt

SEQ ID NO: 985403 - DNA, 25 bp, Mus musculus
ttattgccacagcgacgagagatgg

SEQ ID NO: 985404 - DNA, 25 bp, Mus musculus
ttattgccacagggacgagagatgg

SEQ ID NO: 985405 - DNA, 25 bp, Mus musculus
ttattggaataaatggtgattactt

SEQ ID NO: 985406 - DNA, 25 bp, Mus musculus
ttattggaattaatggtgattactt

SEQ ID NO: 985407 - DNA, 25 bp, Mus musculus
ttattggagacaagttagtaggagg

SEQ ID NO: 985408 - DNA, 25 bp, Mus musculus
ttattggagacatgttagtaggagg

SEQ ID NO: 985409 - DNA, 25 bp, Mus musculus
ttattgtagacacgtactggcatag

SEQ ID NO: 985410 - DNA, 25 bp, Mus musculus
ttattgtagacaggtactggcatag

SEQ ID NO: 985411 - DNA, 25 bp, Mus musculus
ttattgtcagctctgtgagaacgac

SEQ ID NO: 985412 - DNA, 25 bp, Mus musculus
ttattgtcaggtctgtgagaacgac

SEQ ID NO: 985413 - DNA, 25 bp, Mus musculus
ttattgtgacagctacctgtgtgac

SEQ ID NO: 985414 - DNA, 25 bp, Mus musculus
ttattgtgacaggtacctgtgtgac

SEQ ID NO: 985415 - DNA, 25 bp, Mus musculus
ttatttacagcgacctcaagctgga

SEQ ID NO: 985416 - DNA, 25 bp, Mus musculus
ttatttacagggacctcaagctgga

SEQ ID NO: 985417 - DNA, 25 bp, Mus musculus
ttatttgtctctctcttctcacagg

SEQ ID NO: 985418 - DNA, 25 bp, Mus musculus
ttatttgtctgtctcttctcacagg

SEQ ID NO: 985419 - DNA, 25 bp, Mus musculus
ttattttaagagatcctggacctga

SEQ ID NO: 985420 - DNA, 25 bp, Mus musculus
ttattttaagagttcctggacctga

SEQ ID NO: 985421 - DNA, 25 bp, Mus musculus
ttattttcacaaagtggctacagga

SEQ ID NO: 985422 - DNA, 25 bp, Mus musculus
ttattttcacaatgtggctacagga

SEQ ID NO: 985423 - DNA, 25 bp, Mus musculus
ttattttgccagagactgtcaccat

SEQ ID NO: 985424 - DNA, 25 bp, Mus musculus
ttattttgccagtgactgtcaccat

SEQ ID NO: 985425 - DNA, 25 bp, Mus musculus
ttcaaaaacaagcaggaccagtatg

SEQ ID NO: 985426 - DNA, 25 bp, Mus musculus
ttcaaaaacaagcaggagccgagga

SEQ ID NO: 985427 - DNA, 25 bp, Mus musculus
ttcaaaaacaaggaggaccagtatg

SEQ ID NO: 985428 - DNA, 25 bp, Mus musculus
ttcaaaaacaaggaggagccgagga

SEQ ID NO: 985429 - DNA, 25 bp, Mus musculus
ttcaaaaaccagaacaatctaatca

SEQ ID NO: 985430 - DNA, 25 bp, Mus musculus
ttcaaaaaccagaagaatctaatca

SEQ ID NO: 985431 - DNA, 25 bp, Mus musculus
ttcaaaatgagagaaatgttctttg

SEQ ID NO: 985432 - DNA, 25 bp, Mus musculus
ttcaaaatgagagatatgttctttg

SEQ ID NO: 985433 - DNA, 25 bp, Mus musculus
ttcaaacacaagatggaaatctaca

SEQ ID NO: 985434 - DNA, 25 bp, Mus musculus
ttcaaacacaagttggaaatctaca

SEQ ID NO: 985435 - DNA, 25 bp, Mus musculus
ttcaaacatccacgtggctctggtc

SEQ ID NO: 985436 - DNA, 25 bp, Mus musculus
ttcaaacatccaggtggctctggtc

SEQ ID NO: 985437 - DNA, 25 bp, Mus musculus
ttcaaagacaagctcaaacatgtct

SEQ ID NO: 985438 - DNA, 25 bp, Mus musculus
ttcaaagacaagctgagggtggtga

SEQ ID NO: 985439 - DNA, 25 bp, Mus musculus
ttcaaagacaaggtcaaacatgtct

SEQ ID NO: 985440 - DNA, 25 bp, Mus musculus
ttcaaagacaaggtgagggtggtga

SEQ ID NO: 985441 - DNA, 25 bp, Mus musculus
ttcaaagactagaatgttgtgtcaa

SEQ ID NO: 985442 - DNA, 25 bp, Mus musculus
ttcaaagacttgaatgttgtgtcaa

SEQ ID NO: 985443 - DNA, 25 bp, Mus musculus
ttcaaagagacacgctactggaatg

SEQ ID NO: 985444 - DNA, 25 bp, Mus musculus
ttcaaagagacaggctactggaatg

SEQ ID NO: 985445 - DNA, 25 bp, Mus musculus
ttcaaagcagcccaatcatggaagc

SEQ ID NO: 985446 - DNA, 25 bp, Mus musculus
ttcaaagcaggccaatcatggaagc

SEQ ID NO: 985447 - DNA, 25 bp, Mus musculus
ttcaaagcgtggttcatctggtggc

SEQ ID NO: 985448 - DNA, 25 bp, Mus musculus
ttcaaagcgtggttgatctggtggc

SEQ ID NO: 985449 - DNA, 25 bp, Mus musculus
ttcaaaggacaactatttgtgcttt

SEQ ID NO: 985450 - DNA, 25 bp, Mus musculus
ttcaaaggacaagtatttgtgcttt

SEQ ID NO: 985451 - DNA, 25 bp, Mus musculus
ttcaaagtagaacgttacatccagg

SEQ ID NO: 985452 - DNA, 25 bp, Mus musculus
ttcaaagtagaaggttacatccagg

SEQ ID NO: 985453 - DNA, 25 bp, Mus musculus
ttcaaatacaaaccttaccaagaag

SEQ ID NO: 985454 - DNA, 25 bp, Mus musculus
ttcaaatacaaagcttaccaagaag

SEQ ID NO: 985455 - DNA, 25 bp, Mus musculus
ttcaaatacattcacgaagccgaaa

SEQ ID NO: 985456 - DNA, 25 bp, Mus musculus
ttcaaatacattcaggaagccgaaa

SEQ ID NO: 985457 - DNA, 25 bp, Mus musculus
ttcaaatcccaacttccgtgaggag

SEQ ID NO: 985458 - DNA, 25 bp, Mus musculus
ttcaaatcccaagttccgtgaggag

SEQ ID NO: 985459 - DNA, 25 bp, Mus musculus
ttcaaatctgaactcgagaaggaac

SEQ ID NO: 985460 - DNA, 25 bp, Mus musculus
ttcaaatctgaactggagaaggaac

SEQ ID NO: 985461 - DNA, 25 bp, Mus musculus
ttcaaatgggcaattggacggctga

SEQ ID NO: 985462 - DNA, 25 bp, Mus musculus
ttcaaatggggaattggacggctga

SEQ ID NO: 985463 - DNA, 25 bp, Mus musculus
ttcaaatgttgtcgcagaataccag

SEQ ID NO: 985464 - DNA, 25 bp, Mus musculus
ttcaaatgttgtctcctctgttgtg

SEQ ID NO: 985465 - DNA, 25 bp, Mus musculus
ttcaaatgttgtggcagaataccag

SEQ ID NO: 985466 - DNA, 25 bp, Mus musculus
ttcaaatgttgtgtcctctgttgtg

SEQ ID NO: 985467 - DNA, 25 bp, Mus musculus
ttcaaatttgatcatcccaaatttg

SEQ ID NO: 985468 - DNA, 25 bp, Mus musculus
ttcaaatttgatgatcccaaatttg

SEQ ID NO: 985469 - DNA, 25 bp, Mus musculus
ttcaacaaagcaattgaaatgcacc

SEQ ID NO: 985470 - DNA, 25 bp, Mus musculus
ttcaacaaaggaattgaaatgcacc

SEQ ID NO: 985471 - DNA, 25 bp, Mus musculus
ttcaacaaatggcatgcagaaaatg

SEQ ID NO: 985472 - DNA, 25 bp, Mus musculus
ttcaacaaatgggatgcagaaaatg

SEQ ID NO: 985473 - DNA, 25 bp, Mus musculus
ttcaacacatcactagtcttcccca

SEQ ID NO: 985474 - DNA, 25 bp, Mus musculus
ttcaacacatcacttgtcttcccca

SEQ ID NO: 985475 - DNA, 25 bp, Mus musculus
ttcaacactgttcctcaggagcttc

SEQ ID NO: 985476 - DNA, 25 bp, Mus musculus
ttcaacactgttgctcaggagcttc

SEQ ID NO: 985477 - DNA, 25 bp, Mus musculus
ttcaacagacaaaagaggagttgtg

SEQ ID NO: 985478 - DNA, 25 bp, Mus musculus
ttcaacagacaaatagaagaggagt

SEQ ID NO: 985479 - DNA, 25 bp, Mus musculus
ttcaacagacaactcaagagcaatc

SEQ ID NO: 985480 - DNA, 25 bp, Mus musculus
ttcaacagacaagtcaagagcaatc

SEQ ID NO: 985481 - DNA, 25 bp, Mus musculus
ttcaacagacaatagaggagttgtg

SEQ ID NO: 985482 - DNA, 25 bp, Mus musculus
ttcaacagacaattagaagaggagt

SEQ ID NO: 985483 - DNA, 25 bp, Mus musculus
ttcaacattacccaccttccccgct

SEQ ID NO: 985484 - DNA, 25 bp, Mus musculus
ttcaacattacccagcttccccgct

SEQ ID NO: 985485 - DNA, 25 bp, Mus musculus
ttcaacattgagcatcataaagaca

SEQ ID NO: 985486 - DNA, 25 bp, Mus musculus
ttcaacattgaggatcataaagaca

SEQ ID NO: 985487 - DNA, 25 bp, Mus musculus
ttcaaccacaaacgccatgcctaca

SEQ ID NO: 985488 - DNA, 25 bp, Mus musculus
ttcaaccacaaaggccatgcctaca

SEQ ID NO: 985489 - DNA, 25 bp, Mus musculus
ttcaaccacaatgacggattccacc

SEQ ID NO: 985490 - DNA, 25 bp, Mus musculus
ttcaaccacattgacggattccacc

SEQ ID NO: 985491 - DNA, 25 bp, Mus musculus
ttcaaccatcagcggctggtgtcat

SEQ ID NO: 985492 - DNA, 25 bp, Mus musculus
ttcaaccatcagctctaggtggctg

SEQ ID NO: 985493 - DNA, 25 bp, Mus musculus
ttcaaccatcaggggctggtgtcat

SEQ ID NO: 985494 - DNA, 25 bp, Mus musculus
ttcaaccatcaggtctaggtggctg

SEQ ID NO: 985495 - DNA, 25 bp, Mus musculus
ttcaacccaaacgtcgaaggacctg

SEQ ID NO: 985496 - DNA, 25 bp, Mus musculus
ttcaacccaaacgtggaaggacctg

SEQ ID NO: 985497 - DNA, 25 bp, Mus musculus
ttcaaccctgactctaaggggctct

SEQ ID NO: 985498 - DNA, 25 bp, Mus musculus
ttcaaccctgtctctaaggggctct

SEQ ID NO: 985499 - DNA, 25 bp, Mus musculus
ttcaaccgggagaggtctgctctga

SEQ ID NO: 985500 - DNA, 25 bp, Mus musculus
ttcaaccgggagcaggaggacagga

SEQ ID NO: 985501 - DNA, 25 bp, Mus musculus
ttcaaccgggagcattctcagagct

SEQ ID NO: 985502 - DNA, 25 bp, Mus musculus
ttcaaccgggaggaggaggacagga

SEQ ID NO: 985503 - DNA, 25 bp, Mus musculus
ttcaaccgggaggattctcagagct

SEQ ID NO: 985504 - DNA, 25 bp, Mus musculus
ttcaaccgggagtggtctgctctga

SEQ ID NO: 985505 - DNA, 25 bp, Mus musculus
ttcaacctgtagcgaactgtgcacc

SEQ ID NO: 985506 - DNA, 25 bp, Mus musculus
ttcaacctgtagggaactgtgcacc

SEQ ID NO: 985507 - DNA, 25 bp, Mus musculus
ttcaacgctgacaacctgaagaagg

SEQ ID NO: 985508 - DNA, 25 bp, Mus musculus
ttcaacgctgacaagctgaagaagg

SEQ ID NO: 985509 - DNA, 25 bp, Mus musculus
ttcaacggggcattcatcagttggt

SEQ ID NO: 985510 - DNA, 25 bp, Mus musculus
ttcaacgggggattcatcagttggt

SEQ ID NO: 985511 - DNA, 25 bp, Mus musculus
ttcaacgttttccagcagagtttga

SEQ ID NO: 985512 - DNA, 25 bp, Mus musculus
ttcaacgttttcgagcagagtttga

SEQ ID NO: 985513 - DNA, 25 bp, Mus musculus
ttcaactcagtgcatttaaaaatga

SEQ ID NO: 985514 - DNA, 25 bp, Mus musculus
ttcaactcagtggatttaaaaatga

SEQ ID NO: 985515 - DNA, 25 bp, Mus musculus
ttcaactcccagctgacacccctcc

SEQ ID NO: 985516 - DNA, 25 bp, Mus musculus
ttcaactcccaggtgacacccctcc

SEQ ID NO: 985517 - DNA, 25 bp, Mus musculus
ttcaactgctcacacagtcagtccg

SEQ ID NO: 985518 - DNA, 25 bp, Mus musculus
ttcaactgctcacagagtcagtccg

SEQ ID NO: 985519 - DNA, 25 bp, Mus musculus
ttcaactgtaaggaaagaaaacatg

SEQ ID NO: 985520 - DNA, 25 bp, Mus musculus
ttcaactgtatggaaagaaaacatg

SEQ ID NO: 985521 - DNA, 25 bp, Mus musculus
ttcaactgtgagcgacaggtacaag

SEQ ID NO: 985522 - DNA, 25 bp, Mus musculus
ttcaactgtgagggacaggtacaag

SEQ ID NO: 985523 - DNA, 25 bp, Mus musculus
ttcaagaacctgagagagttctgga

SEQ ID NO: 985524 - DNA, 25 bp, Mus musculus
ttcaagaacctgagtgagttctgga

SEQ ID NO: 985525 - DNA, 25 bp, Mus musculus
ttcaagaactggaactagtggactg

SEQ ID NO: 985526 - DNA, 25 bp, Mus musculus
ttcaagaactggtactagtggactg

SEQ ID NO: 985527 - DNA, 25 bp, Mus musculus
ttcaagaagacacgcaaacatttca

SEQ ID NO: 985528 - DNA, 25 bp, Mus musculus
ttcaagaagacaggcaaacatttca

SEQ ID NO: 985529 - DNA, 25 bp, Mus musculus
ttcaagagaaagccttgtttgcagt

SEQ ID NO: 985530 - DNA, 25 bp, Mus musculus
ttcaagagaaagcttcaattttata

SEQ ID NO: 985531 - DNA, 25 bp, Mus musculus
ttcaagagaaaggcttgtttgcagt

SEQ ID NO: 985532 - DNA, 25 bp, Mus musculus
ttcaagagaaaggttcaattttata

SEQ ID NO: 985533 - DNA, 25 bp, Mus musculus
ttcaagagacagccagagatgcagc

SEQ ID NO: 985534 - DNA, 25 bp, Mus musculus
ttcaagagacaggcagagatgcagc

SEQ ID NO: 985535 - DNA, 25 bp, Mus musculus
ttcaagagtgaccacccgtgggaat

SEQ ID NO: 985536 - DNA, 25 bp, Mus musculus
ttcaagagtgaccagccgtgggaat

SEQ ID NO: 985537 - DNA, 25 bp, Mus musculus
ttcaagataagagaaatgccagaat

SEQ ID NO: 985538 - DNA, 25 bp, Mus musculus
ttcaagataagagatatgccagaat

SEQ ID NO: 985539 - DNA, 25 bp, Mus musculus
ttcaagatgtatacatagtcatgga

SEQ ID NO: 985540 - DNA, 25 bp, Mus musculus
ttcaagatgtttacatagtcatgga

SEQ ID NO: 985541 - DNA, 25 bp, Mus musculus
ttcaagcaaccatttaagaagacca

SEQ ID NO: 985542 - DNA, 25 bp, Mus musculus
ttcaagcaacgatttaagaagacca

SEQ ID NO: 985543 - DNA, 25 bp, Mus musculus
ttcaagcaagaacgcacttgctatc

SEQ ID NO: 985544 - DNA, 25 bp, Mus musculus
ttcaagcaagaaggcacttgctatc

SEQ ID NO: 985545 - DNA, 25 bp, Mus musculus
ttcaagcatgctggaagggactgca

SEQ ID NO: 985546 - DNA, 25 bp, Mus musculus
ttcaagcatggtggaagggactgca

SEQ ID NO: 985547 - DNA, 25 bp, Mus musculus
ttcaagccaaagacaccataggtgt

SEQ ID NO: 985548 - DNA, 25 bp, Mus musculus
ttcaagccaatgacaccataggtgt

SEQ ID NO: 985549 - DNA, 25 bp, Mus musculus
ttcaagcgagccaagtcccacctgg

SEQ ID NO: 985550 - DNA, 25 bp, Mus musculus
ttcaagcgaggcaagtcccacctgg

SEQ ID NO: 985551 - DNA, 25 bp, Mus musculus
ttcaagctcttaagtgagacgtgga

SEQ ID NO: 985552 - DNA, 25 bp, Mus musculus
ttcaagctcttatgtgagacgtgga

SEQ ID NO: 985553 - DNA, 25 bp, Mus musculus
ttcaagctggagcacgaggagtacc

SEQ ID NO: 985554 - DNA, 25 bp, Mus musculus
ttcaagctggagcaggaggagtacc

SEQ ID NO: 985555 - DNA, 25 bp, Mus musculus
ttcaagctggatgacgacctttgtg

SEQ ID NO: 985556 - DNA, 25 bp, Mus musculus
ttcaagctggatgaggacctttgtg

SEQ ID NO: 985557 - DNA, 25 bp, Mus musculus
ttcaaggaatcacccgccagatccc

SEQ ID NO: 985558 - DNA, 25 bp, Mus musculus
ttcaaggaatcagccgccagatccc

SEQ ID NO: 985559 - DNA, 25 bp, Mus musculus
ttcaaggactgccgctctaaggtgg

SEQ ID NO: 985560 - DNA, 25 bp, Mus musculus
ttcaaggactgcggctctaaggtgg

SEQ ID NO: 985561 - DNA, 25 bp, Mus musculus
ttcaaggagaagaaccaatgtctga

SEQ ID NO: 985562 - DNA, 25 bp, Mus musculus
ttcaaggagaagaagaaaaagtcag

SEQ ID NO: 985563 - DNA, 25 bp, Mus musculus
ttcaaggagaagaagcaatgtctga

SEQ ID NO: 985564 - DNA, 25 bp, Mus musculus
ttcaaggagaagtagaaaaagtcag

SEQ ID NO: 985565 - DNA, 25 bp, Mus musculus
ttcaaggagatgctctgctggtgta

SEQ ID NO: 985566 - DNA, 25 bp, Mus musculus
ttcaaggagatggtctgctggtgta

SEQ ID NO: 985567 - DNA, 25 bp, Mus musculus
ttcaaggggcagctgtttgctttgt

SEQ ID NO: 985568 - DNA, 25 bp, Mus musculus
ttcaaggggcaggtgtttgctttgt

SEQ ID NO: 985569 - DNA, 25 bp, Mus musculus
ttcaaggtggatcacccggcgggaa

SEQ ID NO: 985570 - DNA, 25 bp, Mus musculus
ttcaaggtggatgacccggcgggaa

SEQ ID NO: 985571 - DNA, 25 bp, Mus musculus
ttcaagtacaggaatgaactcaagc

SEQ ID NO: 985572 - DNA, 25 bp, Mus musculus
ttcaagtacaggtatgaactcaagc

SEQ ID NO: 985573 - DNA, 25 bp, Mus musculus
ttcaagtcaacacgcatcaactaaa

SEQ ID NO: 985574 - DNA, 25 bp, Mus musculus
ttcaagtcaacaggcatcaactaaa

SEQ ID NO: 985575 - DNA, 25 bp, Mus musculus
ttcaagtgaaagaggtcaaccggat

SEQ ID NO: 985576 - DNA, 25 bp, Mus musculus
ttcaagtgaaagtggtcaaccggat

SEQ ID NO: 985577 - DNA, 25 bp, Mus musculus
ttcaataaagatatcagtgaagaca

SEQ ID NO: 985578 - DNA, 25 bp, Mus musculus
ttcaataaagatatgagtgaagaca

SEQ ID NO: 985579 - DNA, 25 bp, Mus musculus
ttcaataaagctgatgagtacaccc

SEQ ID NO: 985580 - DNA, 25 bp, Mus musculus
ttcaataaaggtgatgagtacaccc

SEQ ID NO: 985581 - DNA, 25 bp, Mus musculus
ttcaatccccaacgttcattctgtg

SEQ ID NO: 985582 - DNA, 25 bp, Mus musculus
ttcaatccccaaggttcattctgtg

SEQ ID NO: 985583 - DNA, 25 bp, Mus musculus
ttcaatgaaatgcttgtatatagtg

SEQ ID NO: 985584 - DNA, 25 bp, Mus musculus
ttcaatgaaatggttgtatatagtg

SEQ ID NO: 985585 - DNA, 25 bp, Mus musculus
ttcaatgacacggacgtcctccagc

SEQ ID NO: 985586 - DNA, 25 bp, Mus musculus
ttcaatgacacggaggtcctccagc

SEQ ID NO: 985587 - DNA, 25 bp, Mus musculus
ttcaatgacttagacgagtgtgacc

SEQ ID NO: 985588 - DNA, 25 bp, Mus musculus
ttcaatgacttagaggagtgtgacc

SEQ ID NO: 985589 - DNA, 25 bp, Mus musculus
ttcaatgaggcacagattgcccctc

SEQ ID NO: 985590 - DNA, 25 bp, Mus musculus
ttcaatgagggacagattgcccctc

SEQ ID NO: 985591 - DNA, 25 bp, Mus musculus
ttcaatggagagccgtgcagcgtgg

SEQ ID NO: 985592 - DNA, 25 bp, Mus musculus
ttcaatggagtgccgtgcagcgtgg

SEQ ID NO: 985593 - DNA, 25 bp, Mus musculus
ttcaatggccagaagcaccaagaat

SEQ ID NO: 985594 - DNA, 25 bp, Mus musculus
ttcaatggccagctcaggagtttac

SEQ ID NO: 985595 - DNA, 25 bp, Mus musculus
ttcaatggccaggtcaggagtttac

SEQ ID NO: 985596 - DNA, 25 bp, Mus musculus
ttcaatggccagtagcaccaagaat

SEQ ID NO: 985597 - DNA, 25 bp, Mus musculus
ttcaattccaatccaaacaagaatg

SEQ ID NO: 985598 - DNA, 25 bp, Mus musculus
ttcaattccaatgcaaacaagaatg

SEQ ID NO: 985599 - DNA, 25 bp, Mus musculus
ttcacaaaagcgaaggatctgtcct

SEQ ID NO: 985600 - DNA, 25 bp, Mus musculus
ttcacaaaagggaaggatctgtcct

SEQ ID NO: 985601 - DNA, 25 bp, Mus musculus
ttcacaaccaatcctggtctgacgg

SEQ ID NO: 985602 - DNA, 25 bp, Mus musculus
ttcacaaccattcctggtctgacgg

SEQ ID NO: 985603 - DNA, 25 bp, Mus musculus
ttcacaagttgacatgaagcccgag

SEQ ID NO: 985604 - DNA, 25 bp, Mus musculus
ttcacaagttgagatgaagcccgag

SEQ ID NO: 985605 - DNA, 25 bp, Mus musculus
ttcacaattggtcaccacagccgct

SEQ ID NO: 985606 - DNA, 25 bp, Mus musculus
ttcacaattggtgaccacagccgct

SEQ ID NO: 985607 - DNA, 25 bp, Mus musculus
ttcacacctaagatggaacagctag

SEQ ID NO: 985608 - DNA, 25 bp, Mus musculus
ttcacacctaagattgagcagctag

SEQ ID NO: 985609 - DNA, 25 bp, Mus musculus
ttcacacctaagttggaacagctag

SEQ ID NO: 985610 - DNA, 25 bp, Mus musculus
ttcacacctaagtttgagcagctag

SEQ ID NO: 985611 - DNA, 25 bp, Mus musculus
ttcacactgagaccagacttctttc

SEQ ID NO: 985612 - DNA, 25 bp, Mus musculus
ttcacactgagagcagacttctttc

SEQ ID NO: 985613 - DNA, 25 bp, Mus musculus
ttcacactggctggcaccccttacc

SEQ ID NO: 985614 - DNA, 25 bp, Mus musculus
ttcacactgggtggcaccccttacc

SEQ ID NO: 985615 - DNA, 25 bp, Mus musculus
ttcacagaagccagaggtcatcatg

SEQ ID NO: 985616 - DNA, 25 bp, Mus musculus
ttcacagaaggcagaggtcatcatg

SEQ ID NO: 985617 - DNA, 25 bp, Mus musculus
ttcacagaagtgcctgaagtacttg

SEQ ID NO: 985618 - DNA, 25 bp, Mus musculus
ttcacagaagtggctgaagtacttg

SEQ ID NO: 985619 - DNA, 25 bp, Mus musculus
ttcacagatgaacataacactgtgt

SEQ ID NO: 985620 - DNA, 25 bp, Mus musculus
ttcacagatgaagataacactgtgt

SEQ ID NO: 985621 - DNA, 25 bp, Mus musculus
ttcacagcccagcttttctgctttt

SEQ ID NO: 985622 - DNA, 25 bp, Mus musculus
ttcacagcccaggttttctgctttt

SEQ ID NO: 985623 - DNA, 25 bp, Mus musculus
ttcacagccccacttcacagccatg

SEQ ID NO: 985624 - DNA, 25 bp, Mus musculus
ttcacagccccagttcacagccatg

SEQ ID NO: 985625 - DNA, 25 bp, Mus musculus
ttcacagtagcctattgcagaccag

SEQ ID NO: 985626 - DNA, 25 bp, Mus musculus
ttcacagtaggctattgcagaccag

SEQ ID NO: 985627 - DNA, 25 bp, Mus musculus
ttcacagtgaatatcgtaaaaagca

SEQ ID NO: 985628 - DNA, 25 bp, Mus musculus
ttcacagtgaatatggtaaaaagca

SEQ ID NO: 985629 - DNA, 25 bp, Mus musculus
ttcacagttgttccactctgatact

SEQ ID NO: 985630 - DNA, 25 bp, Mus musculus
ttcacagttgttgcactctgatact

SEQ ID NO: 985631 - DNA, 25 bp, Mus musculus
ttcacatcagcacgaacgtcatcca

SEQ ID NO: 985632 - DNA, 25 bp, Mus musculus
ttcacatcagcactgcctgcagaag

SEQ ID NO: 985633 - DNA, 25 bp, Mus musculus
ttcacatcagcaggaacgtcatcca

SEQ ID NO: 985634 - DNA, 25 bp, Mus musculus
ttcacatcagcagtgcctgcagaag

SEQ ID NO: 985635 - DNA, 25 bp, Mus musculus
ttcaccaaacagaaatatccagagc

SEQ ID NO: 985636 - DNA, 25 bp, Mus musculus
ttcaccaaacagtaatatccagagc

SEQ ID NO: 985637 - DNA, 25 bp, Mus musculus
ttcaccaagaaagactttcaagcca

SEQ ID NO: 985638 - DNA, 25 bp, Mus musculus
ttcaccaagaaagagtttcaagcca

SEQ ID NO: 985639 - DNA, 25 bp, Mus musculus
ttcaccaagatcaacaccgctgacc

SEQ ID NO: 985640 - DNA, 25 bp, Mus musculus
ttcaccaagatcaagaccgctgacc

SEQ ID NO: 985641 - DNA, 25 bp, Mus musculus
ttcaccaagatctccgtggatatgt

SEQ ID NO: 985642 - DNA, 25 bp, Mus musculus
ttcaccaagatctcggtggatatgt

SEQ ID NO: 985643 - DNA, 25 bp, Mus musculus
ttcaccaagccacaccaatgtgggg

SEQ ID NO: 985644 - DNA, 25 bp, Mus musculus
ttcaccaagccacacgatggtgaca

SEQ ID NO: 985645 - DNA, 25 bp, Mus musculus
ttcaccaagccacagcaatgtgggg

SEQ ID NO: 985646 - DNA, 25 bp, Mus musculus
ttcaccaagccacaggatggtgaca

SEQ ID NO: 985647 - DNA, 25 bp, Mus musculus
ttcaccaaggagcacgtgactaacg

SEQ ID NO: 985648 - DNA, 25 bp, Mus musculus
ttcaccaaggagcaggtgactaacg

SEQ ID NO: 985649 - DNA, 25 bp, Mus musculus
ttcaccacaaagctgggcctttgtc

SEQ ID NO: 985650 - DNA, 25 bp, Mus musculus
ttcaccacaaaggtgggcctttgtc

SEQ ID NO: 985651 - DNA, 25 bp, Mus musculus
ttcaccacacagacagaggagctga

SEQ ID NO: 985652 - DNA, 25 bp, Mus musculus
ttcaccacacagtcagaggagctga

SEQ ID NO: 985653 - DNA, 25 bp, Mus musculus
ttcaccacagagataatatgcaaca

SEQ ID NO: 985654 - DNA, 25 bp, Mus musculus
ttcaccacagatcccatcactctgg

SEQ ID NO: 985655 - DNA, 25 bp, Mus musculus
ttcaccacagatgccatcactctgg

SEQ ID NO: 985656 - DNA, 25 bp, Mus musculus
ttcaccacagctgtggtctatgaca

SEQ ID NO: 985657 - DNA, 25 bp, Mus musculus
ttcaccacaggtgtggtctatgaca

SEQ ID NO: 985658 - DNA, 25 bp, Mus musculus
ttcaccacagtgataatatgcaaca

SEQ ID NO: 985659 - DNA, 25 bp, Mus musculus
ttcaccactaaccactctgacacca

SEQ ID NO: 985660 - DNA, 25 bp, Mus musculus
ttcaccactaaccggactcagaaga

SEQ ID NO: 985661 - DNA, 25 bp, Mus musculus
ttcaccactaacgactctgacacca

SEQ ID NO: 985662 - DNA, 25 bp, Mus musculus
ttcaccactaacgggactcagaaga

SEQ ID NO: 985663 - DNA, 25 bp, Mus musculus
ttcaccatagagccaatcatcactg

SEQ ID NO: 985664 - DNA, 25 bp, Mus musculus
ttcaccatagtgccaatcatcactg

SEQ ID NO: 985665 - DNA, 25 bp, Mus musculus
ttcaccatcaagcatgtttatgaca

SEQ ID NO: 985666 - DNA, 25 bp, Mus musculus
ttcaccatcaaggatgtttatgaca

SEQ ID NO: 985667 - DNA, 25 bp, Mus musculus
ttcaccatggatccaaaattgtcag

SEQ ID NO: 985668 - DNA, 25 bp, Mus musculus
ttcaccatggatcctaaattgtcag

SEQ ID NO: 985669 - DNA, 25 bp, Mus musculus
ttcaccattcagcaaaacttgaact

SEQ ID NO: 985670 - DNA, 25 bp, Mus musculus
ttcaccattcaggaaaacttgaact

SEQ ID NO: 985671 - DNA, 25 bp, Mus musculus
ttcaccccagctgaacacctttatg

SEQ ID NO: 985672 - DNA, 25 bp, Mus musculus
ttcaccccagctttgtatggagaga

SEQ ID NO: 985673 - DNA, 25 bp, Mus musculus
ttcaccccaggtgaacacctttatg

SEQ ID NO: 985674 - DNA, 25 bp, Mus musculus
ttcaccccaggtttgtatggagaga

SEQ ID NO: 985675 - DNA, 25 bp, Mus musculus
ttcacccctctggacatcctctgga

SEQ ID NO: 985676 - DNA, 25 bp, Mus musculus
ttcacccctctggagatcctctgga

SEQ ID NO: 985677 - DNA, 25 bp, Mus musculus
ttcacccgagtcccctgagggatct

SEQ ID NO: 985678 - DNA, 25 bp, Mus musculus
ttcacccgagtcgcctgagggatct

SEQ ID NO: 985679 - DNA, 25 bp, Mus musculus
ttcaccctcttccacacccatgaca

SEQ ID NO: 985680 - DNA, 25 bp, Mus musculus
ttcaccctcttccagacccatgaca

SEQ ID NO: 985681 - DNA, 25 bp, Mus musculus
ttcaccgatcagaaacctgatatct

SEQ ID NO: 985682 - DNA, 25 bp, Mus musculus
ttcaccgatcagcacaacatccacg

SEQ ID NO: 985683 - DNA, 25 bp, Mus musculus
ttcaccgatcaggacaacatccacg

SEQ ID NO: 985684 - DNA, 25 bp, Mus musculus
ttcaccgatcagtaacctgatatct

SEQ ID NO: 985685 - DNA, 25 bp, Mus musculus
ttcaccgctcagaacaaggcctgag

SEQ ID NO: 985686 - DNA, 25 bp, Mus musculus
ttcaccgctcagaagaaggcctgag

SEQ ID NO: 985687 - DNA, 25 bp, Mus musculus
ttcaccgtggcacgggttcttacag

SEQ ID NO: 985688 - DNA, 25 bp, Mus musculus
ttcaccgtggcaggggttcttacag

SEQ ID NO: 985689 - DNA, 25 bp, Mus musculus
ttcacctacgattaccacaccctgc

SEQ ID NO: 985690 - DNA, 25 bp, Mus musculus
ttcacctacgccaagagatgtcgat

SEQ ID NO: 985691 - DNA, 25 bp, Mus musculus
ttcacctacggcaagagatgtcgat

SEQ ID NO: 985692 - DNA, 25 bp, Mus musculus
ttcacctacgtttaccacaccctgc

SEQ ID NO: 985693 - DNA, 25 bp, Mus musculus
ttcacctatgcctgcacgtgggaat

SEQ ID NO: 985694 - DNA, 25 bp, Mus musculus
ttcacctatggctgcacgtgggaat

SEQ ID NO: 985695 - DNA, 25 bp, Mus musculus
ttcacctcagatgcctgtggtctgt

SEQ ID NO: 985696 - DNA, 25 bp, Mus musculus
ttcacctcagttgcctgtggtctgt

SEQ ID NO: 985697 - DNA, 25 bp, Mus musculus
ttcacctcgccacgctgcctaaacc

SEQ ID NO: 985698 - DNA, 25 bp, Mus musculus
ttcacctcgccacggtgcactcgtg

SEQ ID NO: 985699 - DNA, 25 bp, Mus musculus
ttcacctcgccaggctgcctaaacc

SEQ ID NO: 985700 - DNA, 25 bp, Mus musculus
ttcacctcgccagggtgcactcgtg

SEQ ID NO: 985701 - DNA, 25 bp, Mus musculus
ttcacctcgcctcgacgttgtcagg

SEQ ID NO: 985702 - DNA, 25 bp, Mus musculus
ttcacctcgcctggacgttgtcagg

SEQ ID NO: 985703 - DNA, 25 bp, Mus musculus
ttcacctctcgtcacatgtcgtcac

SEQ ID NO: 985704 - DNA, 25 bp, Mus musculus
ttcacctctcgtcacgactgcaaga

SEQ ID NO: 985705 - DNA, 25 bp, Mus musculus
ttcacctctcgtcagatgtcgtcac

SEQ ID NO: 985706 - DNA, 25 bp, Mus musculus
ttcacctctcgtcaggactgcaaga

SEQ ID NO: 985707 - DNA, 25 bp, Mus musculus
ttcacgacagcgctgagtaccttca

SEQ ID NO: 985708 - DNA, 25 bp, Mus musculus
ttcacgacagggctgagtaccttca

SEQ ID NO: 985709 - DNA, 25 bp, Mus musculus
ttcacgcagccttcaggctcagttc

SEQ ID NO: 985710 - DNA, 25 bp, Mus musculus
ttcacgcagccttctggctcagttc

SEQ ID NO: 985711 - DNA, 25 bp, Mus musculus
ttcacgcccccacatgaagactgtc

SEQ ID NO: 985712 - DNA, 25 bp, Mus musculus
ttcacgcccccagatgaagactgtc

SEQ ID NO: 985713 - DNA, 25 bp, Mus musculus
ttcacgcctgatgcctgtggccttt

SEQ ID NO: 985714 - DNA, 25 bp, Mus musculus
ttcacgcctgttgcctgtggccttt

SEQ ID NO: 985715 - DNA, 25 bp, Mus musculus
ttcacgcggcagcctcacctgcgga

SEQ ID NO: 985716 - DNA, 25 bp, Mus musculus
ttcacgcggcaggctcacctgcgga

SEQ ID NO: 985717 - DNA, 25 bp, Mus musculus
ttcacgtctcacgacgaccatgact

SEQ ID NO: 985718 - DNA, 25 bp, Mus musculus
ttcacgtctcacgaggaccatgact

SEQ ID NO: 985719 - DNA, 25 bp, Mus musculus
ttcacgtctctgcacaagccctcag

SEQ ID NO: 985720 - DNA, 25 bp, Mus musculus
ttcacgtctctggacaagccctcag

SEQ ID NO: 985721 - DNA, 25 bp, Mus musculus
ttcacgttggtctccgtgctcttag

SEQ ID NO: 985722 - DNA, 25 bp, Mus musculus
ttcacgttggtctcggtgctcttag

SEQ ID NO: 985723 - DNA, 25 bp, Mus musculus
ttcactcaagagcactgggtaaggt

SEQ ID NO: 985724 - DNA, 25 bp, Mus musculus
ttcactcaagagcagtgggtaaggt

SEQ ID NO: 985725 - DNA, 25 bp, Mus musculus
ttcactccccagatatacaaaaagt

SEQ ID NO: 985726 - DNA, 25 bp, Mus musculus
ttcactccccagttatacaaaaagt

SEQ ID NO: 985727 - DNA, 25 bp, Mus musculus
ttcactcgcactacctatgtgacat

SEQ ID NO: 985728 - DNA, 25 bp, Mus musculus
ttcactcgcactacgtatgtgacat

SEQ ID NO: 985729 - DNA, 25 bp, Mus musculus
ttcactcggtgcaacaaagctgtag

SEQ ID NO: 985730 - DNA, 25 bp, Mus musculus
ttcactcggtgcaaccagaaagctg

SEQ ID NO: 985731 - DNA, 25 bp, Mus musculus
ttcactcggtgcaagaaagctgtag

SEQ ID NO: 985732 - DNA, 25 bp, Mus musculus
ttcactcggtgcaagcagaaagctg

SEQ ID NO: 985733 - DNA, 25 bp, Mus musculus
ttcactctagagtcttttattcaaa

SEQ ID NO: 985734 - DNA, 25 bp, Mus musculus
ttcactctagtgtcttttattcaaa

SEQ ID NO: 985735 - DNA, 25 bp, Mus musculus
ttcactctgcagatcagtcaaagag

SEQ ID NO: 985736 - DNA, 25 bp, Mus musculus
ttcactctgcagttcagtcaaagag

SEQ ID NO: 985737 - DNA, 25 bp, Mus musculus
ttcactcttgcacggtgattgccac

SEQ ID NO: 985738 - DNA, 25 bp, Mus musculus
ttcactcttggacggtgattgccac

SEQ ID NO: 985739 - DNA, 25 bp, Mus musculus
ttcactgcagcgctgggattggccg

SEQ ID NO: 985740 - DNA, 25 bp, Mus musculus
ttcactgcagggctgggattggccg

SEQ ID NO: 985741 - DNA, 25 bp, Mus musculus
ttcactgcagtgatatggacgagtg

SEQ ID NO: 985742 - DNA, 25 bp, Mus musculus
ttcactgcagtgttatggacgagtg

SEQ ID NO: 985743 - DNA, 25 bp, Mus musculus
ttcactggacatcggtgaagaaggg

SEQ ID NO: 985744 - DNA, 25 bp, Mus musculus
ttcactggacatgggtgaagaaggg

SEQ ID NO: 985745 - DNA, 25 bp, Mus musculus
ttcactggcagtgacatccgccatc

SEQ ID NO: 985746 - DNA, 25 bp, Mus musculus
ttcactggcagtgagatccgccatc

SEQ ID NO: 985747 - DNA, 25 bp, Mus musculus
ttcactggggccttcctcctaggct

SEQ ID NO: 985748 - DNA, 25 bp, Mus musculus
ttcactgggggcttcctcctaggct

SEQ ID NO: 985749 - DNA, 25 bp, Mus musculus
ttcactgtagtttcactgttcctgg

SEQ ID NO: 985750 - DNA, 25 bp, Mus musculus
ttcactgtagtttctctgttcctgg

SEQ ID NO: 985751 - DNA, 25 bp, Mus musculus
ttcactgttcagccatccgaaggtg

SEQ ID NO: 985752 - DNA, 25 bp, Mus musculus
ttcactgttcagcccacagtgagaa

SEQ ID NO: 985753 - DNA, 25 bp, Mus musculus
ttcactgttcaggcatccgaaggtg

SEQ ID NO: 985754 - DNA, 25 bp, Mus musculus
ttcactgttcaggccacagtgagaa

SEQ ID NO: 985755 - DNA, 25 bp, Mus musculus
ttcacttagacacacttacaacagc

SEQ ID NO: 985756 - DNA, 25 bp, Mus musculus
ttcacttagacagacttacaacagc

SEQ ID NO: 985757 - DNA, 25 bp, Mus musculus
ttcacttcagctattgacctcatgg

SEQ ID NO: 985758 - DNA, 25 bp, Mus musculus
ttcacttcagctgtggacctcgttt

SEQ ID NO: 985759 - DNA, 25 bp, Mus musculus
ttcacttcaggtattgacctcatgg

SEQ ID NO: 985760 - DNA, 25 bp, Mus musculus
ttcacttcaggtgtggacctcgttt

SEQ ID NO: 985761 - DNA, 25 bp, Mus musculus
ttcacttctcctccactctgggcat

SEQ ID NO: 985762 - DNA, 25 bp, Mus musculus
ttcacttctcctgcactctgggcat

SEQ ID NO: 985763 - DNA, 25 bp, Mus musculus
ttcacttgtgctggatccaacacct

SEQ ID NO: 985764 - DNA, 25 bp, Mus musculus
ttcacttgtggtggatccaacacct

SEQ ID NO: 985765 - DNA, 25 bp, Mus musculus
ttcactttcaagctgccataccagg

SEQ ID NO: 985766 - DNA, 25 bp, Mus musculus
ttcactttcaaggtgccataccagg

SEQ ID NO: 985767 - DNA, 25 bp, Mus musculus
ttcactttggaacagctcattgccc

SEQ ID NO: 985768 - DNA, 25 bp, Mus musculus
ttcactttggaagagctcattgccc

SEQ ID NO: 985769 - DNA, 25 bp, Mus musculus
ttcagaaacaactcctttcagcctg

SEQ ID NO: 985770 - DNA, 25 bp, Mus musculus
ttcagaaacacacctcgatgcagtc

SEQ ID NO: 985771 - DNA, 25 bp, Mus musculus
ttcagaaacagacctcgatgcagtc

SEQ ID NO: 985772 - DNA, 25 bp, Mus musculus
ttcagaaacatctcctttcagcctg

SEQ ID NO: 985773 - DNA, 25 bp, Mus musculus
ttcagaaacatgaccctgaaacgaa

SEQ ID NO: 985774 - DNA, 25 bp, Mus musculus
ttcagaaacatgtccctgaaacgaa

SEQ ID NO: 985775 - DNA, 25 bp, Mus musculus
ttcagaacagagggcaatgcgagca

SEQ ID NO: 985776 - DNA, 25 bp, Mus musculus
ttcagaacagagtggaagtcggagt

SEQ ID NO: 985777 - DNA, 25 bp, Mus musculus
ttcagaacagtgggcaatgcgagca

SEQ ID NO: 985778 - DNA, 25 bp, Mus musculus
ttcagaacagtgtggaagtcggagt

SEQ ID NO: 985779 - DNA, 25 bp, Mus musculus
ttcagaactgttagcaatgcgatgc

SEQ ID NO: 985780 - DNA, 25 bp, Mus musculus
ttcagaactgttaggaatgcgatgc

SEQ ID NO: 985781 - DNA, 25 bp, Mus musculus
ttcagaagaaaacatgatggagttt

SEQ ID NO: 985782 - DNA, 25 bp, Mus musculus
ttcagaagaaaagatgatggagttt

SEQ ID NO: 985783 - DNA, 25 bp, Mus musculus
ttcagaagagcatgactgagtggga

SEQ ID NO: 985784 - DNA, 25 bp, Mus musculus
ttcagaagaggatgactgagtggga

SEQ ID NO: 985785 - DNA, 25 bp, Mus musculus
ttcagaagttaacgaaacatattca

SEQ ID NO: 985786 - DNA, 25 bp, Mus musculus
ttcagaagttaaggaaacatattca

SEQ ID NO: 985787 - DNA, 25 bp, Mus musculus
ttcagaatcagcaacacagacacca

SEQ ID NO: 985788 - DNA, 25 bp, Mus musculus
ttcagaatcagcaagacagacacca

SEQ ID NO: 985789 - DNA, 25 bp, Mus musculus
ttcagaatggcttctacgcagctcc

SEQ ID NO: 985790 - DNA, 25 bp, Mus musculus
ttcagaatgggttctacgcagctcc

SEQ ID NO: 985791 - DNA, 25 bp, Mus musculus
ttcagaattgctctcataagctggc

SEQ ID NO: 985792 - DNA, 25 bp, Mus musculus
ttcagaattgctctgataagctggc

SEQ ID NO: 985793 - DNA, 25 bp, Mus musculus
ttcagacaagttatcacggcaatgg

SEQ ID NO: 985794 - DNA, 25 bp, Mus musculus
ttcagacaagttatgacggcaatgg

SEQ ID NO: 985795 - DNA, 25 bp, Mus musculus
ttcagacaccagcaagcccctgagg

SEQ ID NO: 985796 - DNA, 25 bp, Mus musculus
ttcagacaccaggaagcccctgagg

SEQ ID NO: 985797 - DNA, 25 bp, Mus musculus
ttcagacaggactctagcaaggagc

SEQ ID NO: 985798 - DNA, 25 bp, Mus musculus
ttcagacaggtctctagcaaggagc

SEQ ID NO: 985799 - DNA, 25 bp, Mus musculus
ttcagacagtaaccttgtggagaat

SEQ ID NO: 985800 - DNA, 25 bp, Mus musculus
ttcagacagtaagcttgtggagaat

SEQ ID NO: 985801 - DNA, 25 bp, Mus musculus
ttcagaccagaaatgctccagggaa

SEQ ID NO: 985802 - DNA, 25 bp, Mus musculus
ttcagaccaggcagcgagtactaac

SEQ ID NO: 985803 - DNA, 25 bp, Mus musculus
ttcagaccaggctgcgagtactaac

SEQ ID NO: 985804 - DNA, 25 bp, Mus musculus
ttcagaccagtaatgctccagggaa

SEQ ID NO: 985805 - DNA, 25 bp, Mus musculus
ttcagaccagtgagccacagggttc

SEQ ID NO: 985806 - DNA, 25 bp, Mus musculus
ttcagaccagtgtgccacagggttc

SEQ ID NO: 985807 - DNA, 25 bp, Mus musculus
ttcagacggtgacaaggttattgat

SEQ ID NO: 985808 - DNA, 25 bp, Mus musculus
ttcagacggtgacatggttattgat

SEQ ID NO: 985809 - DNA, 25 bp, Mus musculus
ttcagacgtgctctggacagctcca

SEQ ID NO: 985810 - DNA, 25 bp, Mus musculus
ttcagacgtggtctggacagctcca

SEQ ID NO: 985811 - DNA, 25 bp, Mus musculus
ttcagactcgctcagatccagctat

SEQ ID NO: 985812 - DNA, 25 bp, Mus musculus
ttcagactcggtcagatccagctat

SEQ ID NO: 985813 - DNA, 25 bp, Mus musculus
ttcagagactcacgattgaaaagat

SEQ ID NO: 985814 - DNA, 25 bp, Mus musculus
ttcagagactcaggattgaaaagat

SEQ ID NO: 985815 - DNA, 25 bp, Mus musculus
ttcagagcagatcggagagaaaagc

SEQ ID NO: 985816 - DNA, 25 bp, Mus musculus
ttcagagcagctacggatgctgccc

SEQ ID NO: 985817 - DNA, 25 bp, Mus musculus
ttcagagcaggtacggatgctgccc

SEQ ID NO: 985818 - DNA, 25 bp, Mus musculus
ttcagagcagttcggagagaaaagc

SEQ ID NO: 985819 - DNA, 25 bp, Mus musculus
ttcagagctgaacccagcaagcctg

SEQ ID NO: 985820 - DNA, 25 bp, Mus musculus
ttcagagctgaacgctattctagac

SEQ ID NO: 985821 - DNA, 25 bp, Mus musculus
ttcagagctgaagccagcaagcctg

SEQ ID NO: 985822 - DNA, 25 bp, Mus musculus
ttcagagctgaaggctattctagac

SEQ ID NO: 985823 - DNA, 25 bp, Mus musculus
ttcagaggagaaccggaagctggct

SEQ ID NO: 985824 - DNA, 25 bp, Mus musculus
ttcagaggagaagcggaagctggct

SEQ ID NO: 985825 - DNA, 25 bp, Mus musculus
ttcagagtgagaacatcatccaagt

SEQ ID NO: 985826 - DNA, 25 bp, Mus musculus
ttcagagtgagatcatcatccaagt

SEQ ID NO: 985827 - DNA, 25 bp, Mus musculus
ttcagagtgaggctctggtcaaggc

SEQ ID NO: 985828 - DNA, 25 bp, Mus musculus
ttcagagtgagggtctggtcaaggc

SEQ ID NO: 985829 - DNA, 25 bp, Mus musculus
ttcagataagcttccgagaagtggc

SEQ ID NO: 985830 - DNA, 25 bp, Mus musculus
ttcagataaggttccgagaagtggc

SEQ ID NO: 985831 - DNA, 25 bp, Mus musculus
ttcagataataggaggatagacagt

SEQ ID NO: 985832 - DNA, 25 bp, Mus musculus
ttcagataatagggccattgacagc

SEQ ID NO: 985833 - DNA, 25 bp, Mus musculus
ttcagataattggaggatagacagt

SEQ ID NO: 985834 - DNA, 25 bp, Mus musculus
ttcagataattgggccattgacagc

SEQ ID NO: 985835 - DNA, 25 bp, Mus musculus
ttcagatcagaacctgcaagaagtg

SEQ ID NO: 985836 - DNA, 25 bp, Mus musculus
ttcagatcagtacctgcaagaagtg

SEQ ID NO: 985837 - DNA, 25 bp, Mus musculus
ttcagatcctcaccaagaacctgaa

SEQ ID NO: 985838 - DNA, 25 bp, Mus musculus
ttcagatcctcagcaagaacctgaa

SEQ ID NO: 985839 - DNA, 25 bp, Mus musculus
ttcagattgtagcacggctgaagaa

SEQ ID NO: 985840 - DNA, 25 bp, Mus musculus
ttcagattgttgcacggctgaagaa

SEQ ID NO: 985841 - DNA, 25 bp, Mus musculus
ttcagcaaccctgacgactggaaag

SEQ ID NO: 985842 - DNA, 25 bp, Mus musculus
ttcagcaaccctgaggactggaaag

SEQ ID NO: 985843 - DNA, 25 bp, Mus musculus
ttcagcacaaatttcacaggctgtc

SEQ ID NO: 985844 - DNA, 25 bp, Mus musculus
ttcagcacaattttcacaggctgtc

SEQ ID NO: 985845 - DNA, 25 bp, Mus musculus
ttcagcagccagctggcagccacct

SEQ ID NO: 985846 - DNA, 25 bp, Mus musculus
ttcagcagccaggtggcagccacct

SEQ ID NO: 985847 - DNA, 25 bp, Mus musculus
ttcagcagcggcaccacagcaccca

SEQ ID NO: 985848 - DNA, 25 bp, Mus musculus
ttcagcagcggcacgacagcaccca

SEQ ID NO: 985849 - DNA, 25 bp, Mus musculus
ttcagcaggaagaaaaatctctttg

SEQ ID NO: 985850 - DNA, 25 bp, Mus musculus
ttcagcaggaagcgtcccaggttcc

SEQ ID NO: 985851 - DNA, 25 bp, Mus musculus
ttcagcaggaagggtcccaggttcc

SEQ ID NO: 985852 - DNA, 25 bp, Mus musculus
ttcagcaggaagtaaaatctctttg

SEQ ID NO: 985853 - DNA, 25 bp, Mus musculus
ttcagcagtgtgatgtgggaggaga

SEQ ID NO: 985854 - DNA, 25 bp, Mus musculus
ttcagcagtgtgttgtgggaggaga

SEQ ID NO: 985855 - DNA, 25 bp, Mus musculus
ttcagcatgggcaaagaagtgcttc

SEQ ID NO: 985856 - DNA, 25 bp, Mus musculus
ttcagcatgggcaatgaagtgcttc

SEQ ID NO: 985857 - DNA, 25 bp, Mus musculus
ttcagcattaagagaaattgctttt

SEQ ID NO: 985858 - DNA, 25 bp, Mus musculus
ttcagcattaagtgaaattgctttt

SEQ ID NO: 985859 - DNA, 25 bp, Mus musculus
ttcagccaacagcactcctgagctg

SEQ ID NO: 985860 - DNA, 25 bp, Mus musculus
ttcagccaacaggactcctgagctg

SEQ ID NO: 985861 - DNA, 25 bp, Mus musculus
ttcagccaggagcgagcggacatgg

SEQ ID NO: 985862 - DNA, 25 bp, Mus musculus
ttcagccaggagggagcggacatgg

SEQ ID NO: 985863 - DNA, 25 bp, Mus musculus
ttcagccagtttcgtaagaccctaa

SEQ ID NO: 985864 - DNA, 25 bp, Mus musculus
ttcagccagtttggtaagaccctaa

SEQ ID NO: 985865 - DNA, 25 bp, Mus musculus
ttcagccatgggctatggctcctac

SEQ ID NO: 985866 - DNA, 25 bp, Mus musculus
ttcagccatggggtatggctcctac

SEQ ID NO: 985867 - DNA, 25 bp, Mus musculus
ttcagcccagacacagctgtggtct

SEQ ID NO: 985868 - DNA, 25 bp, Mus musculus
ttcagcccagtcacagctgtggtct

SEQ ID NO: 985869 - DNA, 25 bp, Mus musculus
ttcagcccggcacgatgatgcccgg

SEQ ID NO: 985870 - DNA, 25 bp, Mus musculus
ttcagcccggcaggatgatgcccgg

SEQ ID NO: 985871 - DNA, 25 bp, Mus musculus
ttcagccctgcgcacgtgtgtcccc

SEQ ID NO: 985872 - DNA, 25 bp, Mus musculus
ttcagccctgcggacgtgtgtcccc

SEQ ID NO: 985873 - DNA, 25 bp, Mus musculus
ttcagccgagaaacatcccaaaccg

SEQ ID NO: 985874 - DNA, 25 bp, Mus musculus
ttcagccgagaagaactttgatcag

SEQ ID NO: 985875 - DNA, 25 bp, Mus musculus
ttcagccgagtaacatcccaaaccg

SEQ ID NO: 985876 - DNA, 25 bp, Mus musculus
ttcagccgagtagaactttgatcag

SEQ ID NO: 985877 - DNA, 25 bp, Mus musculus
ttcagccgagtgagtgaattagatg

SEQ ID NO: 985878 - DNA, 25 bp, Mus musculus
ttcagccgagtgtgtgaattagatg

SEQ ID NO: 985879 - DNA, 25 bp, Mus musculus
ttcagccgcatccctctgaagaaag

SEQ ID NO: 985880 - DNA, 25 bp, Mus musculus
ttcagccgcatcgctctgaagaaag

SEQ ID NO: 985881 - DNA, 25 bp, Mus musculus
ttcagcctactgcgttccaggagtg

SEQ ID NO: 985882 - DNA, 25 bp, Mus musculus
ttcagcctactgggttccaggagtg

SEQ ID NO: 985883 - DNA, 25 bp, Mus musculus
ttcagcctatctcgctctcaggctg

SEQ ID NO: 985884 - DNA, 25 bp, Mus musculus
ttcagcctatctggctctcaggctg

SEQ ID NO: 985885 - DNA, 25 bp, Mus musculus
ttcagcgagccccggctgttgataa

SEQ ID NO: 985886 - DNA, 25 bp, Mus musculus
ttcagcgagcccgggctgttgataa

SEQ ID NO: 985887 - DNA, 25 bp, Mus musculus
ttcagcgaggaacatgaggacgatg

SEQ ID NO: 985888 - DNA, 25 bp, Mus musculus
ttcagcgaggaagatgaggacgatg

SEQ ID NO: 985889 - DNA, 25 bp, Mus musculus
ttcagcgccgcccctggagagatgt

SEQ ID NO: 985890 - DNA, 25 bp, Mus musculus
ttcagcgccgccgctggagagatgt

SEQ ID NO: 985891 - DNA, 25 bp, Mus musculus
ttcagcgtgtctcatactacaagga

SEQ ID NO: 985892 - DNA, 25 bp, Mus musculus
ttcagcgtgtctgatactacaagga

SEQ ID NO: 985893 - DNA, 25 bp, Mus musculus
ttcagctggacaccttaccagaagt

SEQ ID NO: 985894 - DNA, 25 bp, Mus musculus
ttcagctggacagcttaccagaagt

SEQ ID NO: 985895 - DNA, 25 bp, Mus musculus
ttcagctgtaatcgtgcgtctaatg

SEQ ID NO: 985896 - DNA, 25 bp, Mus musculus
ttcagctgtaatggtgcgtctaatg

SEQ ID NO: 985897 - DNA, 25 bp, Mus musculus
ttcagcttcccacacatttcagcct

SEQ ID NO: 985898 - DNA, 25 bp, Mus musculus
ttcagcttcccagacatttcagcct

SEQ ID NO: 985899 - DNA, 25 bp, Mus musculus
ttcagcttgcctcaccgaaaatggg

SEQ ID NO: 985900 - DNA, 25 bp, Mus musculus
ttcagcttgcctcagcgaaaatggg

SEQ ID NO: 985901 - DNA, 25 bp, Mus musculus
ttcaggaaaataccttggaacttag

SEQ ID NO: 985902 - DNA, 25 bp, Mus musculus
ttcaggaaaatagcttggaacttag

SEQ ID NO: 985903 - DNA, 25 bp, Mus musculus
ttcaggaaagatctccagaaagaga

SEQ ID NO: 985904 - DNA, 25 bp, Mus musculus
ttcaggaaagatgtccagaaagaga

SEQ ID NO: 985905 - DNA, 25 bp, Mus musculus
ttcaggaaagcctgcacaaggccca

SEQ ID NO: 985906 - DNA, 25 bp, Mus musculus
ttcaggaaagcctgtgggccgaagc

SEQ ID NO: 985907 - DNA, 25 bp, Mus musculus
ttcaggaaaggctgcacaaggccca

SEQ ID NO: 985908 - DNA, 25 bp, Mus musculus
ttcaggaaaggctgtgggccgaagc

SEQ ID NO: 985909 - DNA, 25 bp, Mus musculus
ttcaggaccccaaggtcatgatgct

SEQ ID NO: 985910 - DNA, 25 bp, Mus musculus
ttcaggaccccatggtcatgatgct

SEQ ID NO: 985911 - DNA, 25 bp, Mus musculus
ttcaggacggctggtcccaggatac

SEQ ID NO: 985912 - DNA, 25 bp, Mus musculus
ttcaggacgggtggtcccaggatac

SEQ ID NO: 985913 - DNA, 25 bp, Mus musculus
ttcaggagaatcagctatgctaaca

SEQ ID NO: 985914 - DNA, 25 bp, Mus musculus
ttcaggagaatctgctatgctaaca

SEQ ID NO: 985915 - DNA, 25 bp, Mus musculus
ttcaggccaagtctccaatcagaag

SEQ ID NO: 985916 - DNA, 25 bp, Mus musculus
ttcaggccaagtctgcaatcagaag

SEQ ID NO: 985917 - DNA, 25 bp, Mus musculus
ttcaggccacgaaaagaacacgaga

SEQ ID NO: 985918 - DNA, 25 bp, Mus musculus
ttcaggccacgaaatgaacacgaga

SEQ ID NO: 985919 - DNA, 25 bp, Mus musculus
ttcaggccgtcactaatgtttcaca

SEQ ID NO: 985920 - DNA, 25 bp, Mus musculus
ttcaggccgtcagtaatgtttcaca

SEQ ID NO: 985921 - DNA, 25 bp, Mus musculus
ttcagggatttgaaacacgtttgtg

SEQ ID NO: 985922 - DNA, 25 bp, Mus musculus
ttcagggatttgaatcacgtttgtg

SEQ ID NO: 985923 - DNA, 25 bp, Mus musculus
ttcagggccaaaaaagtgcggaatg

SEQ ID NO: 985924 - DNA, 25 bp, Mus musculus
ttcagggccaaaaatgtgcggaatg

SEQ ID NO: 985925 - DNA, 25 bp, Mus musculus
ttcagggccacactcgtgctgtgac

SEQ ID NO: 985926 - DNA, 25 bp, Mus musculus
ttcagggccacactggtgctgtgac

SEQ ID NO: 985927 - DNA, 25 bp, Mus musculus
ttcaggtcttcaaagccccagagga

SEQ ID NO: 985928 - DNA, 25 bp, Mus musculus
ttcaggtcttcatagccccagagga

SEQ ID NO: 985929 - DNA, 25 bp, Mus musculus
ttcaggtgtcaaataatggtccttg

SEQ ID NO: 985930 - DNA, 25 bp, Mus musculus
ttcaggtgtcaattaatggtccttg

SEQ ID NO: 985931 - DNA, 25 bp, Mus musculus
ttcaggttcagacgagtcggattgt

SEQ ID NO: 985932 - DNA, 25 bp, Mus musculus
ttcaggttcagaggagtcggattgt

SEQ ID NO: 985933 - DNA, 25 bp, Mus musculus
ttcagtactcagctagttacagcca

SEQ ID NO: 985934 - DNA, 25 bp, Mus musculus
ttcagtactcaggtagttacagcca

SEQ ID NO: 985935 - DNA, 25 bp, Mus musculus
ttcagtatcctgatcacatttgaca

SEQ ID NO: 985936 - DNA, 25 bp, Mus musculus
ttcagtatcctgttcacatttgaca

SEQ ID NO: 985937 - DNA, 25 bp, Mus musculus
ttcagtcacaaggacaactatgagt

SEQ ID NO: 985938 - DNA, 25 bp, Mus musculus
ttcagtcacaaggagaactatgagt

SEQ ID NO: 985939 - DNA, 25 bp, Mus musculus
ttcagtccaagcaccccgcagcagc

SEQ ID NO: 985940 - DNA, 25 bp, Mus musculus
ttcagtccaagcaccgggacagctt

SEQ ID NO: 985941 - DNA, 25 bp, Mus musculus
ttcagtccaagcacgccgcagcagc

SEQ ID NO: 985942 - DNA, 25 bp, Mus musculus
ttcagtccaagcacggggacagctt

SEQ ID NO: 985943 - DNA, 25 bp, Mus musculus
ttcagtctagaggacgtcagttact

SEQ ID NO: 985944 - DNA, 25 bp, Mus musculus
ttcagtctagaggaggtcagttact

SEQ ID NO: 985945 - DNA, 25 bp, Mus musculus
ttcagtctctcactgcctgtgctga

SEQ ID NO: 985946 - DNA, 25 bp, Mus musculus
ttcagtctctcagtgcctgtgctga

SEQ ID NO: 985947 - DNA, 25 bp, Mus musculus
ttcagtctgctgccccggttgcgag

SEQ ID NO: 985948 - DNA, 25 bp, Mus musculus
ttcagtctgctggcccggttgcgag

SEQ ID NO: 985949 - DNA, 25 bp, Mus musculus
ttcagtgaagaggacgtcccccaga

SEQ ID NO: 985950 - DNA, 25 bp, Mus musculus
ttcagtgaagaggaggtcccccaga

SEQ ID NO: 985951 - DNA, 25 bp, Mus musculus
ttcagtgagtcccgcatctatggaa

SEQ ID NO: 985952 - DNA, 25 bp, Mus musculus
ttcagtgagtcccggatctatggaa

SEQ ID NO: 985953 - DNA, 25 bp, Mus musculus
ttcagtgcagatcacaatcaagctc

SEQ ID NO: 985954 - DNA, 25 bp, Mus musculus
ttcagtgcagatcagaatcaagctc

SEQ ID NO: 985955 - DNA, 25 bp, Mus musculus
ttcagtgcctgccacgtgagaagcc

SEQ ID NO: 985956 - DNA, 25 bp, Mus musculus
ttcagtgcctgccaggtgagaagcc

SEQ ID NO: 985957 - DNA, 25 bp, Mus musculus
ttcagtgcgcagcctgatgcagaca

SEQ ID NO: 985958 - DNA, 25 bp, Mus musculus
ttcagtgcgcaggctgatgcagaca

SEQ ID NO: 985959 - DNA, 25 bp, Mus musculus
ttcagtggaccaaattttcaggatg

SEQ ID NO: 985960 - DNA, 25 bp, Mus musculus
ttcagtggaccatattttcaggatg

SEQ ID NO: 985961 - DNA, 25 bp, Mus musculus
ttcagtggtcgtcgtggctttggtg

SEQ ID NO: 985962 - DNA, 25 bp, Mus musculus
ttcagtggtcgtggtggctttggtg

SEQ ID NO: 985963 - DNA, 25 bp, Mus musculus
ttcagtgtctagctggaaatggcta

SEQ ID NO: 985964 - DNA, 25 bp, Mus musculus
ttcagtgtctaggtggaaatggcta

SEQ ID NO: 985965 - DNA, 25 bp, Mus musculus
ttcagttacacacttgccctaaact

SEQ ID NO: 985966 - DNA, 25 bp, Mus musculus
ttcagttacacagttgccctaaact

SEQ ID NO: 985967 - DNA, 25 bp, Mus musculus
ttcagttgacaccagccgtctaccc

SEQ ID NO: 985968 - DNA, 25 bp, Mus musculus
ttcagttgacaccgaacagtccaat

SEQ ID NO: 985969 - DNA, 25 bp, Mus musculus
ttcagttgacacgagccgtctaccc

SEQ ID NO: 985970 - DNA, 25 bp, Mus musculus
ttcagttgacacggaacagtccaat

SEQ ID NO: 985971 - DNA, 25 bp, Mus musculus
ttcagtttctcgcacagtgttcctg

SEQ ID NO: 985972 - DNA, 25 bp, Mus musculus
ttcagtttctcgcacatatattacc

SEQ ID NO: 985973 - DNA, 25 bp, Mus musculus
ttcagtttctcgcagagtgttcctg

SEQ ID NO: 985974 - DNA, 25 bp, Mus musculus
ttcagtttctcgcagatatattacc

SEQ ID NO: 985975 - DNA, 25 bp, Mus musculus
ttcagttttacagacatcctgggtg

SEQ ID NO: 985976 - DNA, 25 bp, Mus musculus
ttcagttttacagagatcctgggtg

SEQ ID NO: 985977 - DNA, 25 bp, Mus musculus
ttcataaaagagtaagtgagcaaga

SEQ ID NO: 985978 - DNA, 25 bp, Mus musculus
ttcataaaagtgtaagtgagcaaga

SEQ ID NO: 985979 - DNA, 25 bp, Mus musculus
ttcataacagatctcagcgactcca

SEQ ID NO: 985980 - DNA, 25 bp, Mus musculus
ttcataacagttctcagcgactcca

SEQ ID NO: 985981 - DNA, 25 bp, Mus musculus
ttcataagaagaaactgcagctggc

SEQ ID NO: 985982 - DNA, 25 bp, Mus musculus
ttcataagaagatactgcagctggc

SEQ ID NO: 985983 - DNA, 25 bp, Mus musculus
ttcataagaagtctttccacgatga

SEQ ID NO: 985984 - DNA, 25 bp, Mus musculus
ttcataagaagtgtttccacgatga

SEQ ID NO: 985985 - DNA, 25 bp, Mus musculus
ttcatagaagatcaagatgtagaac

SEQ ID NO: 985986 - DNA, 25 bp, Mus musculus
ttcatagaagctacttcaagagtaa

SEQ ID NO: 985987 - DNA, 25 bp, Mus musculus
ttcatagaaggtacttcaagagtaa

SEQ ID NO: 985988 - DNA, 25 bp, Mus musculus
ttcatagaagttcaagatgtagaac

SEQ ID NO: 985989 - DNA, 25 bp, Mus musculus
ttcatagttgatcttatcaatgtgg

SEQ ID NO: 985990 - DNA, 25 bp, Mus musculus
ttcatagttgatgttatcaatgtgg

SEQ ID NO: 985991 - DNA, 25 bp, Mus musculus
ttcatatacaaacgcagtttgagga

SEQ ID NO: 985992 - DNA, 25 bp, Mus musculus
ttcatatacaaaggcagtttgagga

SEQ ID NO: 985993 - DNA, 25 bp, Mus musculus
ttcatatgttactacgagtcaagct

SEQ ID NO: 985994 - DNA, 25 bp, Mus musculus
ttcatatgttactaggagtcaagct

SEQ ID NO: 985995 - DNA, 25 bp, Mus musculus
ttcatattgataaacgcatgaaaga

SEQ ID NO: 985996 - DNA, 25 bp, Mus musculus
ttcatattgataaaggcatgaaaga

SEQ ID NO: 985997 - DNA, 25 bp, Mus musculus
ttcatattgtcacgtctgtgttcca

SEQ ID NO: 985998 - DNA, 25 bp, Mus musculus
ttcatattgtcaggtctgtgttcca

SEQ ID NO: 985999 - DNA, 25 bp, Mus musculus
ttcatcaaagctccaattggttgtg

SEQ ID NO: 986000 - DNA, 25 bp, Mus musculus
ttcatcaaagctgcaattggttgtg

SEQ ID NO: 986001 - DNA, 25 bp, Mus musculus
ttcatcaaatacgacaccaacctga

SEQ ID NO: 986002 - DNA, 25 bp, Mus musculus
ttcatcaaatacgagaccaacctga

SEQ ID NO: 986003 - DNA, 25 bp, Mus musculus
ttcatcaacaagctgacaagagcag

SEQ ID NO: 986004 - DNA, 25 bp, Mus musculus
ttcatcaacaaggtgacaagagcag

SEQ ID NO: 986005 - DNA, 25 bp, Mus musculus
ttcatcaaccatgttattctcacag

SEQ ID NO: 986006 - DNA, 25 bp, Mus musculus
ttcatcaaccttgttattctcacag

SEQ ID NO: 986007 - DNA, 25 bp, Mus musculus
ttcatcaagccacgtaagcagcctc

SEQ ID NO: 986008 - DNA, 25 bp, Mus musculus
ttcatcaagccaggtaagcagcctc

SEQ ID NO: 986009 - DNA, 25 bp, Mus musculus
ttcatcaccaacacagacgtcttta

SEQ ID NO: 986010 - DNA, 25 bp, Mus musculus
ttcatcaccaacacgtctttattgc

SEQ ID NO: 986011 - DNA, 25 bp, Mus musculus
ttcatcaccaactcagacgtcttta

SEQ ID NO: 986012 - DNA, 25 bp, Mus musculus
ttcatcaccaactcgtctttattgc

SEQ ID NO: 986013 - DNA, 25 bp, Mus musculus
ttcatcagccagcagccagtcctgt

SEQ ID NO: 986014 - DNA, 25 bp, Mus musculus
ttcatcagccaggagccagtcctgt

SEQ ID NO: 986015 - DNA, 25 bp, Mus musculus
ttcatcatggcaaactgtgacgtgt

SEQ ID NO: 986016 - DNA, 25 bp, Mus musculus
ttcatcatgggaaactgtgacgtgt

SEQ ID NO: 986017 - DNA, 25 bp, Mus musculus
ttcatcatttggactttctaaagaa

SEQ ID NO: 986018 - DNA, 25 bp, Mus musculus
ttcatcatttggtctttctaaagaa

SEQ ID NO: 986019 - DNA, 25 bp, Mus musculus
ttcatcattttcagcaatgctgcca

SEQ ID NO: 986020 - DNA, 25 bp, Mus musculus
ttcatcattttctgcaatgctgcca

SEQ ID NO: 986021 - DNA, 25 bp, Mus musculus
ttcatccacttgctggagaattcag

SEQ ID NO: 986022 - DNA, 25 bp, Mus musculus
ttcatccacttggtggagaattcag

SEQ ID NO: 986023 - DNA, 25 bp, Mus musculus
ttcatcccagctctgtcgggttgct

SEQ ID NO: 986024 - DNA, 25 bp, Mus musculus
ttcatcccaggacatcttcccacgg

SEQ ID NO: 986025 - DNA, 25 bp, Mus musculus
ttcatcccaggagatcttcccacgg

SEQ ID NO: 986026 - DNA, 25 bp, Mus musculus
ttcatcccaggtctgtcgggttgct

SEQ ID NO: 986027 - DNA, 25 bp, Mus musculus
ttcatccccaagcggacaaatgtaa

SEQ ID NO: 986028 - DNA, 25 bp, Mus musculus
ttcatccccaagcggacgacactca

SEQ ID NO: 986029 - DNA, 25 bp, Mus musculus
ttcatccccaaggggacaaatgtaa

SEQ ID NO: 986030 - DNA, 25 bp, Mus musculus
ttcatccccaaggggacgacactca

SEQ ID NO: 986031 - DNA, 25 bp, Mus musculus
ttcatccccagagacaaccttcttc

SEQ ID NO: 986032 - DNA, 25 bp, Mus musculus
ttcatccccagagacatgaggaaag

SEQ ID NO: 986033 - DNA, 25 bp, Mus musculus
ttcatccccagagaccatttctggc

SEQ ID NO: 986034 - DNA, 25 bp, Mus musculus
ttcatccccagagagaaccttcttc

SEQ ID NO: 986035 - DNA, 25 bp, Mus musculus
ttcatccccagagagatgaggaaag

SEQ ID NO: 986036 - DNA, 25 bp, Mus musculus
ttcatccccagagagcatttctggc

SEQ ID NO: 986037 - DNA, 25 bp, Mus musculus
ttcatccgagagctgcagcaattct

SEQ ID NO: 986038 - DNA, 25 bp, Mus musculus
ttcatccgagtgctgcagcaattct

SEQ ID NO: 986039 - DNA, 25 bp, Mus musculus
ttcatcctagcgctttgcctgagaa

SEQ ID NO: 986040 - DNA, 25 bp, Mus musculus
ttcatcctagcggtttgcctgagaa

SEQ ID NO: 986041 - DNA, 25 bp, Mus musculus
ttcatccttttccacacagtccagg

SEQ ID NO: 986042 - DNA, 25 bp, Mus musculus
ttcatccttttccagacagtccagg

SEQ ID NO: 986043 - DNA, 25 bp, Mus musculus
ttcatcgacaaacacaacactgctt

SEQ ID NO: 986044 - DNA, 25 bp, Mus musculus
ttcatcgacaaagacaacactgctt

SEQ ID NO: 986045 - DNA, 25 bp, Mus musculus
ttcatcgacaagctacgcttcctgg

SEQ ID NO: 986046 - DNA, 25 bp, Mus musculus
ttcatcgacaaggtacgcttcctgg

SEQ ID NO: 986047 - DNA, 25 bp, Mus musculus
ttcatcgataccctgatgcaattgc

SEQ ID NO: 986048 - DNA, 25 bp, Mus musculus
ttcatcgataccgtgatgcaattgc

SEQ ID NO: 986049 - DNA, 25 bp, Mus musculus
ttcatcgtcagacggtggctgcata

SEQ ID NO: 986050 - DNA, 25 bp, Mus musculus
ttcatcgtcagagggtggctgcata

SEQ ID NO: 986051 - DNA, 25 bp, Mus musculus
ttcatctcagagggcgtccgtgtga

SEQ ID NO: 986052 - DNA, 25 bp, Mus musculus
ttcatctcagagggggtccgtgtga

SEQ ID NO: 986053 - DNA, 25 bp, Mus musculus
ttcatctcagatgcctgcaaaacaa

SEQ ID NO: 986054 - DNA, 25 bp, Mus musculus
ttcatctcagctcactgaacagttt

SEQ ID NO: 986055 - DNA, 25 bp, Mus musculus
ttcatctcagctcagtgaacagttt

SEQ ID NO: 986056 - DNA, 25 bp, Mus musculus
ttcatctcagttgcctgcaaaacaa

SEQ ID NO: 986057 - DNA, 25 bp, Mus musculus
ttcatctctcgacaatccatccctt

SEQ ID NO: 986058 - DNA, 25 bp, Mus musculus
ttcatctctcgacattccatccctt

SEQ ID NO: 986059 - DNA, 25 bp, Mus musculus
ttcatctctgctcttgacgaagtga

SEQ ID NO: 986060 - DNA, 25 bp, Mus musculus
ttcatctctggtcttgacgaagtga

SEQ ID NO: 986061 - DNA, 25 bp, Mus musculus
ttcatctgctggcaccagagtgagg

SEQ ID NO: 986062 - DNA, 25 bp, Mus musculus
ttcatctgctgggaccagagtgagg

SEQ ID NO: 986063 - DNA, 25 bp, Mus musculus
ttcatctgggaatctacagtgattt

SEQ ID NO: 986064 - DNA, 25 bp, Mus musculus
ttcatctgggtatctacagtgattt

SEQ ID NO: 986065 - DNA, 25 bp, Mus musculus
ttcatcttagcacaggagcagttca

SEQ ID NO: 986066 - DNA, 25 bp, Mus musculus
ttcatcttagcagaggagcagttca

SEQ ID NO: 986067 - DNA, 25 bp, Mus musculus
ttcatcttatcacgagcacggcatc

SEQ ID NO: 986068 - DNA, 25 bp, Mus musculus
ttcatcttatcaggagcacggcatc

SEQ ID NO: 986069 - DNA, 25 bp, Mus musculus
ttcatgaaagatccgacgagatatc

SEQ ID NO: 986070 - DNA, 25 bp, Mus musculus
ttcatgaaagcaatacagatgttat

SEQ ID NO: 986071 - DNA, 25 bp, Mus musculus
ttcatgaaaggaatacagatgttat

SEQ ID NO: 986072 - DNA, 25 bp, Mus musculus
ttcatgaaagttccgacgagatatc

SEQ ID NO: 986073 - DNA, 25 bp, Mus musculus
ttcatgaataagcacttccgggctt

SEQ ID NO: 986074 - DNA, 25 bp, Mus musculus
ttcatgaataagcagttccgggctt

SEQ ID NO: 986075 - DNA, 25 bp, Mus musculus
ttcatgacaccacgacttcctccat

SEQ ID NO: 986076 - DNA, 25 bp, Mus musculus
ttcatgacaccaggacttcctccat

SEQ ID NO: 986077 - DNA, 25 bp, Mus musculus
ttcatgagaaaacgtattgttgggg

SEQ ID NO: 986078 - DNA, 25 bp, Mus musculus
ttcatgagaaaaggtattgttgggg

SEQ ID NO: 986079 - DNA, 25 bp, Mus musculus
ttcatgagccagaaccgcatattct

SEQ ID NO: 986080 - DNA, 25 bp, Mus musculus
ttcatgagccagtaccgcatattct

SEQ ID NO: 986081 - DNA, 25 bp, Mus musculus
ttcatgagcctgaataaggatggct

SEQ ID NO: 986082 - DNA, 25 bp, Mus musculus
ttcatgagcctgtataaggatggct

SEQ ID NO: 986083 - DNA, 25 bp, Mus musculus
ttcatgcaagatcctatggagatct

SEQ ID NO: 986084 - DNA, 25 bp, Mus musculus
ttcatgcaagatgctatggagatct

SEQ ID NO: 986085 - DNA, 25 bp, Mus musculus
ttcatgcacaagatgccacgcctgt

SEQ ID NO: 986086 - DNA, 25 bp, Mus musculus
ttcatgcacaagttgccacgcctgt

SEQ ID NO: 986087 - DNA, 25 bp, Mus musculus
ttcatgcacactggtgtggcccctg

SEQ ID NO: 986088 - DNA, 25 bp, Mus musculus
ttcatgcacagtggtgtggcccctg

SEQ ID NO: 986089 - DNA, 25 bp, Mus musculus
ttcatgccagattcagaaagcagct

SEQ ID NO: 986090 - DNA, 25 bp, Mus musculus
ttcatgccagtttcagaaagcagct

SEQ ID NO: 986091 - DNA, 25 bp, Mus musculus
ttcatgctggatcatactatcgtgg

SEQ ID NO: 986092 - DNA, 25 bp, Mus musculus
ttcatgctggatgacctcaatgcca

SEQ ID NO: 986093 - DNA, 25 bp, Mus musculus
ttcatgctggatgatactatcgtgg

SEQ ID NO: 986094 - DNA, 25 bp, Mus musculus
ttcatgctggttgacctcaatgcca

SEQ ID NO: 986095 - DNA, 25 bp, Mus musculus
ttcatggacgccctggttgctgcta

SEQ ID NO: 986096 - DNA, 25 bp, Mus musculus
ttcatggacggcctggttgctgcta

SEQ ID NO: 986097 - DNA, 25 bp, Mus musculus
ttcatggagcagcttcatcgaggca

SEQ ID NO: 986098 - DNA, 25 bp, Mus musculus
ttcatggagcaggttcatcgaggca

SEQ ID NO: 986099 - DNA, 25 bp, Mus musculus
ttcatggtactgctgtattttcatc

SEQ ID NO: 986100 - DNA, 25 bp, Mus musculus
ttcatggtactggtgtattttcatc

SEQ ID NO: 986101 - DNA, 25 bp, Mus musculus
ttcatggtcacacacatacttgttg

SEQ ID NO: 986102 - DNA, 25 bp, Mus musculus
ttcatggtcacacagatacttgttg

SEQ ID NO: 986103 - DNA, 25 bp, Mus musculus
ttcatggtgaagcacacatcttacc

SEQ ID NO: 986104 - DNA, 25 bp, Mus musculus
ttcatggtgaaggacacatcttacc

SEQ ID NO: 986105 - DNA, 25 bp, Mus musculus
ttcatgtaagctggtttgtgatgaa

SEQ ID NO: 986106 - DNA, 25 bp, Mus musculus
ttcatgtaaggtggtttgtgatgaa

SEQ ID NO: 986107 - DNA, 25 bp, Mus musculus
ttcatgtatgatgactttgtagaag

SEQ ID NO: 986108 - DNA, 25 bp, Mus musculus
ttcatgtatgatgagtttgtagaag

SEQ ID NO: 986109 - DNA, 25 bp, Mus musculus
ttcatgtctgcatgtgtctagtccg

SEQ ID NO: 986110 - DNA, 25 bp, Mus musculus
ttcatgtctggatgtgtctagtccg

SEQ ID NO: 986111 - DNA, 25 bp, Mus musculus
ttcatgtgccagcctggatggcaag

SEQ ID NO: 986112 - DNA, 25 bp, Mus musculus
ttcatgtgccagcctggcgacttca

SEQ ID NO: 986113 - DNA, 25 bp, Mus musculus
ttcatgtgccagcgtggtgacttta

SEQ ID NO: 986114 - DNA, 25 bp, Mus musculus
ttcatgtgccaggctggatggcaag

SEQ ID NO: 986115 - DNA, 25 bp, Mus musculus
ttcatgtgccaggctggcgacttca

SEQ ID NO: 986116 - DNA, 25 bp, Mus musculus
ttcatgtgccagggtggtgacttta

SEQ ID NO: 986117 - DNA, 25 bp, Mus musculus
ttcatgtgctaacagagggagagta

SEQ ID NO: 986118 - DNA, 25 bp, Mus musculus
ttcatgtgctaagagagggagagta

SEQ ID NO: 986119 - DNA, 25 bp, Mus musculus
ttcatgttcgtgattgtgctgtcct

SEQ ID NO: 986120 - DNA, 25 bp, Mus musculus
ttcatgttcgtgtttgtgctgtcct

SEQ ID NO: 986121 - DNA, 25 bp, Mus musculus
ttcatgtttccacttggcctctatt

SEQ ID NO: 986122 - DNA, 25 bp, Mus musculus
ttcatgtttccagttggcctctatt

SEQ ID NO: 986123 - DNA, 25 bp, Mus musculus
ttcatgtttggacgccatgacacca

SEQ ID NO: 986124 - DNA, 25 bp, Mus musculus
ttcatgtttggaggccatgacacca

SEQ ID NO: 986125 - DNA, 25 bp, Mus musculus
ttcattaatgagcgccttaaagctg

SEQ ID NO: 986126 - DNA, 25 bp, Mus musculus
ttcattaatgagggccttaaagctg

SEQ ID NO: 986127 - DNA, 25 bp, Mus musculus
ttcattacgtaaagaagtacttaag

SEQ ID NO: 986128 - DNA, 25 bp, Mus musculus
ttcattacgtaatgaagtacttaag

SEQ ID NO: 986129 - DNA, 25 bp, Mus musculus
ttcattcacaaccacgaacggcacc

SEQ ID NO: 986130 - DNA, 25 bp, Mus musculus
ttcattcacaaccaggaacggcacc

SEQ ID NO: 986131 - DNA, 25 bp, Mus musculus
ttcattcactcacataacagtgcac

SEQ ID NO: 986132 - DNA, 25 bp, Mus musculus
ttcattcactcagataacagtgcac

SEQ ID NO: 986133 - DNA, 25 bp, Mus musculus
ttcattccatagtgagttcttagac

SEQ ID NO: 986134 - DNA, 25 bp, Mus musculus
ttcattccattgtgagttcttagac

SEQ ID NO: 986135 - DNA, 25 bp, Mus musculus
ttcattctcatccccgagctgaatg

SEQ ID NO: 986136 - DNA, 25 bp, Mus musculus
ttcattctcatcgccgagctgaatg

SEQ ID NO: 986137 - DNA, 25 bp, Mus musculus
ttcattctgcgccacgtcattgaga

SEQ ID NO: 986138 - DNA, 25 bp, Mus musculus
ttcattctgcgccaggtcattgaga

SEQ ID NO: 986139 - DNA, 25 bp, Mus musculus
ttcattctggcttgcccaaagctat

SEQ ID NO: 986140 - DNA, 25 bp, Mus musculus
ttcattctggcttggccaaagctat

SEQ ID NO: 986141 - DNA, 25 bp, Mus musculus
ttcattgatctgcttatccaggccg

SEQ ID NO: 986142 - DNA, 25 bp, Mus musculus
ttcattgatctggttatccaggccg

SEQ ID NO: 986143 - DNA, 25 bp, Mus musculus
ttcattgcagagtccggcgggccct

SEQ ID NO: 986144 - DNA, 25 bp, Mus musculus
ttcattgcagtgtccggcgggccct

SEQ ID NO: 986145 - DNA, 25 bp, Mus musculus
ttcattggagctttaggattagcat

SEQ ID NO: 986146 - DNA, 25 bp, Mus musculus
ttcattggaggtttaggattagcat

SEQ ID NO: 986147 - DNA, 25 bp, Mus musculus
ttcattggtacacatgtgggcacag

SEQ ID NO: 986148 - DNA, 25 bp, Mus musculus
ttcattggtacagatgtgggcacag

SEQ ID NO: 986149 - DNA, 25 bp, Mus musculus
ttcattgtggagaacggtatgcctg

SEQ ID NO: 986150 - DNA, 25 bp, Mus musculus
ttcattgtggagaagggtatgcctg

SEQ ID NO: 986151 - DNA, 25 bp, Mus musculus
ttcatttaaaatcgatgtgaaatga

SEQ ID NO: 986152 - DNA, 25 bp, Mus musculus
ttcatttaaaatggatgtgaaatga

SEQ ID NO: 986153 - DNA, 25 bp, Mus musculus
ttcatttatgactgttacaaaattt

SEQ ID NO: 986154 - DNA, 25 bp, Mus musculus
ttcatttatgcgatccagaaaatag

SEQ ID NO: 986155 - DNA, 25 bp, Mus musculus
ttcatttatgctagcattaaaggaa

SEQ ID NO: 986156 - DNA, 25 bp, Mus musculus
ttcatttatgggatccagaaaatag

SEQ ID NO: 986157 - DNA, 25 bp, Mus musculus
ttcatttatggtagcattaaaggaa

SEQ ID NO: 986158 - DNA, 25 bp, Mus musculus
ttcatttatgtctgttacaaaattt

SEQ ID NO: 986159 - DNA, 25 bp, Mus musculus
ttcatttcagatgcctctctgcatt

SEQ ID NO: 986160 - DNA, 25 bp, Mus musculus
ttcatttcagttgcctctctgcatt

SEQ ID NO: 986161 - DNA, 25 bp, Mus musculus
ttcatttcctttcacaagacccagc

SEQ ID NO: 986162 - DNA, 25 bp, Mus musculus
ttcatttcctttcagaagacccagc

SEQ ID NO: 986163 - DNA, 25 bp, Mus musculus
ttcatttcggctcacactcgcatgt

SEQ ID NO: 986164 - DNA, 25 bp, Mus musculus
ttcatttcggctcacggaagtgact

SEQ ID NO: 986165 - DNA, 25 bp, Mus musculus
ttcatttcggctcagactcgcatgt

SEQ ID NO: 986166 - DNA, 25 bp, Mus musculus
ttcatttcggctcagggaagtgact

SEQ ID NO: 986167 - DNA, 25 bp, Mus musculus
ttcatttgagggcgtcaggacaaag

SEQ ID NO: 986168 - DNA, 25 bp, Mus musculus
ttcatttgagggggtcaggacaaag

SEQ ID NO: 986169 - DNA, 25 bp, Mus musculus
ttcatttgtatgtaaaggctgttat

SEQ ID NO: 986170 - DNA, 25 bp, Mus musculus
ttcatttgtatgtataggctgttat

SEQ ID NO: 986171 - DNA, 25 bp, Mus musculus
ttcattttgaaacacgagaagccct

SEQ ID NO: 986172 - DNA, 25 bp, Mus musculus
ttcattttgaaagacgagaagccct

SEQ ID NO: 986173 - DNA, 25 bp, Mus musculus
ttcatttttgctgacgtaaatagcg

SEQ ID NO: 986174 - DNA, 25 bp, Mus musculus
ttcatttttgctgaggtaaatagcg

SEQ ID NO: 986175 - DNA, 25 bp, Mus musculus
ttccaaaaggagactttctgcactg

SEQ ID NO: 986176 - DNA, 25 bp, Mus musculus
ttccaaaaggagtctttctgcactg

SEQ ID NO: 986177 - DNA, 25 bp, Mus musculus
ttccaaaatggccaagtcagggatg

SEQ ID NO: 986178 - DNA, 25 bp, Mus musculus
ttccaaaatggccatgtcagggatg

SEQ ID NO: 986179 - DNA, 25 bp, Mus musculus
ttccaaacacagccagccaatgcca

SEQ ID NO: 986180 - DNA, 25 bp, Mus musculus
ttccaaacacagccccagccagcca

SEQ ID NO: 986181 - DNA, 25 bp, Mus musculus
ttccaaacacaggcagccaatgcca

SEQ ID NO: 986182 - DNA, 25 bp, Mus musculus
ttccaaacacaggcccagccagcca

SEQ ID NO: 986183 - DNA, 25 bp, Mus musculus
ttccaaacttgacgaaatctacgct

SEQ ID NO: 986184 - DNA, 25 bp, Mus musculus
ttccaaacttgaggaaatctacgct

SEQ ID NO: 986185 - DNA, 25 bp, Mus musculus
ttccaaagacagcacaaaactttcg

SEQ ID NO: 986186 - DNA, 25 bp, Mus musculus
ttccaaagacagcagaaaactttcg

SEQ ID NO: 986187 - DNA, 25 bp, Mus musculus
ttccaaagagccctgctgttccccg

SEQ ID NO: 986188 - DNA, 25 bp, Mus musculus
ttccaaagaggcctgctgttccccg

SEQ ID NO: 986189 - DNA, 25 bp, Mus musculus
ttccaaagatactggcattgcccga

SEQ ID NO: 986190 - DNA, 25 bp, Mus musculus
ttccaaagattctggcattgcccga

SEQ ID NO: 986191 - DNA, 25 bp, Mus musculus
ttccaacaagccatttgtatcccag

SEQ ID NO: 986192 - DNA, 25 bp, Mus musculus
ttccaacaaggcatttgtatcccag

SEQ ID NO: 986193 - DNA, 25 bp, Mus musculus
ttccaacatggtcgatgtattcatg

SEQ ID NO: 986194 - DNA, 25 bp, Mus musculus
ttccaacatggtggatgtattcatg

SEQ ID NO: 986195 - DNA, 25 bp, Mus musculus
ttccaaccagacctcccccaggatc

SEQ ID NO: 986196 - DNA, 25 bp, Mus musculus
ttccaaccagacctgccccaggatc

SEQ ID NO: 986197 - DNA, 25 bp, Mus musculus
ttccaaccagctcgctgaagccatc

SEQ ID NO: 986198 - DNA, 25 bp, Mus musculus
ttccaaccagctggctgaagccatc

SEQ ID NO: 986199 - DNA, 25 bp, Mus musculus
ttccaacccaagctcttttgtgact

SEQ ID NO: 986200 - DNA, 25 bp, Mus musculus
ttccaacccaaggtcttttgtgact

SEQ ID NO: 986201 - DNA, 25 bp, Mus musculus
ttccaacctacaagggcaagatgaa

SEQ ID NO: 986202 - DNA, 25 bp, Mus musculus
ttccaacctacatgggcaagatgaa

SEQ ID NO: 986203 - DNA, 25 bp, Mus musculus
ttccaacgaaagagttcaatgtggg

SEQ ID NO: 986204 - DNA, 25 bp, Mus musculus
ttccaacgaaagtgttcaatgtggg

SEQ ID NO: 986205 - DNA, 25 bp, Mus musculus
ttccaactcacgctgcttctgatgc

SEQ ID NO: 986206 - DNA, 25 bp, Mus musculus
ttccaactcaggctgcttctgatgc

SEQ ID NO: 986207 - DNA, 25 bp, Mus musculus
ttccaagaggcaacaactgtatgtg

SEQ ID NO: 986208 - DNA, 25 bp, Mus musculus
ttccaagagggaacaactgtatgtg

SEQ ID NO: 986209 - DNA, 25 bp, Mus musculus
ttccaagagtgcaacgacttgaatg

SEQ ID NO: 986210 - DNA, 25 bp, Mus musculus
ttccaagagtgcaaggacttgaatg

SEQ ID NO: 986211 - DNA, 25 bp, Mus musculus
ttccaagatgatccccacaccagtt

SEQ ID NO: 986212 - DNA, 25 bp, Mus musculus
ttccaagatgatgcccacaccagtt

SEQ ID NO: 986213 - DNA, 25 bp, Mus musculus
ttccaagatgtaccatgaaaccatg

SEQ ID NO: 986214 - DNA, 25 bp, Mus musculus
ttccaagatgtaccttgaaaccatg

SEQ ID NO: 986215 - DNA, 25 bp, Mus musculus
ttccaagcaatgaggtacacggatg

SEQ ID NO: 986216 - DNA, 25 bp, Mus musculus
ttccaagcaatgtggtacacggatg

SEQ ID NO: 986217 - DNA, 25 bp, Mus musculus
ttccaagcacatcaatgaaacaagc

SEQ ID NO: 986218 - DNA, 25 bp, Mus musculus
ttccaagcacatgaatgaaacaagc

SEQ ID NO: 986219 - DNA, 25 bp, Mus musculus
ttccaagcctgacgactgggacaag

SEQ ID NO: 986220 - DNA, 25 bp, Mus musculus
ttccaagcctgacgactgggatgaa

SEQ ID NO: 986221 - DNA, 25 bp, Mus musculus
ttccaagcctgaggactgggacaag

SEQ ID NO: 986222 - DNA, 25 bp, Mus musculus
ttccaagcctgaggactgggatgaa

SEQ ID NO: 986223 - DNA, 25 bp, Mus musculus
ttccaaggagctcaggaaggtccac

SEQ ID NO: 986224 - DNA, 25 bp, Mus musculus
ttccaaggaggtcaggaaggtccac

SEQ ID NO: 986225 - DNA, 25 bp, Mus musculus
ttccaaggatgagtcggtggaagag

SEQ ID NO: 986226 - DNA, 25 bp, Mus musculus
ttccaaggatgagtgggtggaagag

SEQ ID NO: 986227 - DNA, 25 bp, Mus musculus
ttccaaggctatatctcttgatcac

SEQ ID NO: 986228 - DNA, 25 bp, Mus musculus
ttccaaggctttatctcttgatcac

SEQ ID NO: 986229 - DNA, 25 bp, Mus musculus
ttccaatacaagcacaggggagtat

SEQ ID NO: 986230 - DNA, 25 bp, Mus musculus
ttccaatacaaggacaggggagtat

SEQ ID NO: 986231 - DNA, 25 bp, Mus musculus
ttccaatatgcctttatcctcttgt

SEQ ID NO: 986232 - DNA, 25 bp, Mus musculus
ttccaatatggctttatcctcttgt

SEQ ID NO: 986233 - DNA, 25 bp, Mus musculus
ttccacaaagcattgttgagctgaa

SEQ ID NO: 986234 - DNA, 25 bp, Mus musculus
ttccacaaaggattgttgagctgaa

SEQ ID NO: 986235 - DNA, 25 bp, Mus musculus
ttccacaacatctgcgacaagctgg

SEQ ID NO: 986236 - DNA, 25 bp, Mus musculus
ttccacaacatctgggacaagctgg

SEQ ID NO: 986237 - DNA, 25 bp, Mus musculus
ttccacaagatacactcgagcctgg

SEQ ID NO: 986238 - DNA, 25 bp, Mus musculus
ttccacaagatacagtcgagcctgg

SEQ ID NO: 986239 - DNA, 25 bp, Mus musculus
ttccacaagatacgagtaggtgcca

SEQ ID NO: 986240 - DNA, 25 bp, Mus musculus
ttccacaagataggagtaggtgcca

SEQ ID NO: 986241 - DNA, 25 bp, Mus musculus
ttccacaagtacaacatcttgattg

SEQ ID NO: 986242 - DNA, 25 bp, Mus musculus
ttccacaagtacaagatcttgattg

SEQ ID NO: 986243 - DNA, 25 bp, Mus musculus
ttccacagggagactccaccacata

SEQ ID NO: 986244 - DNA, 25 bp, Mus musculus
ttccacagggagtctccaccacata

SEQ ID NO: 986245 - DNA, 25 bp, Mus musculus
ttccacagtgatgctctagctagaa

SEQ ID NO: 986246 - DNA, 25 bp, Mus musculus
ttccacagtgttgctctagctagaa

SEQ ID NO: 986247 - DNA, 25 bp, Mus musculus
ttccacatagagctggggatcgaac

SEQ ID NO: 986248 - DNA, 25 bp, Mus musculus
ttccacatagatcagcaatcagcaa

SEQ ID NO: 986249 - DNA, 25 bp, Mus musculus
ttccacatagtgctggggatcgaac

SEQ ID NO: 986250 - DNA, 25 bp, Mus musculus
ttccacatagttcagcaatcagcaa

SEQ ID NO: 986251 - DNA, 25 bp, Mus musculus
ttccaccaaccaccagatcatacat

SEQ ID NO: 986252 - DNA, 25 bp, Mus musculus
ttccaccaaccaccttagcagatca

SEQ ID NO: 986253 - DNA, 25 bp, Mus musculus
ttccaccaaccagcagatcatacat

SEQ ID NO: 986254 - DNA, 25 bp, Mus musculus
ttccaccaaccagcttagcagatca

SEQ ID NO: 986255 - DNA, 25 bp, Mus musculus
ttccaccaagcacgcatctcggaaa

SEQ ID NO: 986256 - DNA, 25 bp, Mus musculus
ttccaccaagcaggcatctcggaaa

SEQ ID NO: 986257 - DNA, 25 bp, Mus musculus
ttccaccaccagctattccaataac

SEQ ID NO: 986258 - DNA, 25 bp, Mus musculus
ttccaccaccaggtattccaataac

SEQ ID NO: 986259 - DNA, 25 bp, Mus musculus
ttccaccacctgcatcgagaactcg

SEQ ID NO: 986260 - DNA, 25 bp, Mus musculus
ttccaccacctggatcgagaactcg

SEQ ID NO: 986261 - DNA, 25 bp, Mus musculus
ttccacctgccaaacggaaccatga

SEQ ID NO: 986262 - DNA, 25 bp, Mus musculus
ttccacctgccaaagggaaccatga

SEQ ID NO: 986263 - DNA, 25 bp, Mus musculus
ttccacgaagcagccgcagccctgt

SEQ ID NO: 986264 - DNA, 25 bp, Mus musculus
ttccacgaaggagccgcagccctgt

SEQ ID NO: 986265 - DNA, 25 bp, Mus musculus
ttccacgccactagtcggcagctct

SEQ ID NO: 986266 - DNA, 25 bp, Mus musculus
ttccacgccacttgtcggcagctct

SEQ ID NO: 986267 - DNA, 25 bp, Mus musculus
ttccacgcctgaatctggcaggtga

SEQ ID NO: 986268 - DNA, 25 bp, Mus musculus
ttccacgcctgattctggcaggtga

SEQ ID NO: 986269 - DNA, 25 bp, Mus musculus
ttccacggggcgcccaatgtgtgtg

SEQ ID NO: 986270 - DNA, 25 bp, Mus musculus
ttccacggggggcccaatgtgtgtg

SEQ ID NO: 986271 - DNA, 25 bp, Mus musculus
ttccacgtcacaacagcctggccct

SEQ ID NO: 986272 - DNA, 25 bp, Mus musculus
ttccacgtcacaactgcctggccct

SEQ ID NO: 986273 - DNA, 25 bp, Mus musculus
ttccacgtgcgtccttcttgccacc

SEQ ID NO: 986274 - DNA, 25 bp, Mus musculus
ttccacgtgcgtgcttcttgccacc

SEQ ID NO: 986275 - DNA, 25 bp, Mus musculus
ttccacgtgttcaacgtgtttgtgg

SEQ ID NO: 986276 - DNA, 25 bp, Mus musculus
ttccacgtgttcaaggtgtttgtgg

SEQ ID NO: 986277 - DNA, 25 bp, Mus musculus
ttccactatgcagctggacacccaa

SEQ ID NO: 986278 - DNA, 25 bp, Mus musculus
ttccactatggagctggacacccaa

SEQ ID NO: 986279 - DNA, 25 bp, Mus musculus
ttccactccttccacgatcccctgc

SEQ ID NO: 986280 - DNA, 25 bp, Mus musculus
ttccactccttccaggatcccctgc

SEQ ID NO: 986281 - DNA, 25 bp, Mus musculus
ttccactctgaactaaacatctctg

SEQ ID NO: 986282 - DNA, 25 bp, Mus musculus
ttccactctgaacttaacatctctg

SEQ ID NO: 986283 - DNA, 25 bp, Mus musculus
ttccactgcaaggcctgcaggaaag

SEQ ID NO: 986284 - DNA, 25 bp, Mus musculus
ttccactgcatggcctgcaggaaag

SEQ ID NO: 986285 - DNA, 25 bp, Mus musculus
ttccactgctctcgctcgacttcgg

SEQ ID NO: 986286 - DNA, 25 bp, Mus musculus
ttccactgctctggctcgacttcgg

SEQ ID NO: 986287 - DNA, 25 bp, Mus musculus
ttccacttccagcctcgagatgcag

SEQ ID NO: 986288 - DNA, 25 bp, Mus musculus
ttccacttccaggctcgagatgcag

SEQ ID NO: 986289 - DNA, 25 bp, Mus musculus
ttccacttgactcggacgtggaaca

SEQ ID NO: 986290 - DNA, 25 bp, Mus musculus
ttccacttgactgggacgtggaaca

SEQ ID NO: 986291 - DNA, 25 bp, Mus musculus
ttccacttgcgacacagagaagaag

SEQ ID NO: 986292 - DNA, 25 bp, Mus musculus
ttccacttgcgacagagagaagaag

SEQ ID NO: 986293 - DNA, 25 bp, Mus musculus
ttccagaaagtgatcacagaatacc

SEQ ID NO: 986294 - DNA, 25 bp, Mus musculus
ttccagaaagtgttcacagaatacc

SEQ ID NO: 986295 - DNA, 25 bp, Mus musculus
ttccagaaattccacgatgtctgtg

SEQ ID NO: 986296 - DNA, 25 bp, Mus musculus
ttccagaaattccacgattgctgtg

SEQ ID NO: 986297 - DNA, 25 bp, Mus musculus
ttccagaaattccaggatgtctgtg

SEQ ID NO: 986298 - DNA, 25 bp, Mus musculus
ttccagaaattccaggattgctgtg

SEQ ID NO: 986299 - DNA, 25 bp, Mus musculus
ttccagaagaaacattatgtgcgga

SEQ ID NO: 986300 - DNA, 25 bp, Mus musculus
ttccagaagaaagattatgtgcgga

SEQ ID NO: 986301 - DNA, 25 bp, Mus musculus
ttccagaagcagctgtccccagaac

SEQ ID NO: 986302 - DNA, 25 bp, Mus musculus
ttccagaagcaggtgtccccagaac

SEQ ID NO: 986303 - DNA, 25 bp, Mus musculus
ttccagaataaccacctgctggtgg

SEQ ID NO: 986304 - DNA, 25 bp, Mus musculus
ttccagaataaccagctgctggtgg

SEQ ID NO: 986305 - DNA, 25 bp, Mus musculus
ttccagaccaagcaccacctgttct

SEQ ID NO: 986306 - DNA, 25 bp, Mus musculus
ttccagaccaagctgcacaggaaga

SEQ ID NO: 986307 - DNA, 25 bp, Mus musculus
ttccagaccaaggaccacctgttct

SEQ ID NO: 986308 - DNA, 25 bp, Mus musculus
ttccagaccaaggtgcacaggaaga

SEQ ID NO: 986309 - DNA, 25 bp, Mus musculus
ttccagagcacccacgcttccactg

SEQ ID NO: 986310 - DNA, 25 bp, Mus musculus
ttccagagcacccaggcttccactg

SEQ ID NO: 986311 - DNA, 25 bp, Mus musculus
ttccagagcatcaccaaatagatat

SEQ ID NO: 986312 - DNA, 25 bp, Mus musculus
ttccagagcatcaccccagtagaaa

SEQ ID NO: 986313 - DNA, 25 bp, Mus musculus
ttccagagcatcacgaaatagatat

SEQ ID NO: 986314 - DNA, 25 bp, Mus musculus
ttccagagcatcacgccagtagaaa

SEQ ID NO: 986315 - DNA, 25 bp, Mus musculus
ttccagaggaagcctttcggcagca

SEQ ID NO: 986316 - DNA, 25 bp, Mus musculus
ttccagaggaaggctttcggcagca

SEQ ID NO: 986317 - DNA, 25 bp, Mus musculus
ttccagaggaagtacacaatcctcc

SEQ ID NO: 986318 - DNA, 25 bp, Mus musculus
ttccagaggaagtagacaatcctcc

SEQ ID NO: 986319 - DNA, 25 bp, Mus musculus
ttccagatacattgacatcagcaaa

SEQ ID NO: 986320 - DNA, 25 bp, Mus musculus
ttccagatacctcttccaagttgct

SEQ ID NO: 986321 - DNA, 25 bp, Mus musculus
ttccagatacgtcttccaagttgct

SEQ ID NO: 986322 - DNA, 25 bp, Mus musculus
ttccagatactttgacatcagcaaa

SEQ ID NO: 986323 - DNA, 25 bp, Mus musculus
ttccagatcaagcaggtagatatgg

SEQ ID NO: 986324 - DNA, 25 bp, Mus musculus
ttccagatcaaggaggtagatatgg

SEQ ID NO: 986325 - DNA, 25 bp, Mus musculus
ttccagatccgcaacgacttcttat

SEQ ID NO: 986326 - DNA, 25 bp, Mus musculus
ttccagatccgcaaggacttcttat

SEQ ID NO: 986327 - DNA, 25 bp, Mus musculus
ttccagatgaagaacgtgctgtgtt

SEQ ID NO: 986328 - DNA, 25 bp, Mus musculus
ttccagatgaagaaggtgctgtgtt

SEQ ID NO: 986329 - DNA, 25 bp, Mus musculus
ttccagcagatgtgcgagtgtttgg

SEQ ID NO: 986330 - DNA, 25 bp, Mus musculus
ttccagcagatgtgggagtgtttgg

SEQ ID NO: 986331 - DNA, 25 bp, Mus musculus
ttccagccagaacgatcggaatgga

SEQ ID NO: 986332 - DNA, 25 bp, Mus musculus
ttccagccagaaggatcggaatgga

SEQ ID NO: 986333 - DNA, 25 bp, Mus musculus
ttccagccagaccagcggagtcgga

SEQ ID NO: 986334 - DNA, 25 bp, Mus musculus
ttccagccagagagtttatggtctc

SEQ ID NO: 986335 - DNA, 25 bp, Mus musculus
ttccagccagagtgtttatggtctc

SEQ ID NO: 986336 - DNA, 25 bp, Mus musculus
ttccagccagtccagcggagtcgga

SEQ ID NO: 986337 - DNA, 25 bp, Mus musculus
ttccagctttgacatggctatgaac

SEQ ID NO: 986338 - DNA, 25 bp, Mus musculus
ttccagctttgagatggctatgaac

SEQ ID NO: 986339 - DNA, 25 bp, Mus musculus
ttccaggaagggacaatattgatca

SEQ ID NO: 986340 - DNA, 25 bp, Mus musculus
ttccaggaagggactatattgatca

SEQ ID NO: 986341 - DNA, 25 bp, Mus musculus
ttccaggaccaccatgtccctggta

SEQ ID NO: 986342 - DNA, 25 bp, Mus musculus
ttccaggaccacgatgtccctggta

SEQ ID NO: 986343 - DNA, 25 bp, Mus musculus
ttccaggactatagcgcagcagcag

SEQ ID NO: 986344 - DNA, 25 bp, Mus musculus
ttccaggactattgcgcagcagcag

SEQ ID NO: 986345 - DNA, 25 bp, Mus musculus
ttccaggccaaccacctcaccgtgg

SEQ ID NO: 986346 - DNA, 25 bp, Mus musculus
ttccaggccaaccagctcaccgtgg

SEQ ID NO: 986347 - DNA, 25 bp, Mus musculus
ttccaggcctcacgcatctgttgca

SEQ ID NO: 986348 - DNA, 25 bp, Mus musculus
ttccaggcctcaggcatctgttgca

SEQ ID NO: 986349 - DNA, 25 bp, Mus musculus
ttccagggagacagacacagacagc

SEQ ID NO: 986350 - DNA, 25 bp, Mus musculus
ttccagggagactgacacagacagc

SEQ ID NO: 986351 - DNA, 25 bp, Mus musculus
ttccagggagggcaagagtcataca

SEQ ID NO: 986352 - DNA, 25 bp, Mus musculus
ttccagggaggggaagagtcataca

SEQ ID NO: 986353 - DNA, 25 bp, Mus musculus
ttccagggattcatcctgtattttc

SEQ ID NO: 986354 - DNA, 25 bp, Mus musculus
ttccagggattcatgctgtattttc

SEQ ID NO: 986355 - DNA, 25 bp, Mus musculus
ttccagtaaacactgtccactgcaa

SEQ ID NO: 986356 - DNA, 25 bp, Mus musculus
ttccagtaaacagtgtccactgcaa

SEQ ID NO: 986357 - DNA, 25 bp, Mus musculus
ttccagtaccaacacaaagcctatt

SEQ ID NO: 986358 - DNA, 25 bp, Mus musculus
ttccagtaccaagacaaagcctatt

SEQ ID NO: 986359 - DNA, 25 bp, Mus musculus
ttccagtagtactacatgccaaatc

SEQ ID NO: 986360 - DNA, 25 bp, Mus musculus
ttccagtagtactagatgccaaatc

SEQ ID NO: 986361 - DNA, 25 bp, Mus musculus
ttccagtatgttgccgatgctatgg

SEQ ID NO: 986362 - DNA, 25 bp, Mus musculus
ttccagtatgttgcggatgctatgg

SEQ ID NO: 986363 - DNA, 25 bp, Mus musculus
ttccagtcagagaacaccttctgta

SEQ ID NO: 986364 - DNA, 25 bp, Mus musculus
ttccagtcagaggacatcctggagt

SEQ ID NO: 986365 - DNA, 25 bp, Mus musculus
ttccagtcagtgaacaccttctgta

SEQ ID NO: 986366 - DNA, 25 bp, Mus musculus
ttccagtcagtggacatcctggagt

SEQ ID NO: 986367 - DNA, 25 bp, Mus musculus
ttccagtctacacacacctgctatg

SEQ ID NO: 986368 - DNA, 25 bp, Mus musculus
ttccagtctacagacacctgctatg

SEQ ID NO: 986369 - DNA, 25 bp, Mus musculus
ttccagtgagcttgcttcccagagc

SEQ ID NO: 986370 - DNA, 25 bp, Mus musculus
ttccagtgaggttgcttcccagagc

SEQ ID NO: 986371 - DNA, 25 bp, Mus musculus
ttccagtgggcatggagaagagctg

SEQ ID NO: 986372 - DNA, 25 bp, Mus musculus
ttccagtggggatggagaagagctg

SEQ ID NO: 986373 - DNA, 25 bp, Mus musculus
ttccatcaacaacgactggtggaag

SEQ ID NO: 986374 - DNA, 25 bp, Mus musculus
ttccatcaacaaggactggtggaag

SEQ ID NO: 986375 - DNA, 25 bp, Mus musculus
ttccatcaccagcatccatgtctta

SEQ ID NO: 986376 - DNA, 25 bp, Mus musculus
ttccatcaccagctgcgtgatgaca

SEQ ID NO: 986377 - DNA, 25 bp, Mus musculus
ttccatcaccaggatccatgtctta

SEQ ID NO: 986378 - DNA, 25 bp, Mus musculus
ttccatcaccaggtgcgtgatgaca

SEQ ID NO: 986379 - DNA, 25 bp, Mus musculus
ttccatcacgaacaacatctggaga

SEQ ID NO: 986380 - DNA, 25 bp, Mus musculus
ttccatcacgaagaacatctggaga

SEQ ID NO: 986381 - DNA, 25 bp, Mus musculus
ttccatcccaacatctatcctgatg

SEQ ID NO: 986382 - DNA, 25 bp, Mus musculus
ttccatcccaacttctatcctgatg

SEQ ID NO: 986383 - DNA, 25 bp, Mus musculus
ttccatcttcaacgcctgggcagtt

SEQ ID NO: 986384 - DNA, 25 bp, Mus musculus
ttccatcttcaaggcctgggcagtt

SEQ ID NO: 986385 - DNA, 25 bp, Mus musculus
ttccatgactcgcataccagaggat

SEQ ID NO: 986386 - DNA, 25 bp, Mus musculus
ttccatgactggcataccagaggat

SEQ ID NO: 986387 - DNA, 25 bp, Mus musculus
ttccatgccacttcccacccagcct

SEQ ID NO: 986388 - DNA, 25 bp, Mus musculus
ttccatgccagttcccacccagcct

SEQ ID NO: 986389 - DNA, 25 bp, Mus musculus
ttccatggagcatgtgtccatggct

SEQ ID NO: 986390 - DNA, 25 bp, Mus musculus
ttccatggaggatgtgtccatggct

SEQ ID NO: 986391 - DNA, 25 bp, Mus musculus
ttccatggctcaccaagcttccctg

SEQ ID NO: 986392 - DNA, 25 bp, Mus musculus
ttccatggctcagcaagcttccctg

SEQ ID NO: 986393 - DNA, 25 bp, Mus musculus
ttccattacaagaccgaccagggca

SEQ ID NO: 986394 - DNA, 25 bp, Mus musculus
ttccattacaagtccgaccagggca

SEQ ID NO: 986395 - DNA, 25 bp, Mus musculus
ttccattcttagaaaacgcctcctt

SEQ ID NO: 986396 - DNA, 25 bp, Mus musculus
ttccattcttagaatacgcctcctt

SEQ ID NO: 986397 - DNA, 25 bp, Mus musculus
ttccatttcacacttgtggaatgtc

SEQ ID NO: 986398 - DNA, 25 bp, Mus musculus
ttccatttcacagttgtggaatgtc

SEQ ID NO: 986399 - DNA, 25 bp, Mus musculus
ttcccaaaaaagtatccatcgagat

SEQ ID NO: 986400 - DNA, 25 bp, Mus musculus
ttcccaaaaatgtatccatcgagat

SEQ ID NO: 986401 - DNA, 25 bp, Mus musculus
ttcccaaatgcatgacaagtgggaa

SEQ ID NO: 986402 - DNA, 25 bp, Mus musculus
ttcccaaatggatgacaagtgggaa

SEQ ID NO: 986403 - DNA, 25 bp, Mus musculus
ttcccaacagagcaagtgacaaatg

SEQ ID NO: 986404 - DNA, 25 bp, Mus musculus
ttcccaacagagcaatctctggcaa

SEQ ID NO: 986405 - DNA, 25 bp, Mus musculus
ttcccaacagagcatgtgacaaatg

SEQ ID NO: 986406 - DNA, 25 bp, Mus musculus
ttcccaacagagcattctctggcaa

SEQ ID NO: 986407 - DNA, 25 bp, Mus musculus
ttcccaacagcacctctttcagagg

SEQ ID NO: 986408 - DNA, 25 bp, Mus musculus
ttcccaacagcagctctttcagagg

SEQ ID NO: 986409 - DNA, 25 bp, Mus musculus
ttcccaagagctcaagtgccccacc

SEQ ID NO: 986410 - DNA, 25 bp, Mus musculus
ttcccaagagctcatgtgccccacc

SEQ ID NO: 986411 - DNA, 25 bp, Mus musculus
ttcccacagctgcgcgctcagtatg

SEQ ID NO: 986412 - DNA, 25 bp, Mus musculus
ttcccacagctgggcgctcagtatg

SEQ ID NO: 986413 - DNA, 25 bp, Mus musculus
ttcccaccattgctttcaatgtgga

SEQ ID NO: 986414 - DNA, 25 bp, Mus musculus
ttcccaccattggtttcaatgtgga

SEQ ID NO: 986415 - DNA, 25 bp, Mus musculus
ttcccagaagggctgtgctgaaatg

SEQ ID NO: 986416 - DNA, 25 bp, Mus musculus
ttcccagaaggggtgtgctgaaatg

SEQ ID NO: 986417 - DNA, 25 bp, Mus musculus
ttcccagagccacgcacaagatgtg

SEQ ID NO: 986418 - DNA, 25 bp, Mus musculus
ttcccagagccaggcacaagatgtg

SEQ ID NO: 986419 - DNA, 25 bp, Mus musculus
ttcccagcagagcaagctgacgatc

SEQ ID NO: 986420 - DNA, 25 bp, Mus musculus
ttcccagcagcgttagcataaaaga

SEQ ID NO: 986421 - DNA, 25 bp, Mus musculus
ttcccagcagggttagcataaaaga

SEQ ID NO: 986422 - DNA, 25 bp, Mus musculus
ttcccagcagtgcaagctgacgatc

SEQ ID NO: 986423 - DNA, 25 bp, Mus musculus
ttcccagcggttctcagatatgcat

SEQ ID NO: 986424 - DNA, 25 bp, Mus musculus
ttcccagcggttctgagatatgcat

SEQ ID NO: 986425 - DNA, 25 bp, Mus musculus
ttcccaggaagccaccctcaggaac

SEQ ID NO: 986426 - DNA, 25 bp, Mus musculus
ttcccaggaagccagcctcaggaac

SEQ ID NO: 986427 - DNA, 25 bp, Mus musculus
ttcccatcagcccaggccacagcag

SEQ ID NO: 986428 - DNA, 25 bp, Mus musculus
ttcccatcaggccaggccacagcag

SEQ ID NO: 986429 - DNA, 25 bp, Mus musculus
ttcccatccctacatccagtccctg

SEQ ID NO: 986430 - DNA, 25 bp, Mus musculus
ttcccatccctagatccagtccctg

SEQ ID NO: 986431 - DNA, 25 bp, Mus musculus
ttcccatcgtactccggctccttgt

SEQ ID NO: 986432 - DNA, 25 bp, Mus musculus
ttcccatcgtactcgggctccttgt

SEQ ID NO: 986433 - DNA, 25 bp, Mus musculus
ttccccaaattggaagatatccatc

SEQ ID NO: 986434 - DNA, 25 bp, Mus musculus
ttccccaaattggatgatatccatc

SEQ ID NO: 986435 - DNA, 25 bp, Mus musculus
ttccccaatgctccatttactcgac

SEQ ID NO: 986436 - DNA, 25 bp, Mus musculus
ttccccaatggtccatttactcgac

SEQ ID NO: 986437 - DNA, 25 bp, Mus musculus
ttccccagcacaccaatcttccctg

SEQ ID NO: 986438 - DNA, 25 bp, Mus musculus
ttccccagcacagcaatcttccctg

SEQ ID NO: 986439 - DNA, 25 bp, Mus musculus
ttcccccaccatgaatttgtggccc

SEQ ID NO: 986440 - DNA, 25 bp, Mus musculus
ttcccccaccatgattttgtggccc

SEQ ID NO: 986441 - DNA, 25 bp, Mus musculus
ttccccccagagctcgtggaacaca

SEQ ID NO: 986442 - DNA, 25 bp, Mus musculus
ttccccccagagctggtggaacaca

SEQ ID NO: 986443 - DNA, 25 bp, Mus musculus
ttccccctggtcagccactcggaca

SEQ ID NO: 986444 - DNA, 25 bp, Mus musculus
ttccccctggtcaggcactcggaca

SEQ ID NO: 986445 - DNA, 25 bp, Mus musculus
ttccccgggatggacatgaggtgcc

SEQ ID NO: 986446 - DNA, 25 bp, Mus musculus
ttccccgggatggagatgaggtgcc

SEQ ID NO: 986447 - DNA, 25 bp, Mus musculus
ttcccctcaagtctcagtttgtgat

SEQ ID NO: 986448 - DNA, 25 bp, Mus musculus
ttcccctcaagtctgagtttgtgat

SEQ ID NO: 986449 - DNA, 25 bp, Mus musculus
ttcccctcagctgcagcctacttag

SEQ ID NO: 986450 - DNA, 25 bp, Mus musculus
ttcccctcagctgctgcctacttag

SEQ ID NO: 986451 - DNA, 25 bp, Mus musculus
ttcccctgaagcattgaaaaaggca

SEQ ID NO: 986452 - DNA, 25 bp, Mus musculus
ttcccctgaagccaatcatctgggg

SEQ ID NO: 986453 - DNA, 25 bp, Mus musculus
ttcccctgaagcgaatcatctgggg

SEQ ID NO: 986454 - DNA, 25 bp, Mus musculus
ttcccctgaagctttgaaaaaggca

SEQ ID NO: 986455 - DNA, 25 bp, Mus musculus
ttccccttctgcagcatgtcattgc

SEQ ID NO: 986456 - DNA, 25 bp, Mus musculus
ttccccttctgcaggatgtcattgc

SEQ ID NO: 986457 - DNA, 25 bp, Mus musculus
ttcccgaaccagatatgagcggaat

SEQ ID NO: 986458 - DNA, 25 bp, Mus musculus
ttcccgaaccagttatgagcggaat

SEQ ID NO: 986459 - DNA, 25 bp, Mus musculus
ttcccgaagtatcaagtaccggagc

SEQ ID NO: 986460 - DNA, 25 bp, Mus musculus
ttcccgaagtatcatgtaccggagc

SEQ ID NO: 986461 - DNA, 25 bp, Mus musculus
ttcccgaatacccacgctccaacac

SEQ ID NO: 986462 - DNA, 25 bp, Mus musculus
ttcccgaatacccaggctccaacac

SEQ ID NO: 986463 - DNA, 25 bp, Mus musculus
ttcccgcaagagtgagtgtgtcaga

SEQ ID NO: 986464 - DNA, 25 bp, Mus musculus
ttcccgcaagtgtgagtgtgtcaga

SEQ ID NO: 986465 - DNA, 25 bp, Mus musculus
ttcccgctcctgctagagcaatgat

SEQ ID NO: 986466 - DNA, 25 bp, Mus musculus
ttcccgctcctggtagagcaatgat

SEQ ID NO: 986467 - DNA, 25 bp, Mus musculus
ttcccggaagagcctcccagatgga

SEQ ID NO: 986468 - DNA, 25 bp, Mus musculus
ttcccggaagaggctcccagatgga

SEQ ID NO: 986469 - DNA, 25 bp, Mus musculus
ttcccggaagggacaatattgacca

SEQ ID NO: 986470 - DNA, 25 bp, Mus musculus
ttcccggaagggactatattgacca

SEQ ID NO: 986471 - DNA, 25 bp, Mus musculus
ttcccggagaagagtttattgccat

SEQ ID NO: 986472 - DNA, 25 bp, Mus musculus
ttcccggagaagtgtttattgccat

SEQ ID NO: 986473 - DNA, 25 bp, Mus musculus
ttccctaaagatgacgcttccgtgt

SEQ ID NO: 986474 - DNA, 25 bp, Mus musculus
ttccctaaagatgaggcttccgtgt

SEQ ID NO: 986475 - DNA, 25 bp, Mus musculus
ttccctacttccctcctaaccagga

SEQ ID NO: 986476 - DNA, 25 bp, Mus musculus
ttccctacttccctgctaaccagga

SEQ ID NO: 986477 - DNA, 25 bp, Mus musculus
ttccctagagatggctttcctgact

SEQ ID NO: 986478 - DNA, 25 bp, Mus musculus
ttccctagagttggctttcctgact

SEQ ID NO: 986479 - DNA, 25 bp, Mus musculus
ttccctatagtgaatacttcgagta

SEQ ID NO: 986480 - DNA, 25 bp, Mus musculus
ttccctatagtgtatacttcgagta

SEQ ID NO: 986481 - DNA, 25 bp, Mus musculus
ttccctatggcaatctcgcctttcc

SEQ ID NO: 986482 - DNA, 25 bp, Mus musculus
ttccctatggcaatgtcgcctttcc

SEQ ID NO: 986483 - DNA, 25 bp, Mus musculus
ttccctattgcactggttgccctcc

SEQ ID NO: 986484 - DNA, 25 bp, Mus musculus
ttccctattggactggttgccctcc

SEQ ID NO: 986485 - DNA, 25 bp, Mus musculus
ttccctccatttcactgctaatcat

SEQ ID NO: 986486 - DNA, 25 bp, Mus musculus
ttccctccatttcacttgctaatca

SEQ ID NO: 986487 - DNA, 25 bp, Mus musculus
ttccctccatttcagtgctaatcat

SEQ ID NO: 986488 - DNA, 25 bp, Mus musculus
ttccctccatttcagttgctaatca

SEQ ID NO: 986489 - DNA, 25 bp, Mus musculus
ttccctcggtcacacgtatcatggc

SEQ ID NO: 986490 - DNA, 25 bp, Mus musculus
ttccctcggtcacaggtatcatggc

SEQ ID NO: 986491 - DNA, 25 bp, Mus musculus
ttccctctagatgtgagcggccatt

SEQ ID NO: 986492 - DNA, 25 bp, Mus musculus
ttccctctagttgtgagcggccatt

SEQ ID NO: 986493 - DNA, 25 bp, Mus musculus
ttccctctcctgaaagcgctgagaa

SEQ ID NO: 986494 - DNA, 25 bp, Mus musculus
ttccctctcctgaatgcgctgagaa

SEQ ID NO: 986495 - DNA, 25 bp, Mus musculus
ttccctgaagattgcagtgttgatg

SEQ ID NO: 986496 - DNA, 25 bp, Mus musculus
ttccctgaagtttgcagtgttgatg

SEQ ID NO: 986497 - DNA, 25 bp, Mus musculus
ttccctgaggaaccatgttcaccag

SEQ ID NO: 986498 - DNA, 25 bp, Mus musculus
ttccctgaggaagcatgttcaccag

SEQ ID NO: 986499 - DNA, 25 bp, Mus musculus
ttccctgcaagccactggaataccc

SEQ ID NO: 986500 - DNA, 25 bp, Mus musculus
ttccctgcaagccagtggaataccc

SEQ ID NO: 986501 - DNA, 25 bp, Mus musculus
ttccctgcaatacaaaggacctaag

SEQ ID NO: 986502 - DNA, 25 bp, Mus musculus
ttccctgcaatagaaaggacctaag

SEQ ID NO: 986503 - DNA, 25 bp, Mus musculus
ttccctgcagctacaaactctggta

SEQ ID NO: 986504 - DNA, 25 bp, Mus musculus
ttccctgcaggtacaaactctggta

SEQ ID NO: 986505 - DNA, 25 bp, Mus musculus
ttccctgctacaccaacttctcctg

SEQ ID NO: 986506 - DNA, 25 bp, Mus musculus
ttccctgctacagcaacttctcctg

SEQ ID NO: 986507 - DNA, 25 bp, Mus musculus
ttccctgcttcaccaagcttccctg

SEQ ID NO: 986508 - DNA, 25 bp, Mus musculus
ttccctgcttcagcaagcttccctg

SEQ ID NO: 986509 - DNA, 25 bp, Mus musculus
ttccctggacaacctgtggccagcg

SEQ ID NO: 986510 - DNA, 25 bp, Mus musculus
ttccctggacaagctgtggccagcg

SEQ ID NO: 986511 - DNA, 25 bp, Mus musculus
ttccctggacagctattacgccatc

SEQ ID NO: 986512 - DNA, 25 bp, Mus musculus
ttccctggacaggtattacgccatc

SEQ ID NO: 986513 - DNA, 25 bp, Mus musculus
ttccctggcacacaaacatcatcca

SEQ ID NO: 986514 - DNA, 25 bp, Mus musculus
ttccctggcacagaaacatcatcca

SEQ ID NO: 986515 - DNA, 25 bp, Mus musculus
ttccctggcactccaagtttcccca

SEQ ID NO: 986516 - DNA, 25 bp, Mus musculus
ttccctggcactgcaagtttcccca

SEQ ID NO: 986517 - DNA, 25 bp, Mus musculus
ttccctggctaaccaagcttccctg

SEQ ID NO: 986518 - DNA, 25 bp, Mus musculus
ttccctggctaagcaagcttccctg

SEQ ID NO: 986519 - DNA, 25 bp, Mus musculus
ttccctgggcagctttcagtcgttc

SEQ ID NO: 986520 - DNA, 25 bp, Mus musculus
ttccctgggcaggtttcagtcgttc

SEQ ID NO: 986521 - DNA, 25 bp, Mus musculus
ttccctggggccggcaagtccactt

SEQ ID NO: 986522 - DNA, 25 bp, Mus musculus
ttccctgggggcggcaagtccactt

SEQ ID NO: 986523 - DNA, 25 bp, Mus musculus
ttccctggtacaccaagcttccctg

SEQ ID NO: 986524 - DNA, 25 bp, Mus musculus
ttccctggtacaccaagctttcctg

SEQ ID NO: 986525 - DNA, 25 bp, Mus musculus
ttccctggtacaccttccctgtttc

SEQ ID NO: 986526 - DNA, 25 bp, Mus musculus
ttccctggtacagcaagcttccctg

SEQ ID NO: 986527 - DNA, 25 bp, Mus musculus
ttccctggtacagcaagctttcctg

SEQ ID NO: 986528 - DNA, 25 bp, Mus musculus
ttccctggtacagcttccctgtttc

SEQ ID NO: 986529 - DNA, 25 bp, Mus musculus
ttccctgttaagaatgtgattgatg

SEQ ID NO: 986530 - DNA, 25 bp, Mus musculus
ttccctgttaagtatgtgattgatg

SEQ ID NO: 986531 - DNA, 25 bp, Mus musculus
ttccctgtttcaccaaccttccatg

SEQ ID NO: 986532 - DNA, 25 bp, Mus musculus
ttccctgtttcaccaaccttccctg

SEQ ID NO: 986533 - DNA, 25 bp, Mus musculus
ttccctgtttcaccaagcttccctg

SEQ ID NO: 986534 - DNA, 25 bp, Mus musculus
ttccctgtttcaccaatcttccctg

SEQ ID NO: 986535 - DNA, 25 bp, Mus musculus
ttccctgtttcaccttccctgtttc

SEQ ID NO: 986536 - DNA, 25 bp, Mus musculus
ttccctgtttcagcaaccttccatg

SEQ ID NO: 986537 - DNA, 25 bp, Mus musculus
ttccctgtttcagcaaccttccctg

SEQ ID NO: 986538 - DNA, 25 bp, Mus musculus
ttccctgtttcagcaagcttccctg

SEQ ID NO: 986539 - DNA, 25 bp, Mus musculus
ttccctgtttcagcaatcttccctg

SEQ ID NO: 986540 - DNA, 25 bp, Mus musculus
ttccctgtttcagcttccctgtttc

SEQ ID NO: 986541 - DNA, 25 bp, Mus musculus
ttcccttcctcgctctcgccggtga

SEQ ID NO: 986542 - DNA, 25 bp, Mus musculus
ttcccttcctcggtctcgccggtga

SEQ ID NO: 986543 - DNA, 25 bp, Mus musculus
ttcccttgagcttctgatcttatcg

SEQ ID NO: 986544 - DNA, 25 bp, Mus musculus
ttcccttgaggttctgatcttatcg

SEQ ID NO: 986545 - DNA, 25 bp, Mus musculus
ttcccttgatggcaagtatgtctat

SEQ ID NO: 986546 - DNA, 25 bp, Mus musculus
ttcccttgatggcatgtatgtctat

SEQ ID NO: 986547 - DNA, 25 bp, Mus musculus
ttccctttgcagcggaactcattct

SEQ ID NO: 986548 - DNA, 25 bp, Mus musculus
ttccctttgcaggggaactcattct

SEQ ID NO: 986549 - DNA, 25 bp, Mus musculus
ttccctttggtgaacgccgcagtac

SEQ ID NO: 986550 - DNA, 25 bp, Mus musculus
ttccctttggtgaaggccgcagtac

SEQ ID NO: 986551 - DNA, 25 bp, Mus musculus
ttccgaaactatacatcaggcccgc

SEQ ID NO: 986552 - DNA, 25 bp, Mus musculus
ttccgaaactatacttcaggcccgc

SEQ ID NO: 986553 - DNA, 25 bp, Mus musculus
ttccgaaatgagctggaattttgga

SEQ ID NO: 986554 - DNA, 25 bp, Mus musculus
ttccgaaatgaggtggaattttgga

SEQ ID NO: 986555 - DNA, 25 bp, Mus musculus
ttccgacatgcatatagtgacctat

SEQ ID NO: 986556 - DNA, 25 bp, Mus musculus
ttccgacatggatatagtgacctat

SEQ ID NO: 986557 - DNA, 25 bp, Mus musculus
ttccgagaccagacccctgagcagc

SEQ ID NO: 986558 - DNA, 25 bp, Mus musculus
ttccgagaccagtcccctgagcagc

SEQ ID NO: 986559 - DNA, 25 bp, Mus musculus
ttccgagatattcataacaagaaat

SEQ ID NO: 986560 - DNA, 25 bp, Mus musculus
ttccgagatattgataacaagaaat

SEQ ID NO: 986561 - DNA, 25 bp, Mus musculus
ttccgagcagaaccaagccatacag

SEQ ID NO: 986562 - DNA, 25 bp, Mus musculus
ttccgagcagaagcaagccatacag

SEQ ID NO: 986563 - DNA, 25 bp, Mus musculus
ttccgagtgcagtgcccctggacca

SEQ ID NO: 986564 - DNA, 25 bp, Mus musculus
ttccgagtgcagtggccctggacca

SEQ ID NO: 986565 - DNA, 25 bp, Mus musculus
ttccgcaagggccacctggcaaaga

SEQ ID NO: 986566 - DNA, 25 bp, Mus musculus
ttccgcaagggccagctggcaaaga

SEQ ID NO: 986567 - DNA, 25 bp, Mus musculus
ttccgcacccaacccagtttggaca

SEQ ID NO: 986568 - DNA, 25 bp, Mus musculus
ttccgcacccaactttggacaagca

SEQ ID NO: 986569 - DNA, 25 bp, Mus musculus
ttccgcacccaagccagtttggaca

SEQ ID NO: 986570 - DNA, 25 bp, Mus musculus
ttccgcacccaagtttggacaagca

SEQ ID NO: 986571 - DNA, 25 bp, Mus musculus
ttccgcagagcccgtgccgacatca

SEQ ID NO: 986572 - DNA, 25 bp, Mus musculus
ttccgcagagccggtgccgacatca

SEQ ID NO: 986573 - DNA, 25 bp, Mus musculus
ttccgcatctttcactttgatgacg

SEQ ID NO: 986574 - DNA, 25 bp, Mus musculus
ttccgcatctttgactttgatgacg

SEQ ID NO: 986575 - DNA, 25 bp, Mus musculus
ttccgccttcgccacttctcaggcc

SEQ ID NO: 986576 - DNA, 25 bp, Mus musculus
ttccgccttcgccagttctcaggcc

SEQ ID NO: 986577 - DNA, 25 bp, Mus musculus
ttccgcgacgcccgtgccttcgccg

SEQ ID NO: 986578 - DNA, 25 bp, Mus musculus
ttccgcgacgccggtgccttcgccg

SEQ ID NO: 986579 - DNA, 25 bp, Mus musculus
ttccgctctcacgacggtgagactt

SEQ ID NO: 986580 - DNA, 25 bp, Mus musculus
ttccgctctcacgagggtgagactt

SEQ ID NO: 986581 - DNA, 25 bp, Mus musculus
ttccgctgacaaaattgaagatgct

SEQ ID NO: 986582 - DNA, 25 bp, Mus musculus
ttccgctgacaatattgaagatgct

SEQ ID NO: 986583 - DNA, 25 bp, Mus musculus
ttccgctgcgctgtcatggagaaac

SEQ ID NO: 986584 - DNA, 25 bp, Mus musculus
ttccgctgcggtgtcatggagaaac

SEQ ID NO: 986585 - DNA, 25 bp, Mus musculus
ttccggaacgggctatggagtcaaa

SEQ ID NO: 986586 - DNA, 25 bp, Mus musculus
ttccggaacggggtatggagtcaaa

SEQ ID NO: 986587 - DNA, 25 bp, Mus musculus
ttccggagtatgaccgaaacaactc

SEQ ID NO: 986588 - DNA, 25 bp, Mus musculus
ttccggagtatgacggaaacaactc

SEQ ID NO: 986589 - DNA, 25 bp, Mus musculus
ttccggcaagctgttggagccaaaa

SEQ ID NO: 986590 - DNA, 25 bp, Mus musculus
ttccggcaaggtgttggagccaaaa

SEQ ID NO: 986591 - DNA, 25 bp, Mus musculus
ttccggcctcgtcggtccacaaggc

SEQ ID NO: 986592 - DNA, 25 bp, Mus musculus
ttccggcctcgtgggtccacaaggc

SEQ ID NO: 986593 - DNA, 25 bp, Mus musculus
ttccggcgacatcgctaaacgcacc

SEQ ID NO: 986594 - DNA, 25 bp, Mus musculus
ttccggcgacatggctaaacgcacc

SEQ ID NO: 986595 - DNA, 25 bp, Mus musculus
ttccggcggcaaatggacattctcc

SEQ ID NO: 986596 - DNA, 25 bp, Mus musculus
ttccggcggcaattggacattctcc

SEQ ID NO: 986597 - DNA, 25 bp, Mus musculus
ttccggctggccacccccatcagtc

SEQ ID NO: 986598 - DNA, 25 bp, Mus musculus
ttccggctgggcacccccatcagtc

SEQ ID NO: 986599 - DNA, 25 bp, Mus musculus
ttccggcttggcgtcgtcactaatg

SEQ ID NO: 986600 - DNA, 25 bp, Mus musculus
ttccggcttggcgtggtcactaatg

SEQ ID NO: 986601 - DNA, 25 bp, Mus musculus
ttccggtcagagacggcccagtcaa

SEQ ID NO: 986602 - DNA, 25 bp, Mus musculus
ttccggtcagagtcggcccagtcaa

SEQ ID NO: 986603 - DNA, 25 bp, Mus musculus
ttccggtcattacgttcaaccagat

SEQ ID NO: 986604 - DNA, 25 bp, Mus musculus
ttccggtcattaggttcaaccagat

SEQ ID NO: 986605 - DNA, 25 bp, Mus musculus
ttccgtacagcatggacgtggagaa

SEQ ID NO: 986606 - DNA, 25 bp, Mus musculus
ttccgtacaggatggacgtggagaa

SEQ ID NO: 986607 - DNA, 25 bp, Mus musculus
ttccgtatctatttctgccaaatcc

SEQ ID NO: 986608 - DNA, 25 bp, Mus musculus
ttccgtatctttttctgccaaatcc

SEQ ID NO: 986609 - DNA, 25 bp, Mus musculus
ttccgtgcctatgaagatgagcagc

SEQ ID NO: 986610 - DNA, 25 bp, Mus musculus
ttccgtgcctttgaagatgagcagc

SEQ ID NO: 986611 - DNA, 25 bp, Mus musculus
ttccgtttgcaacgtgacacgcttg

SEQ ID NO: 986612 - DNA, 25 bp, Mus musculus
ttccgtttgcaaggtgacacgcttg

SEQ ID NO: 986613 - DNA, 25 bp, Mus musculus
ttcctaaggcggattctccactgcg

SEQ ID NO: 986614 - DNA, 25 bp, Mus musculus
ttcctaaggcggtttctccactgcg

SEQ ID NO: 986615 - DNA, 25 bp, Mus musculus
ttcctacaaagacgtggcagaactg

SEQ ID NO: 986616 - DNA, 25 bp, Mus musculus
ttcctacaaagaggtggcagaactg

SEQ ID NO: 986617 - DNA, 25 bp, Mus musculus
ttcctacaagatggacgtggactct

SEQ ID NO: 986618 - DNA, 25 bp, Mus musculus
ttcctacaagttggacgtggactct

SEQ ID NO: 986619 - DNA, 25 bp, Mus musculus
ttcctacagacagaacctggaggat

SEQ ID NO: 986620 - DNA, 25 bp, Mus musculus
ttcctacagagagaacctggaggat

SEQ ID NO: 986621 - DNA, 25 bp, Mus musculus
ttcctacaggacaacaatgccctgg

SEQ ID NO: 986622 - DNA, 25 bp, Mus musculus
ttcctacaggacaacctaagcattg

SEQ ID NO: 986623 - DNA, 25 bp, Mus musculus
ttcctacaggacaagaatgccctgg

SEQ ID NO: 986624 - DNA, 25 bp, Mus musculus
ttcctacaggacaagctaagcattg

SEQ ID NO: 986625 - DNA, 25 bp, Mus musculus
ttcctacattagctttgctttggtg

SEQ ID NO: 986626 - DNA, 25 bp, Mus musculus
ttcctacattaggtttgctttggtg

SEQ ID NO: 986627 - DNA, 25 bp, Mus musculus
ttcctaccagatcctgaatacctcc

SEQ ID NO: 986628 - DNA, 25 bp, Mus musculus
ttcctaccagttcctgaatacctcc

SEQ ID NO: 986629 - DNA, 25 bp, Mus musculus
ttcctactccacctcgcatgtaaag

SEQ ID NO: 986630 - DNA, 25 bp, Mus musculus
ttcctactccacctggcatgtaaag

SEQ ID NO: 986631 - DNA, 25 bp, Mus musculus
ttcctagctgtgccaccaaggagct

SEQ ID NO: 986632 - DNA, 25 bp, Mus musculus
ttcctagctgtggcaccaaggagct

SEQ ID NO: 986633 - DNA, 25 bp, Mus musculus
ttcctagtcttgctgctgggcctct

SEQ ID NO: 986634 - DNA, 25 bp, Mus musculus
ttcctagtcttggtgctgggcctct

SEQ ID NO: 986635 - DNA, 25 bp, Mus musculus
ttcctagtgtcacataagttctgga

SEQ ID NO: 986636 - DNA, 25 bp, Mus musculus
ttcctagtgtcagataagttctgga

SEQ ID NO: 986637 - DNA, 25 bp, Mus musculus
ttcctataatggccgcagagacctg

SEQ ID NO: 986638 - DNA, 25 bp, Mus musculus
ttcctataatgggcgcagagacctg

SEQ ID NO: 986639 - DNA, 25 bp, Mus musculus
ttcctatcagagagtgactcagaca

SEQ ID NO: 986640 - DNA, 25 bp, Mus musculus
ttcctatcagcgctcagttctgaca

SEQ ID NO: 986641 - DNA, 25 bp, Mus musculus
ttcctatcagcttgcgtgtgaactt

SEQ ID NO: 986642 - DNA, 25 bp, Mus musculus
ttcctatcagggctcagttctgaca

SEQ ID NO: 986643 - DNA, 25 bp, Mus musculus
ttcctatcaggttgcgtgtgaactt

SEQ ID NO: 986644 - DNA, 25 bp, Mus musculus
ttcctatcagtgagtgactcagaca

SEQ ID NO: 986645 - DNA, 25 bp, Mus musculus
ttcctatgggcataacttcggagaa

SEQ ID NO: 986646 - DNA, 25 bp, Mus musculus
ttcctatggggataacttcggagaa

SEQ ID NO: 986647 - DNA, 25 bp, Mus musculus
ttcctatggtgtcgttctctgggag

SEQ ID NO: 986648 - DNA, 25 bp, Mus musculus
ttcctatggtgtggttctctgggag

SEQ ID NO: 986649 - DNA, 25 bp, Mus musculus
ttcctcaccatcaacggtgccggac

SEQ ID NO: 986650 - DNA, 25 bp, Mus musculus
ttcctcaccatcaagggtgccggac

SEQ ID NO: 986651 - DNA, 25 bp, Mus musculus
ttcctcactgatcacgaactgaaac

SEQ ID NO: 986652 - DNA, 25 bp, Mus musculus
ttcctcactgatcaggaactgaaac

SEQ ID NO: 986653 - DNA, 25 bp, Mus musculus
ttcctcatctatgacggctacgagg

SEQ ID NO: 986654 - DNA, 25 bp, Mus musculus
ttcctcatctatgagggctacgagg

SEQ ID NO: 986655 - DNA, 25 bp, Mus musculus
ttcctccaacaaatgcagaaccccg

SEQ ID NO: 986656 - DNA, 25 bp, Mus musculus
ttcctccaacaattgcagaaccccg

SEQ ID NO: 986657 - DNA, 25 bp, Mus musculus
ttcctccaggatggattcatgggtg

SEQ ID NO: 986658 - DNA, 25 bp, Mus musculus
ttcctccagggaccctatgacacca

SEQ ID NO: 986659 - DNA, 25 bp, Mus musculus
ttcctccagggagcctatgacacca

SEQ ID NO: 986660 - DNA, 25 bp, Mus musculus
ttcctccaggttggattcatgggtg

SEQ ID NO: 986661 - DNA, 25 bp, Mus musculus
ttcctcccacaggccaggcttcgga

SEQ ID NO: 986662 - DNA, 25 bp, Mus musculus
ttcctcccactggccaggcttcgga

SEQ ID NO: 986663 - DNA, 25 bp, Mus musculus
ttcctcccgaagccgctcaaggtcc

SEQ ID NO: 986664 - DNA, 25 bp, Mus musculus
ttcctcccgaaggcgctcaaggtcc

SEQ ID NO: 986665 - DNA, 25 bp, Mus musculus
ttcctcctccaaccatcagggttgt

SEQ ID NO: 986666 - DNA, 25 bp, Mus musculus
ttcctcctccaagcatcagggttgt

SEQ ID NO: 986667 - DNA, 25 bp, Mus musculus
ttcctcgccacacgcttgatgcagg

SEQ ID NO: 986668 - DNA, 25 bp, Mus musculus
ttcctcgccacaggcttgatgcagg

SEQ ID NO: 986669 - DNA, 25 bp, Mus musculus
ttcctcgcctgtcaactcatcagca

SEQ ID NO: 986670 - DNA, 25 bp, Mus musculus
ttcctcgcctgtgaactcatcagca

SEQ ID NO: 986671 - DNA, 25 bp, Mus musculus
ttcctctaaagacccgaaagcactg

SEQ ID NO: 986672 - DNA, 25 bp, Mus musculus
ttcctctaaagaccggaaagcactg

SEQ ID NO: 986673 - DNA, 25 bp, Mus musculus
ttcctctgacagactcatctttgga

SEQ ID NO: 986674 - DNA, 25 bp, Mus musculus
ttcctctgacagtctcatctttgga

SEQ ID NO: 986675 - DNA, 25 bp, Mus musculus
ttcctctgggaaaacggtcaatgct

SEQ ID NO: 986676 - DNA, 25 bp, Mus musculus
ttcctctgggaaaagggtcaatgct

SEQ ID NO: 986677 - DNA, 25 bp, Mus musculus
ttcctctgggacatctgtaactact

SEQ ID NO: 986678 - DNA, 25 bp, Mus musculus
ttcctctgggacatgtgtaactact

SEQ ID NO: 986679 - DNA, 25 bp, Mus musculus
ttcctctgggatatcagtacccatc

SEQ ID NO: 986680 - DNA, 25 bp, Mus musculus
ttcctctgggttatcagtacccatc

SEQ ID NO: 986681 - DNA, 25 bp, Mus musculus
ttcctctgtcagatgatgatcattt

SEQ ID NO: 986682 - DNA, 25 bp, Mus musculus
ttcctctgtcagttgatgatcattt

SEQ ID NO: 986683 - DNA, 25 bp, Mus musculus
ttcctcttccaacagtcccccagaa

SEQ ID NO: 986684 - DNA, 25 bp, Mus musculus
ttcctcttccaagagtcccccagaa

SEQ ID NO: 986685 - DNA, 25 bp, Mus musculus
ttcctcttccactgcggtgtgtctg

SEQ ID NO: 986686 - DNA, 25 bp, Mus musculus
ttcctcttccactggggtgtgtctg

SEQ ID NO: 986687 - DNA, 25 bp, Mus musculus
ttcctcttcgcccccattgctcctg

SEQ ID NO: 986688 - DNA, 25 bp, Mus musculus
ttcctcttcgccgccattgctcctg

SEQ ID NO: 986689 - DNA, 25 bp, Mus musculus
ttcctgaaaatgatactgtggatgg

SEQ ID NO: 986690 - DNA, 25 bp, Mus musculus
ttcctgaaaatgttactgtggatgg

SEQ ID NO: 986691 - DNA, 25 bp, Mus musculus
ttcctgaacagtgacgtacagtgtg

SEQ ID NO: 986692 - DNA, 25 bp, Mus musculus
ttcctgaacagtgaggtacagtgtg

SEQ ID NO: 986693 - DNA, 25 bp, Mus musculus
ttcctgaaggcccacgtcctgcccc

SEQ ID NO: 986694 - DNA, 25 bp, Mus musculus
ttcctgaaggcccaggtcctgcccc

SEQ ID NO: 986695 - DNA, 25 bp, Mus musculus
ttcctgaatacacacgccccagtgc

SEQ ID NO: 986696 - DNA, 25 bp, Mus musculus
ttcctgaatacacaggccccagtgc

SEQ ID NO: 986697 - DNA, 25 bp, Mus musculus
ttcctgaatggggacgtacaggcag

SEQ ID NO: 986698 - DNA, 25 bp, Mus musculus
ttcctgaatggggaggtacaggcag

SEQ ID NO: 986699 - DNA, 25 bp, Mus musculus
ttcctgacagccgacctcttcagga

SEQ ID NO: 986700 - DNA, 25 bp, Mus musculus
ttcctgacaggcgacctcttcagga

SEQ ID NO: 986701 - DNA, 25 bp, Mus musculus
ttcctgacggaggacaaagagcgga

SEQ ID NO: 986702 - DNA, 25 bp, Mus musculus
ttcctgacggaggagaaagagcgga

SEQ ID NO: 986703 - DNA, 25 bp, Mus musculus
ttcctgactgagctgaaagtgatgc

SEQ ID NO: 986704 - DNA, 25 bp, Mus musculus
ttcctgactgaggtgaaagtgatgc

SEQ ID NO: 986705 - DNA, 25 bp, Mus musculus
ttcctgagtgagctcattgcccacc

SEQ ID NO: 986706 - DNA, 25 bp, Mus musculus
ttcctgagtgctatccttggcatgg

SEQ ID NO: 986707 - DNA, 25 bp, Mus musculus
ttcctgagtggtatccttggcatgg

SEQ ID NO: 986708 - DNA, 25 bp, Mus musculus
ttcctgagtgtgctcattgcccacc

SEQ ID NO: 986709 - DNA, 25 bp, Mus musculus
ttcctgatacccaacggcacagatg

SEQ ID NO: 986710 - DNA, 25 bp, Mus musculus
ttcctgatacccaagggcacagatg

SEQ ID NO: 986711 - DNA, 25 bp, Mus musculus
ttcctgattgatccccagaaaggga

SEQ ID NO: 986712 - DNA, 25 bp, Mus musculus
ttcctgattgttccccagaaaggga

SEQ ID NO: 986713 - DNA, 25 bp, Mus musculus
ttcctgcaagagtgtggctggctac

SEQ ID NO: 986714 - DNA, 25 bp, Mus musculus
ttcctgcaagtgtgtggctggctac

SEQ ID NO: 986715 - DNA, 25 bp, Mus musculus
ttcctgcactttcaggaggaagaga

SEQ ID NO: 986716 - DNA, 25 bp, Mus musculus
ttcctgcactttgaggaggaagaga

SEQ ID NO: 986717 - DNA, 25 bp, Mus musculus
ttcctgcattagcggaaagctgggg

SEQ ID NO: 986718 - DNA, 25 bp, Mus musculus
ttcctgcattaggggaaagctgggg

SEQ ID NO: 986719 - DNA, 25 bp, Mus musculus
ttcctgccaactcccatttctcctc

SEQ ID NO: 986720 - DNA, 25 bp, Mus musculus
ttcctgccaactccgatttctcctc

SEQ ID NO: 986721 - DNA, 25 bp, Mus musculus
ttcctgccagactgggtttgtcatg

SEQ ID NO: 986722 - DNA, 25 bp, Mus musculus
ttcctgccagtctgggtttgtcatg

SEQ ID NO: 986723 - DNA, 25 bp, Mus musculus
ttcctgcccaccgtcacatcgacga

SEQ ID NO: 986724 - DNA, 25 bp, Mus musculus
ttcctgcccaccgtgacatcgacga

SEQ ID NO: 986725 - DNA, 25 bp, Mus musculus
ttcctgccccagaaaacatcggacc

SEQ ID NO: 986726 - DNA, 25 bp, Mus musculus
ttcctgccccagtaaacatcggacc

SEQ ID NO: 986727 - DNA, 25 bp, Mus musculus
ttcctgcctgccacggcgcaggagt

SEQ ID NO: 986728 - DNA, 25 bp, Mus musculus
ttcctgcctggacgggacatgatga

SEQ ID NO: 986729 - DNA, 25 bp, Mus musculus
ttcctgcctggaggggacatgatga

SEQ ID NO: 986730 - DNA, 25 bp, Mus musculus
ttcctgcctggcacggcgcaggagt

SEQ ID NO: 986731 - DNA, 25 bp, Mus musculus
ttcctgcgcaaacggatcagtggcg

SEQ ID NO: 986732 - DNA, 25 bp, Mus musculus
ttcctgcgcaaagggatcagtggcg

SEQ ID NO: 986733 - DNA, 25 bp, Mus musculus
ttcctgcgcagtgtcgacccgttcc

SEQ ID NO: 986734 - DNA, 25 bp, Mus musculus
ttcctgcgcagtgtggacccgttcc

SEQ ID NO: 986735 - DNA, 25 bp, Mus musculus
ttcctgctaccatacgagactacac

SEQ ID NO: 986736 - DNA, 25 bp, Mus musculus
ttcctgctaccatacgctccactta

SEQ ID NO: 986737 - DNA, 25 bp, Mus musculus
ttcctgctaccataggagactacac

SEQ ID NO: 986738 - DNA, 25 bp, Mus musculus
ttcctgctaccataggctccactta

SEQ ID NO: 986739 - DNA, 25 bp, Mus musculus
ttcctgctagactgcggtgctgacc

SEQ ID NO: 986740 - DNA, 25 bp, Mus musculus
ttcctgctagactggggtgctgacc

SEQ ID NO: 986741 - DNA, 25 bp, Mus musculus
ttcctgctcaacaacgtgaatgacc

SEQ ID NO: 986742 - DNA, 25 bp, Mus musculus
ttcctgctcaacaaggtgaatgacc

SEQ ID NO: 986743 - DNA, 25 bp, Mus musculus
ttcctgctgcagaacgagtttgttg

SEQ ID NO: 986744 - DNA, 25 bp, Mus musculus
ttcctgctgcagaaggagtttgttg

SEQ ID NO: 986745 - DNA, 25 bp, Mus musculus
ttcctgctggcccgcattgaatgtc

SEQ ID NO: 986746 - DNA, 25 bp, Mus musculus
ttcctgctggccggcattgaatgtc

SEQ ID NO: 986747 - DNA, 25 bp, Mus musculus
ttcctggaaaattgttgtgtctgtg

SEQ ID NO: 986748 - DNA, 25 bp, Mus musculus
ttcctggaaatttgttgtgtctgtg

SEQ ID NO: 986749 - DNA, 25 bp, Mus musculus
ttcctggaacagctgacatgtatga

SEQ ID NO: 986750 - DNA, 25 bp, Mus musculus
ttcctggaacaggtgacatgtatga

SEQ ID NO: 986751 - DNA, 25 bp, Mus musculus
ttcctggatcaacgtgcgcaggcgc

SEQ ID NO: 986752 - DNA, 25 bp, Mus musculus
ttcctggatcaaggtgcgcaggcgc

SEQ ID NO: 986753 - DNA, 25 bp, Mus musculus
ttcctggatgagccattcgtgactg

SEQ ID NO: 986754 - DNA, 25 bp, Mus musculus
ttcctggatgaggcattcgtgactg

SEQ ID NO: 986755 - DNA, 25 bp, Mus musculus
ttcctggatgcacgcctgccaggca

SEQ ID NO: 986756 - DNA, 25 bp, Mus musculus
ttcctggatgcaggcctgccaggca

SEQ ID NO: 986757 - DNA, 25 bp, Mus musculus
ttcctggcacagaaacatcatccaa

SEQ ID NO: 986758 - DNA, 25 bp, Mus musculus
ttcctggcacagcaagcttccctgg

SEQ ID NO: 986759 - DNA, 25 bp, Mus musculus
ttcctggcacaggaagcttccctgg

SEQ ID NO: 986760 - DNA, 25 bp, Mus musculus
ttcctggcacagtaacatcatccaa

SEQ ID NO: 986761 - DNA, 25 bp, Mus musculus
ttcctggcccccaacgccatgaaga

SEQ ID NO: 986762 - DNA, 25 bp, Mus musculus
ttcctggcccccaaggccatgaaga

SEQ ID NO: 986763 - DNA, 25 bp, Mus musculus
ttcctggcttgcacaccggggccct

SEQ ID NO: 986764 - DNA, 25 bp, Mus musculus
ttcctggcttgcagtgtgcctgcag

SEQ ID NO: 986765 - DNA, 25 bp, Mus musculus
ttcctggcttgctcaccggggccct

SEQ ID NO: 986766 - DNA, 25 bp, Mus musculus
ttcctggcttgctgtgtgcctgcag

SEQ ID NO: 986767 - DNA, 25 bp, Mus musculus
ttcctgggagatcgtatgggcgtct

SEQ ID NO: 986768 - DNA, 25 bp, Mus musculus
ttcctgggagatggtatgggcgtct

SEQ ID NO: 986769 - DNA, 25 bp, Mus musculus
ttcctgggcacacaccgcgggacag

SEQ ID NO: 986770 - DNA, 25 bp, Mus musculus
ttcctgggcacagaccgcgggacag

SEQ ID NO: 986771 - DNA, 25 bp, Mus musculus
ttcctgggctgcaactgggtgctgt

SEQ ID NO: 986772 - DNA, 25 bp, Mus musculus
ttcctgggctgcaagtgggtgctgt

SEQ ID NO: 986773 - DNA, 25 bp, Mus musculus
ttcctggtacagaccatattaacca

SEQ ID NO: 986774 - DNA, 25 bp, Mus musculus
ttcctggtacagaccatattgatca

SEQ ID NO: 986775 - DNA, 25 bp, Mus musculus
ttcctggtacagacgatattaacca

SEQ ID NO: 986776 - DNA, 25 bp, Mus musculus
ttcctggtacagacgatattgatca

SEQ ID NO: 986777 - DNA, 25 bp, Mus musculus
ttcctggtataacgtcatattaagc

SEQ ID NO: 986778 - DNA, 25 bp, Mus musculus
ttcctggtataaggtcatattaagc

SEQ ID NO: 986779 - DNA, 25 bp, Mus musculus
ttcctggtgctaccacaggttagtg

SEQ ID NO: 986780 - DNA, 25 bp, Mus musculus
ttcctggtgctacctggtgaagaca

SEQ ID NO: 986781 - DNA, 25 bp, Mus musculus
ttcctggtgctacgagtggcctgca

SEQ ID NO: 986782 - DNA, 25 bp, Mus musculus
ttcctggtgctagcacaggttagtg

SEQ ID NO: 986783 - DNA, 25 bp, Mus musculus
ttcctggtgctagctggtgaagaca

SEQ ID NO: 986784 - DNA, 25 bp, Mus musculus
ttcctggtgctaggagtggcctgca

SEQ ID NO: 986785 - DNA, 25 bp, Mus musculus
ttcctgtagtgccgtgtgcaaaact

SEQ ID NO: 986786 - DNA, 25 bp, Mus musculus
ttcctgtagtgcggtgtgcaaaact

SEQ ID NO: 986787 - DNA, 25 bp, Mus musculus
ttcctgtcacctccagtgaccacct

SEQ ID NO: 986788 - DNA, 25 bp, Mus musculus
ttcctgtcacctcctgtgaccacct

SEQ ID NO: 986789 - DNA, 25 bp, Mus musculus
ttcctgtcagagctctggatgttct

SEQ ID NO: 986790 - DNA, 25 bp, Mus musculus
ttcctgtcagtgctctggatgttct

SEQ ID NO: 986791 - DNA, 25 bp, Mus musculus
ttcctgtccgaacagagactcagcc

SEQ ID NO: 986792 - DNA, 25 bp, Mus musculus
ttcctgtccgtacagagactcagcc

SEQ ID NO: 986793 - DNA, 25 bp, Mus musculus
ttcctgtctgagatccgttgggaaa

SEQ ID NO: 986794 - DNA, 25 bp, Mus musculus
ttcctgtctgagttccgttgggaaa

SEQ ID NO: 986795 - DNA, 25 bp, Mus musculus
ttcctgtggatgagtgacttctggg

SEQ ID NO: 986796 - DNA, 25 bp, Mus musculus
ttcctgtggatgtgtgacttctggg

SEQ ID NO: 986797 - DNA, 25 bp, Mus musculus
ttccttaacaaatgaggacctaaga

SEQ ID NO: 986798 - DNA, 25 bp, Mus musculus
ttccttaacaaatgtggacctaaga

SEQ ID NO: 986799 - DNA, 25 bp, Mus musculus
ttccttaacctgcgatcgcttacac

SEQ ID NO: 986800 - DNA, 25 bp, Mus musculus
ttccttaacctgggatcgcttacac

SEQ ID NO: 986801 - DNA, 25 bp, Mus musculus
ttccttaactcatgcagatgtcaac

SEQ ID NO: 986802 - DNA, 25 bp, Mus musculus
ttccttaactccaacaagtttttct

SEQ ID NO: 986803 - DNA, 25 bp, Mus musculus
ttccttaactgatgcagatgtcaac

SEQ ID NO: 986804 - DNA, 25 bp, Mus musculus
ttccttaactgcaacaagtttttct

SEQ ID NO: 986805 - DNA, 25 bp, Mus musculus
ttccttacagataccatttatgatg

SEQ ID NO: 986806 - DNA, 25 bp, Mus musculus
ttccttacagttaccatttatgatg

SEQ ID NO: 986807 - DNA, 25 bp, Mus musculus
ttccttattacacttcctggagggt

SEQ ID NO: 986808 - DNA, 25 bp, Mus musculus
ttccttattacagttcctggagggt

SEQ ID NO: 986809 - DNA, 25 bp, Mus musculus
ttccttattcagcggatgtttgtga

SEQ ID NO: 986810 - DNA, 25 bp, Mus musculus
ttccttattcaggggatgtttgtga

SEQ ID NO: 986811 - DNA, 25 bp, Mus musculus
ttccttcaacagatccagtctgaca

SEQ ID NO: 986812 - DNA, 25 bp, Mus musculus
ttccttcaacagttccagtctgaca

SEQ ID NO: 986813 - DNA, 25 bp, Mus musculus
ttccttcacctgctggaaaattctg

SEQ ID NO: 986814 - DNA, 25 bp, Mus musculus
ttccttcacctggtggaaaattctg

SEQ ID NO: 986815 - DNA, 25 bp, Mus musculus
ttccttccagcgcctggtggtagca

SEQ ID NO: 986816 - DNA, 25 bp, Mus musculus
ttccttccagggcctggtggtagca

SEQ ID NO: 986817 - DNA, 25 bp, Mus musculus
ttccttctccatcacggcatccaga

SEQ ID NO: 986818 - DNA, 25 bp, Mus musculus
ttccttctccatcagggcatccaga

SEQ ID NO: 986819 - DNA, 25 bp, Mus musculus
ttccttcttcagaaaggtgcagatc

SEQ ID NO: 986820 - DNA, 25 bp, Mus musculus
ttccttcttcagaatggtgcagatc

SEQ ID NO: 986821 - DNA, 25 bp, Mus musculus
ttccttgaagacacccacaggaaca

SEQ ID NO: 986822 - DNA, 25 bp, Mus musculus
ttccttgaagtcacccacaggaaca

SEQ ID NO: 986823 - DNA, 25 bp, Mus musculus
ttccttgcagatatactgctgttct

SEQ ID NO: 986824 - DNA, 25 bp, Mus musculus
ttccttgcagcgcctctatgaccaa

SEQ ID NO: 986825 - DNA, 25 bp, Mus musculus
ttccttgcagctccattcacacagc

SEQ ID NO: 986826 - DNA, 25 bp, Mus musculus
ttccttgcagggcctctatgaccaa

SEQ ID NO: 986827 - DNA, 25 bp, Mus musculus
ttccttgcaggtccattcacacagc

SEQ ID NO: 986828 - DNA, 25 bp, Mus musculus
ttccttgcagttatactgctgttct

SEQ ID NO: 986829 - DNA, 25 bp, Mus musculus
ttccttggagcttcattctgtggtg

SEQ ID NO: 986830 - DNA, 25 bp, Mus musculus
ttccttggaggttcattctgtggtg

SEQ ID NO: 986831 - DNA, 25 bp, Mus musculus
ttccttgtggagctcttccaagttg

SEQ ID NO: 986832 - DNA, 25 bp, Mus musculus
ttccttgtggaggtcttccaagttg

SEQ ID NO: 986833 - DNA, 25 bp, Mus musculus
ttcctttcagaagacccagcatgga

SEQ ID NO: 986834 - DNA, 25 bp, Mus musculus
ttcctttcagccctcagggctggct

SEQ ID NO: 986835 - DNA, 25 bp, Mus musculus
ttcctttcaggcctcagggctggct

SEQ ID NO: 986836 - DNA, 25 bp, Mus musculus
ttcctttcagtagacccagcatgga

SEQ ID NO: 986837 - DNA, 25 bp, Mus musculus
ttcctttccacttcagttcagggtc

SEQ ID NO: 986838 - DNA, 25 bp, Mus musculus
ttcctttccagttcagttcagggtc

SEQ ID NO: 986839 - DNA, 25 bp, Mus musculus
ttcctttcccgacaggtggatgtgt

SEQ ID NO: 986840 - DNA, 25 bp, Mus musculus
ttcctttcccgagaggtggatgtgt

SEQ ID NO: 986841 - DNA, 25 bp, Mus musculus
ttcctttgactgaggcagccacagc

SEQ ID NO: 986842 - DNA, 25 bp, Mus musculus
ttcctttgactgtggcagccacagc

SEQ ID NO: 986843 - DNA, 25 bp, Mus musculus
ttcctttgagcaggattctggaggc

SEQ ID NO: 986844 - DNA, 25 bp, Mus musculus
ttcctttgaggaggattctggaggc

SEQ ID NO: 986845 - DNA, 25 bp, Mus musculus
ttcctttgatattccagctacatat

SEQ ID NO: 986846 - DNA, 25 bp, Mus musculus
ttcctttgattttccagctacatat

SEQ ID NO: 986847 - DNA, 25 bp, Mus musculus
ttcctttggaaaagttgctgtggtt

SEQ ID NO: 986848 - DNA, 25 bp, Mus musculus
ttcctttggaaatgttgctgtggtt

SEQ ID NO: 986849 - DNA, 25 bp, Mus musculus
ttcctttggtagacactggctggag

SEQ ID NO: 986850 - DNA, 25 bp, Mus musculus
ttcctttggtagactctggctggag

SEQ ID NO: 986851 - DNA, 25 bp, Mus musculus
ttcgaaaccaagaatcttgtggaag

SEQ ID NO: 986852 - DNA, 25 bp, Mus musculus
ttcgaaaccaagtatcttgtggaag

SEQ ID NO: 986853 - DNA, 25 bp, Mus musculus
ttcgaaacgagaaacgtgagatctc

SEQ ID NO: 986854 - DNA, 25 bp, Mus musculus
ttcgaaacgagaaaggtgagatctc

SEQ ID NO: 986855 - DNA, 25 bp, Mus musculus
ttcgaaagagtgctatctctgatga

SEQ ID NO: 986856 - DNA, 25 bp, Mus musculus
ttcgaaagagtggtatctctgatga

SEQ ID NO: 986857 - DNA, 25 bp, Mus musculus
ttcgaactcttcaacaatgccatga

SEQ ID NO: 986858 - DNA, 25 bp, Mus musculus
ttcgaactcttcaagaatgccatga

SEQ ID NO: 986859 - DNA, 25 bp, Mus musculus
ttcgaagcaccaaatcaagagaaag

SEQ ID NO: 986860 - DNA, 25 bp, Mus musculus
ttcgaagcaccatatcaagagaaag

SEQ ID NO: 986861 - DNA, 25 bp, Mus musculus
ttcgaagccaagccccaggccttgt

SEQ ID NO: 986862 - DNA, 25 bp, Mus musculus
ttcgaagccaaggcccaggccttgt

SEQ ID NO: 986863 - DNA, 25 bp, Mus musculus
ttcgaagctccatccgccaggtgtc

SEQ ID NO: 986864 - DNA, 25 bp, Mus musculus
ttcgaagctcgatccgccaggtgtc

SEQ ID NO: 986865 - DNA, 25 bp, Mus musculus
ttcgaagtaagacgaccaccagaga

SEQ ID NO: 986866 - DNA, 25 bp, Mus musculus
ttcgaagtaagaggaccaccagaga

SEQ ID NO: 986867 - DNA, 25 bp, Mus musculus
ttcgaatctcagcctcaggtccctg

SEQ ID NO: 986868 - DNA, 25 bp, Mus musculus
ttcgaatctcaggctcaggtccctg

SEQ ID NO: 986869 - DNA, 25 bp, Mus musculus
ttcgaattggccggcggccagcgcg

SEQ ID NO: 986870 - DNA, 25 bp, Mus musculus
ttcgaattgggcggcggccagcgcg

SEQ ID NO: 986871 - DNA, 25 bp, Mus musculus
ttcgacatttttcgtgtgggaagcc

SEQ ID NO: 986872 - DNA, 25 bp, Mus musculus
ttcgacatttttggtgtgggaagcc

SEQ ID NO: 986873 - DNA, 25 bp, Mus musculus
ttcgaccgaatcctcagtagcaaga

SEQ ID NO: 986874 - DNA, 25 bp, Mus musculus
ttcgaccgaatcctgagtagcaaga

SEQ ID NO: 986875 - DNA, 25 bp, Mus musculus
ttcgacgaactccaggatgtgtttg

SEQ ID NO: 986876 - DNA, 25 bp, Mus musculus
ttcgacgaactcgaggatgtgtttg

SEQ ID NO: 986877 - DNA, 25 bp, Mus musculus
ttcgactctgtatgattatttctct

SEQ ID NO: 986878 - DNA, 25 bp, Mus musculus
ttcgactctgtatgtttatttctct

SEQ ID NO: 986879 - DNA, 25 bp, Mus musculus
ttcgactttacttcagtggagtcaa

SEQ ID NO: 986880 - DNA, 25 bp, Mus musculus
ttcgactttacttctgtggagtcaa

SEQ ID NO: 986881 - DNA, 25 bp, Mus musculus
ttcgagaaatgactcctctctggga

SEQ ID NO: 986882 - DNA, 25 bp, Mus musculus
ttcgagaaatgagtcctctctggga

SEQ ID NO: 986883 - DNA, 25 bp, Mus musculus
ttcgagagaaaacgaggttggaaat

SEQ ID NO: 986884 - DNA, 25 bp, Mus musculus
ttcgagagaaaaggaggttggaaat

SEQ ID NO: 986885 - DNA, 25 bp, Mus musculus
ttcgagagaaagctgtggactgtga

SEQ ID NO: 986886 - DNA, 25 bp, Mus musculus
ttcgagagaaaggtgtggactgtga

SEQ ID NO: 986887 - DNA, 25 bp, Mus musculus
ttcgagatggatccatcaggacagt

SEQ ID NO: 986888 - DNA, 25 bp, Mus musculus
ttcgagatggatccttcaggacagt

SEQ ID NO: 986889 - DNA, 25 bp, Mus musculus
ttcgagcaaatccacaaagtgcaag

SEQ ID NO: 986890 - DNA, 25 bp, Mus musculus
ttcgagcaaatccagaaagtgcaag

SEQ ID NO: 986891 - DNA, 25 bp, Mus musculus
ttcgagcacatgcccttaggcccag

SEQ ID NO: 986892 - DNA, 25 bp, Mus musculus
ttcgagcacatgcgagtgttgtgaa

SEQ ID NO: 986893 - DNA, 25 bp, Mus musculus
ttcgagcacatggccttaggcccag

SEQ ID NO: 986894 - DNA, 25 bp, Mus musculus
ttcgagcacatgggagtgttgtgaa

SEQ ID NO: 986895 - DNA, 25 bp, Mus musculus
ttcgagctagccatggtggtgagga

SEQ ID NO: 986896 - DNA, 25 bp, Mus musculus
ttcgagctaggcatggtggtgagga

SEQ ID NO: 986897 - DNA, 25 bp, Mus musculus
ttcgagcttctgcaaggttctgtcc

SEQ ID NO: 986898 - DNA, 25 bp, Mus musculus
ttcgagcttctgcatggttctgtcc

SEQ ID NO: 986899 - DNA, 25 bp, Mus musculus
ttcgaggacatgcggaatgtgttga

SEQ ID NO: 986900 - DNA, 25 bp, Mus musculus
ttcgaggacatggggaatgtgttga

SEQ ID NO: 986901 - DNA, 25 bp, Mus musculus
ttcgaggaccagatggcttcacacc

SEQ ID NO: 986902 - DNA, 25 bp, Mus musculus
ttcgaggaccagttggcttcacacc

SEQ ID NO: 986903 - DNA, 25 bp, Mus musculus
ttcgaggcaacaaaatggagagggg

SEQ ID NO: 986904 - DNA, 25 bp, Mus musculus
ttcgaggcaacaaattggagagggg

SEQ ID NO: 986905 - DNA, 25 bp, Mus musculus
ttcgaggcaataaaatggagagagg

SEQ ID NO: 986906 - DNA, 25 bp, Mus musculus
ttcgaggcaataaattggagagagg

SEQ ID NO: 986907 - DNA, 25 bp, Mus musculus
ttcgaggtcgggtgcctgtttgcag

SEQ ID NO: 986908 - DNA, 25 bp, Mus musculus
ttcgaggtcgggtggctgtttgcag

SEQ ID NO: 986909 - DNA, 25 bp, Mus musculus
ttcgagtacgcattcggtgaagaaa

SEQ ID NO: 986910 - DNA, 25 bp, Mus musculus
ttcgagtacgcattgggtgaagaaa

SEQ ID NO: 986911 - DNA, 25 bp, Mus musculus
ttcgagtcacagccctgagggccag

SEQ ID NO: 986912 - DNA, 25 bp, Mus musculus
ttcgagtcacagcgggtgacatggc

SEQ ID NO: 986913 - DNA, 25 bp, Mus musculus
ttcgagtcacaggcctgagggccag

SEQ ID NO: 986914 - DNA, 25 bp, Mus musculus
ttcgagtcacagggggtgacatggc

SEQ ID NO: 986915 - DNA, 25 bp, Mus musculus
ttcgataccgacatccatgctgtcc

SEQ ID NO: 986916 - DNA, 25 bp, Mus musculus
ttcgataccgtcatccatgctgtcc

SEQ ID NO: 986917 - DNA, 25 bp, Mus musculus
ttcgatccgcccaacagctcaaagc

SEQ ID NO: 986918 - DNA, 25 bp, Mus musculus
ttcgatccgcccaagagctcaaagc

SEQ ID NO: 986919 - DNA, 25 bp, Mus musculus
ttcgatgtgaagagttgttggatga

SEQ ID NO: 986920 - DNA, 25 bp, Mus musculus
ttcgatgtgaagtgttgttggatga

SEQ ID NO: 986921 - DNA, 25 bp, Mus musculus
ttcgattcaaccacaatgacggatt

SEQ ID NO: 986922 - DNA, 25 bp, Mus musculus
ttcgattcaaccactatgacggatt

SEQ ID NO: 986923 - DNA, 25 bp, Mus musculus
ttcgcaagaacgcgattaatctttc

SEQ ID NO: 986924 - DNA, 25 bp, Mus musculus
ttcgcaagaacgggattaatctttc

SEQ ID NO: 986925 - DNA, 25 bp, Mus musculus
ttcgcaagctggtaacagtgcacag

SEQ ID NO: 986926 - DNA, 25 bp, Mus musculus
ttcgcaagctggtatcagtgcacag

SEQ ID NO: 986927 - DNA, 25 bp, Mus musculus
ttcgcaggggacaacatcacctttg

SEQ ID NO: 986928 - DNA, 25 bp, Mus musculus
ttcgcaggggacaagatcacctttg

SEQ ID NO: 986929 - DNA, 25 bp, Mus musculus
ttcgcagttcagcttgctctcatcc

SEQ ID NO: 986930 - DNA, 25 bp, Mus musculus
ttcgcagttcaggttgctctcatcc

SEQ ID NO: 986931 - DNA, 25 bp, Mus musculus
ttcgccaagatttgcattcaagtca

SEQ ID NO: 986932 - DNA, 25 bp, Mus musculus
ttcgccaagatttggattcaagtca

SEQ ID NO: 986933 - DNA, 25 bp, Mus musculus
ttcgccaatggccaaatcaaagaaa

SEQ ID NO: 986934 - DNA, 25 bp, Mus musculus
ttcgccaatggccatatcaaagaaa

SEQ ID NO: 986935 - DNA, 25 bp, Mus musculus
ttcgccaccaagcatgctgtggctg

SEQ ID NO: 986936 - DNA, 25 bp, Mus musculus
ttcgccaccaaggatgctgtggctg

SEQ ID NO: 986937 - DNA, 25 bp, Mus musculus
ttcgccagaacactcgcaccatgag

SEQ ID NO: 986938 - DNA, 25 bp, Mus musculus
ttcgccagaacactggcaccatgag

SEQ ID NO: 986939 - DNA, 25 bp, Mus musculus
ttcgccagcaacatctccagcacct

SEQ ID NO: 986940 - DNA, 25 bp, Mus musculus
ttcgccagcaacttctccagcacct

SEQ ID NO: 986941 - DNA, 25 bp, Mus musculus
ttcgccagtgctcgaacagcaaacc

SEQ ID NO: 986942 - DNA, 25 bp, Mus musculus
ttcgccagtgctggaacagcaaacc

SEQ ID NO: 986943 - DNA, 25 bp, Mus musculus
ttcgccatagctagcattgccaaga

SEQ ID NO: 986944 - DNA, 25 bp, Mus musculus
ttcgccataggtagcattgccaaga

SEQ ID NO: 986945 - DNA, 25 bp, Mus musculus
ttcgccatccagatagtgatcgtgc

SEQ ID NO: 986946 - DNA, 25 bp, Mus musculus
ttcgccatccagttagtgatcgtgc

SEQ ID NO: 986947 - DNA, 25 bp, Mus musculus
ttcgccatctccagtcttgtccgag

SEQ ID NO: 986948 - DNA, 25 bp, Mus musculus
ttcgccatctcctgtcttgtccgag

SEQ ID NO: 986949 - DNA, 25 bp, Mus musculus
ttcgcccagaagctagccgttgccc

SEQ ID NO: 986950 - DNA, 25 bp, Mus musculus
ttcgcccagaaggtagccgttgccc

SEQ ID NO: 986951 - DNA, 25 bp, Mus musculus
ttcgccctctggatgaggaactgct

SEQ ID NO: 986952 - DNA, 25 bp, Mus musculus
ttcgccctctggttgaggaactgct

SEQ ID NO: 986953 - DNA, 25 bp, Mus musculus
ttcgccgaccagatccttcgagtca

SEQ ID NO: 986954 - DNA, 25 bp, Mus musculus
ttcgccgaccagttccttcgagtca

SEQ ID NO: 986955 - DNA, 25 bp, Mus musculus
ttcgccggcaactctgaggaacagt

SEQ ID NO: 986956 - DNA, 25 bp, Mus musculus
ttcgccggcatctctgaggaacagt

SEQ ID NO: 986957 - DNA, 25 bp, Mus musculus
ttcgcctaggcacgaaatatgttat

SEQ ID NO: 986958 - DNA, 25 bp, Mus musculus
ttcgcctaggcaggaaatatgttat

SEQ ID NO: 986959 - DNA, 25 bp, Mus musculus
ttcgcctcagagctcgagcccagtg

SEQ ID NO: 986960 - DNA, 25 bp, Mus musculus
ttcgcctcagagctggcatgcagat

SEQ ID NO: 986961 - DNA, 25 bp, Mus musculus
ttcgcctcagaggtcgagcccagtg

SEQ ID NO: 986962 - DNA, 25 bp, Mus musculus
ttcgcctcagaggtggcatgcagat

SEQ ID NO: 986963 - DNA, 25 bp, Mus musculus
ttcgcctctgacggcgcatatctgc

SEQ ID NO: 986964 - DNA, 25 bp, Mus musculus
ttcgcctctgacggggcatatctgc

SEQ ID NO: 986965 - DNA, 25 bp, Mus musculus
ttcgcctgggcatggaacaaaactg

SEQ ID NO: 986966 - DNA, 25 bp, Mus musculus
ttcgcctggggatggaacaaaactg

SEQ ID NO: 986967 - DNA, 25 bp, Mus musculus
ttcgcgagaacacttcaagggcaga

SEQ ID NO: 986968 - DNA, 25 bp, Mus musculus
ttcgcgagaacagttcaagggcaga

SEQ ID NO: 986969 - DNA, 25 bp, Mus musculus
ttcgcgcaccagcattctcgtgtgg

SEQ ID NO: 986970 - DNA, 25 bp, Mus musculus
ttcgcgcaccaggattctcgtgtgg

SEQ ID NO: 986971 - DNA, 25 bp, Mus musculus
ttcgctacacaggacatcatgccta

SEQ ID NO: 986972 - DNA, 25 bp, Mus musculus
ttcgctacacaggagatcatgccta

SEQ ID NO: 986973 - DNA, 25 bp, Mus musculus
ttcgctcgcaccatcgctgatcagc

SEQ ID NO: 986974 - DNA, 25 bp, Mus musculus
ttcgctcgcaccatggctgatcagc

SEQ ID NO: 986975 - DNA, 25 bp, Mus musculus
ttcgctgctgaaagagcccctgact

SEQ ID NO: 986976 - DNA, 25 bp, Mus musculus
ttcgctgctgaaagtgcccctgact

SEQ ID NO: 986977 - DNA, 25 bp, Mus musculus
ttcgctgctgagctcgtacaccctg

SEQ ID NO: 986978 - DNA, 25 bp, Mus musculus
ttcgctgctgaggtcgtacaccctg

SEQ ID NO: 986979 - DNA, 25 bp, Mus musculus
ttcgctgttgtgatgagcaatgtga

SEQ ID NO: 986980 - DNA, 25 bp, Mus musculus
ttcgctgttgtgttgagcaatgtga

SEQ ID NO: 986981 - DNA, 25 bp, Mus musculus
ttcggaatctaggaccccaccttgg

SEQ ID NO: 986982 - DNA, 25 bp, Mus musculus
ttcggaatctaggagcccaccttgg

SEQ ID NO: 986983 - DNA, 25 bp, Mus musculus
ttcggacacactacatgaagtatct

SEQ ID NO: 986984 - DNA, 25 bp, Mus musculus
ttcggacacagtacatgaagtatct

SEQ ID NO: 986985 - DNA, 25 bp, Mus musculus
ttcggacaggagatgattatgttgc

SEQ ID NO: 986986 - DNA, 25 bp, Mus musculus
ttcggacaggagttgattatgttgc

SEQ ID NO: 986987 - DNA, 25 bp, Mus musculus
ttcggacaggccaacgtttcatact

SEQ ID NO: 986988 - DNA, 25 bp, Mus musculus
ttcggacagggcaacgtttcatact

SEQ ID NO: 986989 - DNA, 25 bp, Mus musculus
ttcggagaagatgtggacccctggc

SEQ ID NO: 986990 - DNA, 25 bp, Mus musculus
ttcggagaagccctcctgccagaag

SEQ ID NO: 986991 - DNA, 25 bp, Mus musculus
ttcggagaaggcctcctgccagaag

SEQ ID NO: 986992 - DNA, 25 bp, Mus musculus
ttcggagaagttgtggacccctggc

SEQ ID NO: 986993 - DNA, 25 bp, Mus musculus
ttcggagttccagacgttgttcaaa

SEQ ID NO: 986994 - DNA, 25 bp, Mus musculus
ttcggagttccagaggttgttcaaa

SEQ ID NO: 986995 - DNA, 25 bp, Mus musculus
ttcggattctggcattgaagagggt

SEQ ID NO: 986996 - DNA, 25 bp, Mus musculus
ttcggattctgggattgaagagggt

SEQ ID NO: 986997 - DNA, 25 bp, Mus musculus
ttcggcactgagacatctccagctg

SEQ ID NO: 986998 - DNA, 25 bp, Mus musculus
ttcggcactgtgacatctccagctg

SEQ ID NO: 986999 - DNA, 25 bp, Mus musculus
ttcggcagcgagcattcacctccca

SEQ ID NO: 987000 - DNA, 25 bp, Mus musculus
ttcggcagcgtgcattcacctccca

SEQ ID NO: 987001 - DNA, 25 bp, Mus musculus
ttcggcagctcacgtgcctggtcat

SEQ ID NO: 987002 - DNA, 25 bp, Mus musculus
ttcggcagctcaggtgcctggtcat

SEQ ID NO: 987003 - DNA, 25 bp, Mus musculus
ttcggccaggagtcctactgtgtga

SEQ ID NO: 987004 - DNA, 25 bp, Mus musculus
ttcggccaggtgtcctactgtgtga

SEQ ID NO: 987005 - DNA, 25 bp, Mus musculus
ttcggcccagaacaatgctaaagtg

SEQ ID NO: 987006 - DNA, 25 bp, Mus musculus
ttcggcccagtacaatgctaaagtg

SEQ ID NO: 987007 - DNA, 25 bp, Mus musculus
ttcggcgccgatcacgttaaagatc

SEQ ID NO: 987008 - DNA, 25 bp, Mus musculus
ttcggcgccgatcaggttaaagatc

SEQ ID NO: 987009 - DNA, 25 bp, Mus musculus
ttcggctcagactcgcatgtgtgga

SEQ ID NO: 987010 - DNA, 25 bp, Mus musculus
ttcggctcagcgaaaattgaagctt

SEQ ID NO: 987011 - DNA, 25 bp, Mus musculus
ttcggctcagcgaagtgactttcac

SEQ ID NO: 987012 - DNA, 25 bp, Mus musculus
ttcggctcagggaaaattgaagctt

SEQ ID NO: 987013 - DNA, 25 bp, Mus musculus
ttcggctcagggaagtgactttcac

SEQ ID NO: 987014 - DNA, 25 bp, Mus musculus
ttcggctcagtctcgcatgtgtgga

SEQ ID NO: 987015 - DNA, 25 bp, Mus musculus
ttcggctgaaccacatgtcagtgcc

SEQ ID NO: 987016 - DNA, 25 bp, Mus musculus
ttcggctgaacctcatgtcagtgcc

SEQ ID NO: 987017 - DNA, 25 bp, Mus musculus
ttcgggacagataaccagcgtgctt

SEQ ID NO: 987018 - DNA, 25 bp, Mus musculus
ttcgggacagataagcagcgtgctt

SEQ ID NO: 987019 - DNA, 25 bp, Mus musculus
ttcgggacctcacctccaactcttc

SEQ ID NO: 987020 - DNA, 25 bp, Mus musculus
ttcgggacctcagctccaactcttc

SEQ ID NO: 987021 - DNA, 25 bp, Mus musculus
ttcgggagaagcaacgagagtacga

SEQ ID NO: 987022 - DNA, 25 bp, Mus musculus
ttcgggagaagcaaggagagtacga

SEQ ID NO: 987023 - DNA, 25 bp, Mus musculus
ttcgggccatctttctcttgcaacc

SEQ ID NO: 987024 - DNA, 25 bp, Mus musculus
ttcgggccatgtttctcttgcaacc

SEQ ID NO: 987025 - DNA, 25 bp, Mus musculus
ttcggggaaaagcattcggactgtc

SEQ ID NO: 987026 - DNA, 25 bp, Mus musculus
ttcggggaaaaggattcggactgtc

SEQ ID NO: 987027 - DNA, 25 bp, Mus musculus
ttcgggtgagaaggaagaggttgtt

SEQ ID NO: 987028 - DNA, 25 bp, Mus musculus
ttcgggtgagtaggaagaggttgtt

SEQ ID NO: 987029 - DNA, 25 bp, Mus musculus
ttcggtattcctcaccttatggcta

SEQ ID NO: 987030 - DNA, 25 bp, Mus musculus
ttcggtattcctcagcttatggcta

SEQ ID NO: 987031 - DNA, 25 bp, Mus musculus
ttcggtcccgaaccagctatgatga

SEQ ID NO: 987032 - DNA, 25 bp, Mus musculus
ttcggtcccgaacctatgatgacca

SEQ ID NO: 987033 - DNA, 25 bp, Mus musculus
ttcggtcccgaagcagctatgatga

SEQ ID NO: 987034 - DNA, 25 bp, Mus musculus
ttcggtcccgaagctatgatgacca

SEQ ID NO: 987035 - DNA, 25 bp, Mus musculus
ttcggtctccagattcgcctctaat

SEQ ID NO: 987036 - DNA, 25 bp, Mus musculus
ttcggtctccagtttcgcctctaat

SEQ ID NO: 987037 - DNA, 25 bp, Mus musculus
ttcggtgacatgaccaatgaggaat

SEQ ID NO: 987038 - DNA, 25 bp, Mus musculus
ttcggtgacatgtccaatgaggaat

SEQ ID NO: 987039 - DNA, 25 bp, Mus musculus
ttcggtgcagagccaccatgccaat

SEQ ID NO: 987040 - DNA, 25 bp, Mus musculus
ttcggtgcagaggcaccatgccaat

SEQ ID NO: 987041 - DNA, 25 bp, Mus musculus
ttcggtgcctaatgggaagatccat

SEQ ID NO: 987042 - DNA, 25 bp, Mus musculus
ttcggtgccttatgggaagatccat

SEQ ID NO: 987043 - DNA, 25 bp, Mus musculus
ttcggtgttgctctggtcagctacc

SEQ ID NO: 987044 - DNA, 25 bp, Mus musculus
ttcggtgttggtctggtcagctacc

SEQ ID NO: 987045 - DNA, 25 bp, Mus musculus
ttcgtactagaggctgctgtccgtg

SEQ ID NO: 987046 - DNA, 25 bp, Mus musculus
ttcgtactagctcacttcatgacat

SEQ ID NO: 987047 - DNA, 25 bp, Mus musculus
ttcgtactagctcctggacttctag

SEQ ID NO: 987048 - DNA, 25 bp, Mus musculus
ttcgtactaggtcacttcatgacat

SEQ ID NO: 987049 - DNA, 25 bp, Mus musculus
ttcgtactaggtcctggacttctag

SEQ ID NO: 987050 - DNA, 25 bp, Mus musculus
ttcgtactagtggctgctgtccgtg

SEQ ID NO: 987051 - DNA, 25 bp, Mus musculus
ttcgtactggagaacttatttccga

SEQ ID NO: 987052 - DNA, 25 bp, Mus musculus
ttcgtactggagaagttatttccga

SEQ ID NO: 987053 - DNA, 25 bp, Mus musculus
ttcgtagaagtgctgattgaaggtg

SEQ ID NO: 987054 - DNA, 25 bp, Mus musculus
ttcgtagaagtggtgattgaaggtg

SEQ ID NO: 987055 - DNA, 25 bp, Mus musculus
ttcgtatacaagatccctctaggaa

SEQ ID NO: 987056 - DNA, 25 bp, Mus musculus
ttcgtatacaagttccctctaggaa

SEQ ID NO: 987057 - DNA, 25 bp, Mus musculus
ttcgtcagaacgtggaaatgacgta

SEQ ID NO: 987058 - DNA, 25 bp, Mus musculus
ttcgtcagaaggtggaaatgacgta

SEQ ID NO: 987059 - DNA, 25 bp, Mus musculus
ttcgtcagcaggaaccgcatccagt

SEQ ID NO: 987060 - DNA, 25 bp, Mus musculus
ttcgtcagcaggaactatggaagct

SEQ ID NO: 987061 - DNA, 25 bp, Mus musculus
ttcgtcagcaggaagcgcatccagt

SEQ ID NO: 987062 - DNA, 25 bp, Mus musculus
ttcgtcagcaggaagtatggaagct

SEQ ID NO: 987063 - DNA, 25 bp, Mus musculus
ttcgtcaggaagccctctctgctcc

SEQ ID NO: 987064 - DNA, 25 bp, Mus musculus
ttcgtcaggaaggcctctctgctcc

SEQ ID NO: 987065 - DNA, 25 bp, Mus musculus
ttcgtcccctcacgatcgccacgac

SEQ ID NO: 987066 - DNA, 25 bp, Mus musculus
ttcgtcccctcaggatcgccacgac

SEQ ID NO: 987067 - DNA, 25 bp, Mus musculus
ttcgtcggagagctgctgaatgcca

SEQ ID NO: 987068 - DNA, 25 bp, Mus musculus
ttcgtcggagaggtgctgaatgcca

SEQ ID NO: 987069 - DNA, 25 bp, Mus musculus
ttcgtctcccagatcctacagaacc

SEQ ID NO: 987070 - DNA, 25 bp, Mus musculus
ttcgtctcccagatgctacagaacc

SEQ ID NO: 987071 - DNA, 25 bp, Mus musculus
ttcgtcttctggatcactggggtga

SEQ ID NO: 987072 - DNA, 25 bp, Mus musculus
ttcgtcttctggctggctggaggcg

SEQ ID NO: 987073 - DNA, 25 bp, Mus musculus
ttcgtcttctgggtggctggaggcg

SEQ ID NO: 987074 - DNA, 25 bp, Mus musculus
ttcgtcttctggttcactggggtga

SEQ ID NO: 987075 - DNA, 25 bp, Mus musculus
ttcgtctttgcgggctatactggag

SEQ ID NO: 987076 - DNA, 25 bp, Mus musculus
ttcgtctttgggggctatactggag

SEQ ID NO: 987077 - DNA, 25 bp, Mus musculus
ttcgtgaatgccaacgcttacaatg

SEQ ID NO: 987078 - DNA, 25 bp, Mus musculus
ttcgtgaatgccaaggcttacaatg

SEQ ID NO: 987079 - DNA, 25 bp, Mus musculus
ttcgtgacacctaacgtgaaggcga

SEQ ID NO: 987080 - DNA, 25 bp, Mus musculus
ttcgtgacacctaaggtgaaggcga

SEQ ID NO: 987081 - DNA, 25 bp, Mus musculus
ttcgtgagcgccaattcaaatgagt

SEQ ID NO: 987082 - DNA, 25 bp, Mus musculus
ttcgtgagcgctctctgctctctgc

SEQ ID NO: 987083 - DNA, 25 bp, Mus musculus
ttcgtgagcggcaattcaaatgagt

SEQ ID NO: 987084 - DNA, 25 bp, Mus musculus
ttcgtgagcggtctctgctctctgc

SEQ ID NO: 987085 - DNA, 25 bp, Mus musculus
ttcgtgcaccctaacgtacctgaac

SEQ ID NO: 987086 - DNA, 25 bp, Mus musculus
ttcgtgcaccgtaacgtacctgaac

SEQ ID NO: 987087 - DNA, 25 bp, Mus musculus
ttcgtggaagccaagaagaaatacc

SEQ ID NO: 987088 - DNA, 25 bp, Mus musculus
ttcgtggaagcggaagacagcgcca

SEQ ID NO: 987089 - DNA, 25 bp, Mus musculus
ttcgtggaaggcaagaagaaatacc

SEQ ID NO: 987090 - DNA, 25 bp, Mus musculus
ttcgtggaaggggaagacagcgcca

SEQ ID NO: 987091 - DNA, 25 bp, Mus musculus
ttcgtggcagcacatacgtgtgagg

SEQ ID NO: 987092 - DNA, 25 bp, Mus musculus
ttcgtggcagcagatacgtgtgagg

SEQ ID NO: 987093 - DNA, 25 bp, Mus musculus
ttcgtgggagatgcagcagggcgcc

SEQ ID NO: 987094 - DNA, 25 bp, Mus musculus
ttcgtgggagcaccttccttcggag

SEQ ID NO: 987095 - DNA, 25 bp, Mus musculus
ttcgtgggagcagcttccttcggag

SEQ ID NO: 987096 - DNA, 25 bp, Mus musculus
ttcgtgggagttgcagcagggcgcc

SEQ ID NO: 987097 - DNA, 25 bp, Mus musculus
ttcgtgtctttgcgcgcgtgctggt

SEQ ID NO: 987098 - DNA, 25 bp, Mus musculus
ttcgtgtctttgcgcgtgcctggct

SEQ ID NO: 987099 - DNA, 25 bp, Mus musculus
ttcgtgtctttgcgggcgtgctggt

SEQ ID NO: 987100 - DNA, 25 bp, Mus musculus
ttcgtgtctttgcgggtgcctggct

SEQ ID NO: 987101 - DNA, 25 bp, Mus musculus
ttcgtgtgtctccgtaacatttgcc

SEQ ID NO: 987102 - DNA, 25 bp, Mus musculus
ttcgtgtgtctcggtaacatttgcc

SEQ ID NO: 987103 - DNA, 25 bp, Mus musculus
ttcgtgtttcaaaacctctcttctc

SEQ ID NO: 987104 - DNA, 25 bp, Mus musculus
ttcgtgtttcaaaacgcattgcgct

SEQ ID NO: 987105 - DNA, 25 bp, Mus musculus
ttcgtgtttcaaaagctctcttctc

SEQ ID NO: 987106 - DNA, 25 bp, Mus musculus
ttcgtgtttcaaaaggcattgcgct

SEQ ID NO: 987107 - DNA, 25 bp, Mus musculus
ttcgttcaagcggcagaatcctttc

SEQ ID NO: 987108 - DNA, 25 bp, Mus musculus
ttcgttcaaggggcagaatcctttc

SEQ ID NO: 987109 - DNA, 25 bp, Mus musculus
ttcgttgccaagctcatgcaggttt

SEQ ID NO: 987110 - DNA, 25 bp, Mus musculus
ttcgttgccaaggtcatgcaggttt

SEQ ID NO: 987111 - DNA, 25 bp, Mus musculus
ttcgtttccaccctggaatgcaaag

SEQ ID NO: 987112 - DNA, 25 bp, Mus musculus
ttcgtttccaccgtggaatgcaaag

SEQ ID NO: 987113 - DNA, 25 bp, Mus musculus
ttcgtttgtcagattttccactcac

SEQ ID NO: 987114 - DNA, 25 bp, Mus musculus
ttcgtttgtcagtttttccactcac

SEQ ID NO: 987115 - DNA, 25 bp, Mus musculus
ttcgtttgtgagttagatgcagcct

SEQ ID NO: 987116 - DNA, 25 bp, Mus musculus
ttcgtttgtgagttagtctttggag

SEQ ID NO: 987117 - DNA, 25 bp, Mus musculus
ttcgtttgtgagtttgatgcagcct

SEQ ID NO: 987118 - DNA, 25 bp, Mus musculus
ttcgtttgtgagtttgtctttggag

SEQ ID NO: 987119 - DNA, 25 bp, Mus musculus
ttcgttttcacacgggccgatcaac

SEQ ID NO: 987120 - DNA, 25 bp, Mus musculus
ttcgttttcacaggggccgatcaac

SEQ ID NO: 987121 - DNA, 25 bp, Mus musculus
ttctaaagaggctgcgttcctcatg

SEQ ID NO: 987122 - DNA, 25 bp, Mus musculus
ttctaaagaggctgggttcctcatg

SEQ ID NO: 987123 - DNA, 25 bp, Mus musculus
ttctaaagtgaacacgccatggcgc

SEQ ID NO: 987124 - DNA, 25 bp, Mus musculus
ttctaaagtgaacacgtgccttctt

SEQ ID NO: 987125 - DNA, 25 bp, Mus musculus
ttctaaagtgaacaggccatggcgc

SEQ ID NO: 987126 - DNA, 25 bp, Mus musculus
ttctaaagtgaacaggtgccttctt

SEQ ID NO: 987127 - DNA, 25 bp, Mus musculus
ttctaaccagagccaccaggatcat

SEQ ID NO: 987128 - DNA, 25 bp, Mus musculus
ttctaaccagaggcaccaggatcat

SEQ ID NO: 987129 - DNA, 25 bp, Mus musculus
ttctaacctggacaatgccctggac

SEQ ID NO: 987130 - DNA, 25 bp, Mus musculus
ttctaacctggagaatgccctggac

SEQ ID NO: 987131 - DNA, 25 bp, Mus musculus
ttctaagacacgaagtcttagaagt

SEQ ID NO: 987132 - DNA, 25 bp, Mus musculus
ttctaagacaggaagtcttagaagt

SEQ ID NO: 987133 - DNA, 25 bp, Mus musculus
ttctaagcagatgctaccaagtact

SEQ ID NO: 987134 - DNA, 25 bp, Mus musculus
ttctaagcagcaagatgctaccaag

SEQ ID NO: 987135 - DNA, 25 bp, Mus musculus
ttctaagcaggaagatgctaccaag

SEQ ID NO: 987136 - DNA, 25 bp, Mus musculus
ttctaagcagttgctaccaagtact

SEQ ID NO: 987137 - DNA, 25 bp, Mus musculus
ttctaagtcgcacgtagaatggatg

SEQ ID NO: 987138 - DNA, 25 bp, Mus musculus
ttctaagtcgcaggtagaatggatg

SEQ ID NO: 987139 - DNA, 25 bp, Mus musculus
ttctaatagacaccccaggaaacaa

SEQ ID NO: 987140 - DNA, 25 bp, Mus musculus
ttctaatagacagcccaggaaacaa

SEQ ID NO: 987141 - DNA, 25 bp, Mus musculus
ttctacaaaatacagatctaatccc

SEQ ID NO: 987142 - DNA, 25 bp, Mus musculus
ttctacaaaatagagatctaatccc

SEQ ID NO: 987143 - DNA, 25 bp, Mus musculus
ttctacaacaagaacgtagaggcag

SEQ ID NO: 987144 - DNA, 25 bp, Mus musculus
ttctacaacaagaaggtagaggcag

SEQ ID NO: 987145 - DNA, 25 bp, Mus musculus
ttctacaagcaacacccaagagtta

SEQ ID NO: 987146 - DNA, 25 bp, Mus musculus
ttctacaagcaacgagttacaccct

SEQ ID NO: 987147 - DNA, 25 bp, Mus musculus
ttctacaagcaagacccaagagtta

SEQ ID NO: 987148 - DNA, 25 bp, Mus musculus
ttctacaagcaaggagttacaccct

SEQ ID NO: 987149 - DNA, 25 bp, Mus musculus
ttctacaagccacgagccatgcgag

SEQ ID NO: 987150 - DNA, 25 bp, Mus musculus
ttctacaagccaggagccatgcgag

SEQ ID NO: 987151 - DNA, 25 bp, Mus musculus
ttctacagaaaaatcattgccttgg

SEQ ID NO: 987152 - DNA, 25 bp, Mus musculus
ttctacagaagaccattgactacat

SEQ ID NO: 987153 - DNA, 25 bp, Mus musculus
ttctacagaagagcattgactacat

SEQ ID NO: 987154 - DNA, 25 bp, Mus musculus
ttctacagaataatcattgccttgg

SEQ ID NO: 987155 - DNA, 25 bp, Mus musculus
ttctacagacaacgtgaccttgaac

SEQ ID NO: 987156 - DNA, 25 bp, Mus musculus
ttctacagacaaggtgaccttgaac

SEQ ID NO: 987157 - DNA, 25 bp, Mus musculus
ttctacatcctgctgtttgtggtag

SEQ ID NO: 987158 - DNA, 25 bp, Mus musculus
ttctacatcctggtgtttgtggtag

SEQ ID NO: 987159 - DNA, 25 bp, Mus musculus
ttctaccagctgagtcatttcctac

SEQ ID NO: 987160 - DNA, 25 bp, Mus musculus
ttctaccagctgtgtcatttcctac

SEQ ID NO: 987161 - DNA, 25 bp, Mus musculus
ttctacccgacacacatacttcctg

SEQ ID NO: 987162 - DNA, 25 bp, Mus musculus
ttctacccgacacggtgtgaacaaa

SEQ ID NO: 987163 - DNA, 25 bp, Mus musculus
ttctacccgacagacatacttcctg

SEQ ID NO: 987164 - DNA, 25 bp, Mus musculus
ttctacccgacagggtgtgaacaaa

SEQ ID NO: 987165 - DNA, 25 bp, Mus musculus
ttctaccgcaacctggtctccattg

SEQ ID NO: 987166 - DNA, 25 bp, Mus musculus
ttctaccgcaacgtggtctccattg

SEQ ID NO: 987167 - DNA, 25 bp, Mus musculus
ttctaccgcactggctgggcactga

SEQ ID NO: 987168 - DNA, 25 bp, Mus musculus
ttctaccgcagtggctgggcactga

SEQ ID NO: 987169 - DNA, 25 bp, Mus musculus
ttctacctacaagacaactctgaag

SEQ ID NO: 987170 - DNA, 25 bp, Mus musculus
ttctacctacaagacgagagtcaaa

SEQ ID NO: 987171 - DNA, 25 bp, Mus musculus
ttctacctacaagagaactctgaag

SEQ ID NO: 987172 - DNA, 25 bp, Mus musculus
ttctacctacaagaggagagtcaaa

SEQ ID NO: 987173 - DNA, 25 bp, Mus musculus
ttctacctcaaccaccataacttga

SEQ ID NO: 987174 - DNA, 25 bp, Mus musculus
ttctacctcaaccagcataacttga

SEQ ID NO: 987175 - DNA, 25 bp, Mus musculus
ttctacctgaagcatctgaaaacat

SEQ ID NO: 987176 - DNA, 25 bp, Mus musculus
ttctacctgaaggatctgaaaacat

SEQ ID NO: 987177 - DNA, 25 bp, Mus musculus
ttctacctggaacgtggcttcagta

SEQ ID NO: 987178 - DNA, 25 bp, Mus musculus
ttctacctggaaggtggcttcagta

SEQ ID NO: 987179 - DNA, 25 bp, Mus musculus
ttctacgtggccatctacattctca

SEQ ID NO: 987180 - DNA, 25 bp, Mus musculus
ttctacgtgggcatctacattctca

SEQ ID NO: 987181 - DNA, 25 bp, Mus musculus
ttctactacgatgatactaccctcc

SEQ ID NO: 987182 - DNA, 25 bp, Mus musculus
ttctactacgttgatactaccctcc

SEQ ID NO: 987183 - DNA, 25 bp, Mus musculus
ttctactatgattggtacagcctcc

SEQ ID NO: 987184 - DNA, 25 bp, Mus musculus
ttctactatgtttggtacagcctcc

SEQ ID NO: 987185 - DNA, 25 bp, Mus musculus
ttctacttcctcgacgcctacaatt

SEQ ID NO: 987186 - DNA, 25 bp, Mus musculus
ttctacttcctcgaggcctacaatt

SEQ ID NO: 987187 - DNA, 25 bp, Mus musculus
ttctagaactagcagccagtgttga

SEQ ID NO: 987188 - DNA, 25 bp, Mus musculus
ttctagaactaggagccagtgttga

SEQ ID NO: 987189 - DNA, 25 bp, Mus musculus
ttctagaagtggtacaaatggacct

SEQ ID NO: 987190 - DNA, 25 bp, Mus musculus
ttctagaagtggtagaaatggacct

SEQ ID NO: 987191 - DNA, 25 bp, Mus musculus
ttctagacccagcagttttgctctg

SEQ ID NO: 987192 - DNA, 25 bp, Mus musculus
ttctagacccaggagttttgctctg

SEQ ID NO: 987193 - DNA, 25 bp, Mus musculus
ttctagctctggaacaggtgctgct

SEQ ID NO: 987194 - DNA, 25 bp, Mus musculus
ttctagctctggaagaggtgctgct

SEQ ID NO: 987195 - DNA, 25 bp, Mus musculus
ttctagtcacagcgaaccacacaga

SEQ ID NO: 987196 - DNA, 25 bp, Mus musculus
ttctagtcacagggaaccacacaga

SEQ ID NO: 987197 - DNA, 25 bp, Mus musculus
ttctagttgttggacgaactgctga

SEQ ID NO: 987198 - DNA, 25 bp, Mus musculus
ttctagttgttggaggaactgctga

SEQ ID NO: 987199 - DNA, 25 bp, Mus musculus
ttctataaaagaccatgggtacaca

SEQ ID NO: 987200 - DNA, 25 bp, Mus musculus
ttctataaaagacgtatatattatg

SEQ ID NO: 987201 - DNA, 25 bp, Mus musculus
ttctataaaagagcatgggtacaca

SEQ ID NO: 987202 - DNA, 25 bp, Mus musculus
ttctataaaagaggtatatattatg

SEQ ID NO: 987203 - DNA, 25 bp, Mus musculus
ttctatacacagctgattttcgata

SEQ ID NO: 987204 - DNA, 25 bp, Mus musculus
ttctatacacaggtgattttcgata

SEQ ID NO: 987205 - DNA, 25 bp, Mus musculus
ttctatagttcacgcatctactatg

SEQ ID NO: 987206 - DNA, 25 bp, Mus musculus
ttctatagttcaggcatctactatg

SEQ ID NO: 987207 - DNA, 25 bp, Mus musculus
ttctatatgcggcaaacagggccta

SEQ ID NO: 987208 - DNA, 25 bp, Mus musculus
ttctatatgcgggaaacagggccta

SEQ ID NO: 987209 - DNA, 25 bp, Mus musculus
ttctatattcagacataccggaaaa

SEQ ID NO: 987210 - DNA, 25 bp, Mus musculus
ttctatattcagtcataccggaaaa

SEQ ID NO: 987211 - DNA, 25 bp, Mus musculus
ttctatcacaagaattttaattacc

SEQ ID NO: 987212 - DNA, 25 bp, Mus musculus
ttctatcacaagtattttaattacc

SEQ ID NO: 987213 - DNA, 25 bp, Mus musculus
ttctatcagcagaggcagctgaaat

SEQ ID NO: 987214 - DNA, 25 bp, Mus musculus
ttctatcagcagtggcagctgaaat

SEQ ID NO: 987215 - DNA, 25 bp, Mus musculus
ttctatcatacccggacagaagagg

SEQ ID NO: 987216 - DNA, 25 bp, Mus musculus
ttctatcataccgggacagaagagg

SEQ ID NO: 987217 - DNA, 25 bp, Mus musculus
ttctatctgccacgatttgtgaagt

SEQ ID NO: 987218 - DNA, 25 bp, Mus musculus
ttctatctgccaggatttgtgaagt

SEQ ID NO: 987219 - DNA, 25 bp, Mus musculus
ttctatgaagctattctacttcctg

SEQ ID NO: 987220 - DNA, 25 bp, Mus musculus
ttctatgaaggtattctacttcctg

SEQ ID NO: 987221 - DNA, 25 bp, Mus musculus
ttctatgaggcgcaaggccgtctgg

SEQ ID NO: 987222 - DNA, 25 bp, Mus musculus
ttctatgaggggcaaggccgtctgg

SEQ ID NO: 987223 - DNA, 25 bp, Mus musculus
ttctatgagtcgctttatggccagt

SEQ ID NO: 987224 - DNA, 25 bp, Mus musculus
ttctatgagtcggtttatggccagt

SEQ ID NO: 987225 - DNA, 25 bp, Mus musculus
ttctatgctaataacatgtacctga

SEQ ID NO: 987226 - DNA, 25 bp, Mus musculus
ttctatgctaattacatgtacctga

SEQ ID NO: 987227 - DNA, 25 bp, Mus musculus
ttctatggagagaaacaacccgagg

SEQ ID NO: 987228 - DNA, 25 bp, Mus musculus
ttctatggagtgaaacaacccgagg

SEQ ID NO: 987229 - DNA, 25 bp, Mus musculus
ttctatgtcatgctggggttttttg

SEQ ID NO: 987230 - DNA, 25 bp, Mus musculus
ttctatgtcatggtggggttttttg

SEQ ID NO: 987231 - DNA, 25 bp, Mus musculus
ttctatgtgcagcctgatagccctg

SEQ ID NO: 987232 - DNA, 25 bp, Mus musculus
ttctatgtgcaggctgatagccctg

SEQ ID NO: 987233 - DNA, 25 bp, Mus musculus
ttctattcccagatctgtggggaaa

SEQ ID NO: 987234 - DNA, 25 bp, Mus musculus
ttctattcccagttctgtggggaaa

SEQ ID NO: 987235 - DNA, 25 bp, Mus musculus
ttctattctaagcacatgctaccaa

SEQ ID NO: 987236 - DNA, 25 bp, Mus musculus
ttctattctaagcacgaagatgcta

SEQ ID NO: 987237 - DNA, 25 bp, Mus musculus
ttctattctaagcagatgctaccaa

SEQ ID NO: 987238 - DNA, 25 bp, Mus musculus
ttctattctaagcaggaagatgcta

SEQ ID NO: 987239 - DNA, 25 bp, Mus musculus
ttctattctggtcaaagaacggtga

SEQ ID NO: 987240 - DNA, 25 bp, Mus musculus
ttctattctggtgaaagaacggtga

SEQ ID NO: 987241 - DNA, 25 bp, Mus musculus
ttctattggcacaacgtgcaaatat

SEQ ID NO: 987242 - DNA, 25 bp, Mus musculus
ttctattggcacaaggtgcaaatat

SEQ ID NO: 987243 - DNA, 25 bp, Mus musculus
ttctattgtactcaactttgccctc

SEQ ID NO: 987244 - DNA, 25 bp, Mus musculus
ttctattgtagtcaactttgccctc

SEQ ID NO: 987245 - DNA, 25 bp, Mus musculus
ttctcaaaattacgtgtgaacattt

SEQ ID NO: 987246 - DNA, 25 bp, Mus musculus
ttctcaaaattaggtgtgaacattt

SEQ ID NO: 987247 - DNA, 25 bp, Mus musculus
ttctcaacaacacctattccaaaga

SEQ ID NO: 987248 - DNA, 25 bp, Mus musculus
ttctcaacaacagctattccaaaga

SEQ ID NO: 987249 - DNA, 25 bp, Mus musculus
ttctcaacagcgaaacggatatgtg

SEQ ID NO: 987250 - DNA, 25 bp, Mus musculus
ttctcaacagggaaacggatatgtg

SEQ ID NO: 987251 - DNA, 25 bp, Mus musculus
ttctcaagagagtgaatgacattgt

SEQ ID NO: 987252 - DNA, 25 bp, Mus musculus
ttctcaagagtgtgaatgacattgt

SEQ ID NO: 987253 - DNA, 25 bp, Mus musculus
ttctcaatggaaatatggaaacctc

SEQ ID NO: 987254 - DNA, 25 bp, Mus musculus
ttctcaatggcaaaaagagcttgtc

SEQ ID NO: 987255 - DNA, 25 bp, Mus musculus
ttctcaatgggaaaaagagcttgtc

SEQ ID NO: 987256 - DNA, 25 bp, Mus musculus
ttctcaatggtaatatggaaacctc

SEQ ID NO: 987257 - DNA, 25 bp, Mus musculus
ttctcacaagatagtactggagtgg

SEQ ID NO: 987258 - DNA, 25 bp, Mus musculus
ttctcacaagttagtactggagtgg

SEQ ID NO: 987259 - DNA, 25 bp, Mus musculus
ttctcacaggacatgaaggcaccac

SEQ ID NO: 987260 - DNA, 25 bp, Mus musculus
ttctcacaggtcatgaaggcaccac

SEQ ID NO: 987261 - DNA, 25 bp, Mus musculus
ttctcacctttgctattgtcctgct

SEQ ID NO: 987262 - DNA, 25 bp, Mus musculus
ttctcacctttggtattgtcctgct

SEQ ID NO: 987263 - DNA, 25 bp, Mus musculus
ttctcactgaactgaagaatccctc

SEQ ID NO: 987264 - DNA, 25 bp, Mus musculus
ttctcactgaactgtagaatccctc

SEQ ID NO: 987265 - DNA, 25 bp, Mus musculus
ttctcacttcgtcacatcaccgcaa

SEQ ID NO: 987266 - DNA, 25 bp, Mus musculus
ttctcacttcgtgacatcaccgcaa

SEQ ID NO: 987267 - DNA, 25 bp, Mus musculus
ttctcagaagagtattcacagagac

SEQ ID NO: 987268 - DNA, 25 bp, Mus musculus
ttctcagaagtgtattcacagagac

SEQ ID NO: 987269 - DNA, 25 bp, Mus musculus
ttctcagagacaaatttggggatgc

SEQ ID NO: 987270 - DNA, 25 bp, Mus musculus
ttctcagagacatatttggggatgc

SEQ ID NO: 987271 - DNA, 25 bp, Mus musculus
ttctcagcagcatgcccaggaattc

SEQ ID NO: 987272 - DNA, 25 bp, Mus musculus
ttctcagcagcccgcagatcatgcc

SEQ ID NO: 987273 - DNA, 25 bp, Mus musculus
ttctcagcaggatgcccaggaattc

SEQ ID NO: 987274 - DNA, 25 bp, Mus musculus
ttctcagcaggccgcagatcatgcc

SEQ ID NO: 987275 - DNA, 25 bp, Mus musculus
ttctcagccaagaacaataccattg

SEQ ID NO: 987276 - DNA, 25 bp, Mus musculus
ttctcagccaagaagaataccattg

SEQ ID NO: 987277 - DNA, 25 bp, Mus musculus
ttctcagcgcagcttgtgacaatgt

SEQ ID NO: 987278 - DNA, 25 bp, Mus musculus
ttctcagcgcaggttgtgacaatgt

SEQ ID NO: 987279 - DNA, 25 bp, Mus musculus
ttctcagcgctcaccttcttgagag

SEQ ID NO: 987280 - DNA, 25 bp, Mus musculus
ttctcagcgctcacgttcttgagag

SEQ ID NO: 987281 - DNA, 25 bp, Mus musculus
ttctcagtgcagcttgtgacaatgt

SEQ ID NO: 987282 - DNA, 25 bp, Mus musculus
ttctcagtgcaggttgtgacaatgt

SEQ ID NO: 987283 - DNA, 25 bp, Mus musculus
ttctcagtggcacaatgccagctga

SEQ ID NO: 987284 - DNA, 25 bp, Mus musculus
ttctcagtggcagaatgccagctga

SEQ ID NO: 987285 - DNA, 25 bp, Mus musculus
ttctcatatctgcgaactctcagac

SEQ ID NO: 987286 - DNA, 25 bp, Mus musculus
ttctcatatctgggaactctcagac

SEQ ID NO: 987287 - DNA, 25 bp, Mus musculus
ttctcatcacggcccgcctaaggaa

SEQ ID NO: 987288 - DNA, 25 bp, Mus musculus
ttctcatcacgggccgcctaaggaa

SEQ ID NO: 987289 - DNA, 25 bp, Mus musculus
ttctcatcccagcagaaaagcccgt

SEQ ID NO: 987290 - DNA, 25 bp, Mus musculus
ttctcatcccaggagaaaagcccgt

SEQ ID NO: 987291 - DNA, 25 bp, Mus musculus
ttctcatcctcacatatcagcctga

SEQ ID NO: 987292 - DNA, 25 bp, Mus musculus
ttctcatcctcagatatcagcctga

SEQ ID NO: 987293 - DNA, 25 bp, Mus musculus
ttctcatcgaagcctttctgggtgc

SEQ ID NO: 987294 - DNA, 25 bp, Mus musculus
ttctcatcgaaggctttctgggtgc

SEQ ID NO: 987295 - DNA, 25 bp, Mus musculus
ttctcatcttgacaacccagcagtg

SEQ ID NO: 987296 - DNA, 25 bp, Mus musculus
ttctcatcttgagaacccagcagtg

SEQ ID NO: 987297 - DNA, 25 bp, Mus musculus
ttctcatgagcaacctggctttagg

SEQ ID NO: 987298 - DNA, 25 bp, Mus musculus
ttctcatgaggaacctggctttagg

SEQ ID NO: 987299 - DNA, 25 bp, Mus musculus
ttctcattaacctgtttgacacccg

SEQ ID NO: 987300 - DNA, 25 bp, Mus musculus
ttctcattaagctgtttgacacccg

SEQ ID NO: 987301 - DNA, 25 bp, Mus musculus
ttctccaaaaacaccgcatcttgag

SEQ ID NO: 987302 - DNA, 25 bp, Mus musculus
ttctccaaaaacacggcatcttgag

SEQ ID NO: 987303 - DNA, 25 bp, Mus musculus
ttctccaaagagaacgaaaagtgat

SEQ ID NO: 987304 - DNA, 25 bp, Mus musculus
ttctccaaagagaaggaaaagtgat

SEQ ID NO: 987305 - DNA, 25 bp, Mus musculus
ttctccaaattaagtgccaccaaaa

SEQ ID NO: 987306 - DNA, 25 bp, Mus musculus
ttctccaaattatgtgccaccaaaa

SEQ ID NO: 987307 - DNA, 25 bp, Mus musculus
ttctccaagtatcaaggaggagtag

SEQ ID NO: 987308 - DNA, 25 bp, Mus musculus
ttctccaagtatgaaggaggagtag

SEQ ID NO: 987309 - DNA, 25 bp, Mus musculus
ttctccacagtcactggagagtcag

SEQ ID NO: 987310 - DNA, 25 bp, Mus musculus
ttctccacagtccctggagagtcag

SEQ ID NO: 987311 - DNA, 25 bp, Mus musculus
ttctccacagtcgctggagagtcag

SEQ ID NO: 987312 - DNA, 25 bp, Mus musculus
ttctccacagtctctggagagtcag

SEQ ID NO: 987313 - DNA, 25 bp, Mus musculus
ttctccaccactcctgagtccccgt

SEQ ID NO: 987314 - DNA, 25 bp, Mus musculus
ttctccaccagtcctgagtccccgt

SEQ ID NO: 987315 - DNA, 25 bp, Mus musculus
ttctccactgcatttgctgaataca

SEQ ID NO: 987316 - DNA, 25 bp, Mus musculus
ttctccactggatttgctgaataca

SEQ ID NO: 987317 - DNA, 25 bp, Mus musculus
ttctccagaaagctccaatcactgc

SEQ ID NO: 987318 - DNA, 25 bp, Mus musculus
ttctccagaaaggtccaatcactgc

SEQ ID NO: 987319 - DNA, 25 bp, Mus musculus
ttctccagaacagcaatggatttgc

SEQ ID NO: 987320 - DNA, 25 bp, Mus musculus
ttctccagaacagcagttcctaagg

SEQ ID NO: 987321 - DNA, 25 bp, Mus musculus
ttctccagaacagctatggatttgc

SEQ ID NO: 987322 - DNA, 25 bp, Mus musculus
ttctccagaacagctgttcctaagg

SEQ ID NO: 987323 - DNA, 25 bp, Mus musculus
ttctccaggtacaacacgaactgga

SEQ ID NO: 987324 - DNA, 25 bp, Mus musculus
ttctccaggtacaagacgaactgga

SEQ ID NO: 987325 - DNA, 25 bp, Mus musculus
ttctccatgcagacccgctatgact

SEQ ID NO: 987326 - DNA, 25 bp, Mus musculus
ttctccatgcagtcccgctatgact

SEQ ID NO: 987327 - DNA, 25 bp, Mus musculus
ttctcccaaaaacactcctcatctt

SEQ ID NO: 987328 - DNA, 25 bp, Mus musculus
ttctcccaaaaagactcctcatctt

SEQ ID NO: 987329 - DNA, 25 bp, Mus musculus
ttctcccagaatacccaggcgtcct

SEQ ID NO: 987330 - DNA, 25 bp, Mus musculus
ttctcccagattacccaggcgtcct

SEQ ID NO: 987331 - DNA, 25 bp, Mus musculus
ttctcccctgacagacccggagtta

SEQ ID NO: 987332 - DNA, 25 bp, Mus musculus
ttctcccctgctttctgtatgcaaa

SEQ ID NO: 987333 - DNA, 25 bp, Mus musculus
ttctcccctggtttctgtatgcaaa

SEQ ID NO: 987334 - DNA, 25 bp, Mus musculus
ttctcccctgtcagacccggagtta

SEQ ID NO: 987335 - DNA, 25 bp, Mus musculus
ttctccgagcacattccatggccct

SEQ ID NO: 987336 - DNA, 25 bp, Mus musculus
ttctccgagcactttccatggccct

SEQ ID NO: 987337 - DNA, 25 bp, Mus musculus
ttctccgcaccagacgaacttctgc

SEQ ID NO: 987338 - DNA, 25 bp, Mus musculus
ttctccgcaccagaggaacttctgc

SEQ ID NO: 987339 - DNA, 25 bp, Mus musculus
ttctccggctggcccaccttgggac

SEQ ID NO: 987340 - DNA, 25 bp, Mus musculus
ttctccggctgggccaccttgggac

SEQ ID NO: 987341 - DNA, 25 bp, Mus musculus
ttctcctcctggcacatcatttgta

SEQ ID NO: 987342 - DNA, 25 bp, Mus musculus
ttctcctcctggcagatcatttgta

SEQ ID NO: 987343 - DNA, 25 bp, Mus musculus
ttctcctgaaatccctaacatacat

SEQ ID NO: 987344 - DNA, 25 bp, Mus musculus
ttctcctgaaatgcctaacatacat

SEQ ID NO: 987345 - DNA, 25 bp, Mus musculus
ttctcctgccagcgcccctttgacc

SEQ ID NO: 987346 - DNA, 25 bp, Mus musculus
ttctcctgccagggcccctttgacc

SEQ ID NO: 987347 - DNA, 25 bp, Mus musculus
ttctcctggcagaactgaagcaagc

SEQ ID NO: 987348 - DNA, 25 bp, Mus musculus
ttctcctggcagtactgaagcaagc

SEQ ID NO: 987349 - DNA, 25 bp, Mus musculus
ttctccttcaagcacaactcaaacc

SEQ ID NO: 987350 - DNA, 25 bp, Mus musculus
ttctccttcaaggacaactcaaacc

SEQ ID NO: 987351 - DNA, 25 bp, Mus musculus
ttctccttcatggacgatgatcggg

SEQ ID NO: 987352 - DNA, 25 bp, Mus musculus
ttctccttcatggaggatgatcggg

SEQ ID NO: 987353 - DNA, 25 bp, Mus musculus
ttctcgcctgatcattttttgggtc

SEQ ID NO: 987354 - DNA, 25 bp, Mus musculus
ttctcgcctgatgattttttgggtc

SEQ ID NO: 987355 - DNA, 25 bp, Mus musculus
ttctcggactcaacttctctgcggc

SEQ ID NO: 987356 - DNA, 25 bp, Mus musculus
ttctcggactcatcttctctgcggc

SEQ ID NO: 987357 - DNA, 25 bp, Mus musculus
ttctcgggcaagcacttagcattca

SEQ ID NO: 987358 - DNA, 25 bp, Mus musculus
ttctcgggcaaggacttagcattca

SEQ ID NO: 987359 - DNA, 25 bp, Mus musculus
ttctctacaaaaagattgaagacct

SEQ ID NO: 987360 - DNA, 25 bp, Mus musculus
ttctctacaaaaagtttgaagacct

SEQ ID NO: 987361 - DNA, 25 bp, Mus musculus
ttctctacacagcaaatccaccttc

SEQ ID NO: 987362 - DNA, 25 bp, Mus musculus
ttctctacacagcctgacaagaaaa

SEQ ID NO: 987363 - DNA, 25 bp, Mus musculus
ttctctacacaggaaatccaccttc

SEQ ID NO: 987364 - DNA, 25 bp, Mus musculus
ttctctacacaggctgacaagaaaa

SEQ ID NO: 987365 - DNA, 25 bp, Mus musculus
ttctctacagcaggtgtagggggcg

SEQ ID NO: 987366 - DNA, 25 bp, Mus musculus
ttctctacaggaggtgtagggggcg

SEQ ID NO: 987367 - DNA, 25 bp, Mus musculus
ttctctaccaaccgaattgaatata

SEQ ID NO: 987368 - DNA, 25 bp, Mus musculus
ttctctaccaacggaattgaatata

SEQ ID NO: 987369 - DNA, 25 bp, Mus musculus
ttctctacccagatgaggtggcatg

SEQ ID NO: 987370 - DNA, 25 bp, Mus musculus
ttctctacccagttgaggtggcatg

SEQ ID NO: 987371 - DNA, 25 bp, Mus musculus
ttctctcagcagattccaaaggctg

SEQ ID NO: 987372 - DNA, 25 bp, Mus musculus
ttctctcagcagcccttgagcctcc

SEQ ID NO: 987373 - DNA, 25 bp, Mus musculus
ttctctcagcaggccttgagcctcc

SEQ ID NO: 987374 - DNA, 25 bp, Mus musculus
ttctctcagcagtttccaaaggctg

SEQ ID NO: 987375 - DNA, 25 bp, Mus musculus
ttctctccagcagaactaaagaacg

SEQ ID NO: 987376 - DNA, 25 bp, Mus musculus
ttctctccagcagatctaaagaacg

SEQ ID NO: 987377 - DNA, 25 bp, Mus musculus
ttctctccaggctcaacttctgttc

SEQ ID NO: 987378 - DNA, 25 bp, Mus musculus
ttctctccaggctcagggaccctga

SEQ ID NO: 987379 - DNA, 25 bp, Mus musculus
ttctctccaggctctacttctgttc

SEQ ID NO: 987380 - DNA, 25 bp, Mus musculus
ttctctccaggctctgggaccctga

SEQ ID NO: 987381 - DNA, 25 bp, Mus musculus
ttctctccgtggaacctgacgacca

SEQ ID NO: 987382 - DNA, 25 bp, Mus musculus
ttctctccgtggtacctgacgacca

SEQ ID NO: 987383 - DNA, 25 bp, Mus musculus
ttctctcctcacagagctcagcgac

SEQ ID NO: 987384 - DNA, 25 bp, Mus musculus
ttctctcctcacagtgctcagcgac

SEQ ID NO: 987385 - DNA, 25 bp, Mus musculus
ttctctccttcccactttctgaact

SEQ ID NO: 987386 - DNA, 25 bp, Mus musculus
ttctctccttcccagtttctgaact

SEQ ID NO: 987387 - DNA, 25 bp, Mus musculus
ttctctctgcaagacgtttgcggtg

SEQ ID NO: 987388 - DNA, 25 bp, Mus musculus
ttctctctgcaagaggtttgcggtg

SEQ ID NO: 987389 - DNA, 25 bp, Mus musculus
ttctctctggcacggatggaagact

SEQ ID NO: 987390 - DNA, 25 bp, Mus musculus
ttctctctggcagggatggaagact

SEQ ID NO: 987391 - DNA, 25 bp, Mus musculus
ttctctcttgccttcgggaaatggc

SEQ ID NO: 987392 - DNA, 25 bp, Mus musculus
ttctctcttgccttggggaaatggc

SEQ ID NO: 987393 - DNA, 25 bp, Mus musculus
ttctctgacacgaatgaatttcata

SEQ ID NO: 987394 - DNA, 25 bp, Mus musculus
ttctctgacaggaatgaatttcata

SEQ ID NO: 987395 - DNA, 25 bp, Mus musculus
ttctctgcagcattacattgctgtg

SEQ ID NO: 987396 - DNA, 25 bp, Mus musculus
ttctctgcaggattacattgctgtg

SEQ ID NO: 987397 - DNA, 25 bp, Mus musculus
ttctctgcctcagtgcttcaattct

SEQ ID NO: 987398 - DNA, 25 bp, Mus musculus
ttctctgcctgagtgcttcaattct

SEQ ID NO: 987399 - DNA, 25 bp, Mus musculus
ttctctgcgccacgtatcagagcat

SEQ ID NO: 987400 - DNA, 25 bp, Mus musculus
ttctctgcgccaggtatcagagcat

SEQ ID NO: 987401 - DNA, 25 bp, Mus musculus
ttctctggagacaaatactaccgag

SEQ ID NO: 987402 - DNA, 25 bp, Mus musculus
ttctctggagtcaaatactaccgag

SEQ ID NO: 987403 - DNA, 25 bp, Mus musculus
ttctctggcaagcgttgtgtaaatc

SEQ ID NO: 987404 - DNA, 25 bp, Mus musculus
ttctctggcaagggttgtgtaaatc

SEQ ID NO: 987405 - DNA, 25 bp, Mus musculus
ttctctgtcaaacgtggaaagatca

SEQ ID NO: 987406 - DNA, 25 bp, Mus musculus
ttctctgtcaaaggtggaaagatca

SEQ ID NO: 987407 - DNA, 25 bp, Mus musculus
ttctctgttcagcatatgcagtacc

SEQ ID NO: 987408 - DNA, 25 bp, Mus musculus
ttctctgttcagcccttcccacaaa

SEQ ID NO: 987409 - DNA, 25 bp, Mus musculus
ttctctgttcaggatatgcagtacc

SEQ ID NO: 987410 - DNA, 25 bp, Mus musculus
ttctctgttcaggccttcccacaaa

SEQ ID NO: 987411 - DNA, 25 bp, Mus musculus
ttctcttacgatactgggagcagca

SEQ ID NO: 987412 - DNA, 25 bp, Mus musculus
ttctcttacgttactgggagcagca

SEQ ID NO: 987413 - DNA, 25 bp, Mus musculus
ttctcttcacaaccattcctggtct

SEQ ID NO: 987414 - DNA, 25 bp, Mus musculus
ttctcttcacaacctttcctggtct

SEQ ID NO: 987415 - DNA, 25 bp, Mus musculus
ttctcttctttgctgctctctccag

SEQ ID NO: 987416 - DNA, 25 bp, Mus musculus
ttctcttctttggtgctctctccag

SEQ ID NO: 987417 - DNA, 25 bp, Mus musculus
ttctcttggacttctgacgggaaca

SEQ ID NO: 987418 - DNA, 25 bp, Mus musculus
ttctcttggagttctgacgggaaca

SEQ ID NO: 987419 - DNA, 25 bp, Mus musculus
ttctctttcacccatcatcgggaaa

SEQ ID NO: 987420 - DNA, 25 bp, Mus musculus
ttctctttcaccgatcatcgggaaa

SEQ ID NO: 987421 - DNA, 25 bp, Mus musculus
ttctgaacagagggcacgaccctgt

SEQ ID NO: 987422 - DNA, 25 bp, Mus musculus
ttctgaacagaggggacgaccctgt

SEQ ID NO: 987423 - DNA, 25 bp, Mus musculus
ttctgaaccccacgtttgaggagcc

SEQ ID NO: 987424 - DNA, 25 bp, Mus musculus
ttctgaaccccaggtttgaggagcc

SEQ ID NO: 987425 - DNA, 25 bp, Mus musculus
ttctgaagctggacactttaaccac

SEQ ID NO: 987426 - DNA, 25 bp, Mus musculus
ttctgaagctggtcactttaaccac

SEQ ID NO: 987427 - DNA, 25 bp, Mus musculus
ttctgacagctgcatcactgatggg

SEQ ID NO: 987428 - DNA, 25 bp, Mus musculus
ttctgacagctggatcactgatggg

SEQ ID NO: 987429 - DNA, 25 bp, Mus musculus
ttctgacattgacgtggataagaag

SEQ ID NO: 987430 - DNA, 25 bp, Mus musculus
ttctgacattgaggtggataagaag

SEQ ID NO: 987431 - DNA, 25 bp, Mus musculus
ttctgaccaaagaatacattccacc

SEQ ID NO: 987432 - DNA, 25 bp, Mus musculus
ttctgaccaaagtatacattccacc

SEQ ID NO: 987433 - DNA, 25 bp, Mus musculus
ttctgaccagagccaaaagaatgag

SEQ ID NO: 987434 - DNA, 25 bp, Mus musculus
ttctgaccagtgccaaaagaatgag

SEQ ID NO: 987435 - DNA, 25 bp, Mus musculus
ttctgagaccaactacatggagaag

SEQ ID NO: 987436 - DNA, 25 bp, Mus musculus
ttctgagaccaagtacatggagaag

SEQ ID NO: 987437 - DNA, 25 bp, Mus musculus
ttctgagagaaactgcaagaaaaat

SEQ ID NO: 987438 - DNA, 25 bp, Mus musculus
ttctgagagaaagtgcaagaaaaat

SEQ ID NO: 987439 - DNA, 25 bp, Mus musculus
ttctgagcagatctggagcccagtc

SEQ ID NO: 987440 - DNA, 25 bp, Mus musculus
ttctgagcagccagttctggagccc

SEQ ID NO: 987441 - DNA, 25 bp, Mus musculus
ttctgagcagcttctgaaggagagt

SEQ ID NO: 987442 - DNA, 25 bp, Mus musculus
ttctgagcagcttgccccgttgctc

SEQ ID NO: 987443 - DNA, 25 bp, Mus musculus
ttctgagcaggcagttctggagccc

SEQ ID NO: 987444 - DNA, 25 bp, Mus musculus
ttctgagcaggttctgaaggagagt

SEQ ID NO: 987445 - DNA, 25 bp, Mus musculus
ttctgagcaggttgccccgttgctc

SEQ ID NO: 987446 - DNA, 25 bp, Mus musculus
ttctgagcagttctggagcccagtc

SEQ ID NO: 987447 - DNA, 25 bp, Mus musculus
ttctgagcctcactcgtgggtgtgc

SEQ ID NO: 987448 - DNA, 25 bp, Mus musculus
ttctgagcctcactggtgggtgtgc

SEQ ID NO: 987449 - DNA, 25 bp, Mus musculus
ttctgagtaaagctgaacgacgact

SEQ ID NO: 987450 - DNA, 25 bp, Mus musculus
ttctgagtaaaggtgaacgacgact

SEQ ID NO: 987451 - DNA, 25 bp, Mus musculus
ttctgagtcaagagcttggattctg

SEQ ID NO: 987452 - DNA, 25 bp, Mus musculus
ttctgagtcaagtgcttggattctg

SEQ ID NO: 987453 - DNA, 25 bp, Mus musculus
ttctgatatacccacttccagactt

SEQ ID NO: 987454 - DNA, 25 bp, Mus musculus
ttctgatatacccagttccagactt

SEQ ID NO: 987455 - DNA, 25 bp, Mus musculus
ttctgatatgagcacccatcctctg

SEQ ID NO: 987456 - DNA, 25 bp, Mus musculus
ttctgatatgaggacccatcctctg

SEQ ID NO: 987457 - DNA, 25 bp, Mus musculus
ttctgatcaacacgtctccattttg

SEQ ID NO: 987458 - DNA, 25 bp, Mus musculus
ttctgatcaacaggtctccattttg

SEQ ID NO: 987459 - DNA, 25 bp, Mus musculus
ttctgatcaatgctcctgaaatcat

SEQ ID NO: 987460 - DNA, 25 bp, Mus musculus
ttctgatcaatggtcctgaaatcat

SEQ ID NO: 987461 - DNA, 25 bp, Mus musculus
ttctgatcagcacagtgaaatggtt

SEQ ID NO: 987462 - DNA, 25 bp, Mus musculus
ttctgatcagcagagtgaaatggtt

SEQ ID NO: 987463 - DNA, 25 bp, Mus musculus
ttctgatcagctgttgtttgtggca

SEQ ID NO: 987464 - DNA, 25 bp, Mus musculus
ttctgatcaggtgttgtttgtggca

SEQ ID NO: 987465 - DNA, 25 bp, Mus musculus
ttctgatcctagagtcaaaggtccc

SEQ ID NO: 987466 - DNA, 25 bp, Mus musculus
ttctgatcctagtgtcaaaggtccc

SEQ ID NO: 987467 - DNA, 25 bp, Mus musculus
ttctgatcggatggcgcatccccag

SEQ ID NO: 987468 - DNA, 25 bp, Mus musculus
ttctgatcggatggggcatccccag

SEQ ID NO: 987469 - DNA, 25 bp, Mus musculus
ttctgatgagctgggaagtcatcaa

SEQ ID NO: 987470 - DNA, 25 bp, Mus musculus
ttctgatgaggtgggaagtcatcaa

SEQ ID NO: 987471 - DNA, 25 bp, Mus musculus
ttctgattctcgccgagctgcttgt

SEQ ID NO: 987472 - DNA, 25 bp, Mus musculus
ttctgattctcggcgagctgcttgt

SEQ ID NO: 987473 - DNA, 25 bp, Mus musculus
ttctgattgaagcctgctgcaaaaa

SEQ ID NO: 987474 - DNA, 25 bp, Mus musculus
ttctgattgaaggctgctgcaaaaa

SEQ ID NO: 987475 - DNA, 25 bp, Mus musculus
ttctgcaaaaagcggatggaattcg

SEQ ID NO: 987476 - DNA, 25 bp, Mus musculus
ttctgcaaaaaggggatggaattcg

SEQ ID NO: 987477 - DNA, 25 bp, Mus musculus
ttctgcaaagaacagaacagtctat

SEQ ID NO: 987478 - DNA, 25 bp, Mus musculus
ttctgcaaagtacagaacagtctat

SEQ ID NO: 987479 - DNA, 25 bp, Mus musculus
ttctgcaaccagatcttcattaaca

SEQ ID NO: 987480 - DNA, 25 bp, Mus musculus
ttctgcaaccagttcttcattaaca

SEQ ID NO: 987481 - DNA, 25 bp, Mus musculus
ttctgcaagatcctcttccaagact

SEQ ID NO: 987482 - DNA, 25 bp, Mus musculus
ttctgcaagatcctgttccaagact

SEQ ID NO: 987483 - DNA, 25 bp, Mus musculus
ttctgcaatggtgacgtgcaggcag

SEQ ID NO: 987484 - DNA, 25 bp, Mus musculus
ttctgcaatggtgaggtgcaggcag

SEQ ID NO: 987485 - DNA, 25 bp, Mus musculus
ttctgcacacagcacccaacataat

SEQ ID NO: 987486 - DNA, 25 bp, Mus musculus
ttctgcacacagcagccaacataat

SEQ ID NO: 987487 - DNA, 25 bp, Mus musculus
ttctgcactcaccaagtagagccca

SEQ ID NO: 987488 - DNA, 25 bp, Mus musculus
ttctgcactcacgaagtagagccca

SEQ ID NO: 987489 - DNA, 25 bp, Mus musculus
ttctgcacttcacaaatgctaccac

SEQ ID NO: 987490 - DNA, 25 bp, Mus musculus
ttctgcacttcacctgtatggacgc

SEQ ID NO: 987491 - DNA, 25 bp, Mus musculus
ttctgcacttcagaaatgctaccac

SEQ ID NO: 987492 - DNA, 25 bp, Mus musculus
ttctgcacttcagctgtatggacgc

SEQ ID NO: 987493 - DNA, 25 bp, Mus musculus
ttctgcagagagaatagtgtgaact

SEQ ID NO: 987494 - DNA, 25 bp, Mus musculus
ttctgcagagagtatagtgtgaact

SEQ ID NO: 987495 - DNA, 25 bp, Mus musculus
ttctgcagagcaacagctgtgccaa

SEQ ID NO: 987496 - DNA, 25 bp, Mus musculus
ttctgcagaggaacagctgtgccaa

SEQ ID NO: 987497 - DNA, 25 bp, Mus musculus
ttctgcagggcccacgaattgcatt

SEQ ID NO: 987498 - DNA, 25 bp, Mus musculus
ttctgcagggcccaggaattgcatt

SEQ ID NO: 987499 - DNA, 25 bp, Mus musculus
ttctgcatcaatctgttgtctgagg

SEQ ID NO: 987500 - DNA, 25 bp, Mus musculus
ttctgcatcaatgtgttgtctgagg

SEQ ID NO: 987501 - DNA, 25 bp, Mus musculus
ttctgcatcagccgatctctcaatc

SEQ ID NO: 987502 - DNA, 25 bp, Mus musculus
ttctgcatcagcggatctctcaatc

SEQ ID NO: 987503 - DNA, 25 bp, Mus musculus
ttctgcatgctcatcgtgggcagca

SEQ ID NO: 987504 - DNA, 25 bp, Mus musculus
ttctgcatgctcatggtgggcagca

SEQ ID NO: 987505 - DNA, 25 bp, Mus musculus
ttctgccaaagaagttgcaaagcag

SEQ ID NO: 987506 - DNA, 25 bp, Mus musculus
ttctgccaaagatgttgcaaagcag

SEQ ID NO: 987507 - DNA, 25 bp, Mus musculus
ttctgccacctccaagtcagcctcc

SEQ ID NO: 987508 - DNA, 25 bp, Mus musculus
ttctgccacctccatgtcagcctcc

SEQ ID NO: 987509 - DNA, 25 bp, Mus musculus
ttctgccagtgtcattttgacattg

SEQ ID NO: 987510 - DNA, 25 bp, Mus musculus
ttctgccagtgtgattttgacattg

SEQ ID NO: 987511 - DNA, 25 bp, Mus musculus
ttctgccatctagcactaagagcgg

SEQ ID NO: 987512 - DNA, 25 bp, Mus musculus
ttctgccatctagctctaagagcgg

SEQ ID NO: 987513 - DNA, 25 bp, Mus musculus
ttctgcccagcagacggcagacacc

SEQ ID NO: 987514 - DNA, 25 bp, Mus musculus
ttctgcccagcagagggcagacacc

SEQ ID NO: 987515 - DNA, 25 bp, Mus musculus
ttctgccctacacaatactgtggca

SEQ ID NO: 987516 - DNA, 25 bp, Mus musculus
ttctgccctacagaatactgtggca

SEQ ID NO: 987517 - DNA, 25 bp, Mus musculus
ttctgccgaatgctccaagatggaa

SEQ ID NO: 987518 - DNA, 25 bp, Mus musculus
ttctgccgaatggtccaagatggaa

SEQ ID NO: 987519 - DNA, 25 bp, Mus musculus
ttctgccgggcccacgaactgcata

SEQ ID NO: 987520 - DNA, 25 bp, Mus musculus
ttctgccgggcccaggaactgcata

SEQ ID NO: 987521 - DNA, 25 bp, Mus musculus
ttctgcctagcatcaacgatatagc

SEQ ID NO: 987522 - DNA, 25 bp, Mus musculus
ttctgcctagctatgtctatatagc

SEQ ID NO: 987523 - DNA, 25 bp, Mus musculus
ttctgcctagctcctcaactttgac

SEQ ID NO: 987524 - DNA, 25 bp, Mus musculus
ttctgcctaggatcaacgatatagc

SEQ ID NO: 987525 - DNA, 25 bp, Mus musculus
ttctgcctaggtatgtctatatagc

SEQ ID NO: 987526 - DNA, 25 bp, Mus musculus
ttctgcctaggtcctcaactttgac

SEQ ID NO: 987527 - DNA, 25 bp, Mus musculus
ttctgcctgacaaattgacatcagc

SEQ ID NO: 987528 - DNA, 25 bp, Mus musculus
ttctgcctgacaattggcagcttca

SEQ ID NO: 987529 - DNA, 25 bp, Mus musculus
ttctgcctgacatattgacatcagc

SEQ ID NO: 987530 - DNA, 25 bp, Mus musculus
ttctgcctgacatttggcagcttca

SEQ ID NO: 987531 - DNA, 25 bp, Mus musculus
ttctgcctggctgctgtaaaaggag

SEQ ID NO: 987532 - DNA, 25 bp, Mus musculus
ttctgcctgggtgctgtaaaaggag

SEQ ID NO: 987533 - DNA, 25 bp, Mus musculus
ttctgcctttgaaacagacataatg

SEQ ID NO: 987534 - DNA, 25 bp, Mus musculus
ttctgcctttgaacatgattctgtt

SEQ ID NO: 987535 - DNA, 25 bp, Mus musculus
ttctgcctttgatacagacataatg

SEQ ID NO: 987536 - DNA, 25 bp, Mus musculus
ttctgcctttgatcatgattctgtt

SEQ ID NO: 987537 - DNA, 25 bp, Mus musculus
ttctgcgaaatacacgttcgggctt

SEQ ID NO: 987538 - DNA, 25 bp, Mus musculus
ttctgcgaaatagacgttcgggctt

SEQ ID NO: 987539 - DNA, 25 bp, Mus musculus
ttctgcgggcagctggtgctgatcg

SEQ ID NO: 987540 - DNA, 25 bp, Mus musculus
ttctgcgggcaggtggtgctgatcg

SEQ ID NO: 987541 - DNA, 25 bp, Mus musculus
ttctgctcagaggtcgagtactcca

SEQ ID NO: 987542 - DNA, 25 bp, Mus musculus
ttctgctcagtggtcgagtactcca

SEQ ID NO: 987543 - DNA, 25 bp, Mus musculus
ttctgctccaaacagatttccgcat

SEQ ID NO: 987544 - DNA, 25 bp, Mus musculus
ttctgctccaaagagatttccgcat

SEQ ID NO: 987545 - DNA, 25 bp, Mus musculus
ttctgctgagcaaacatgaagcggc

SEQ ID NO: 987546 - DNA, 25 bp, Mus musculus
ttctgctgagcaaagatgaagcggc

SEQ ID NO: 987547 - DNA, 25 bp, Mus musculus
ttctgctgagcagagcaatggccag

SEQ ID NO: 987548 - DNA, 25 bp, Mus musculus
ttctgctgaggagagcaatggccag

SEQ ID NO: 987549 - DNA, 25 bp, Mus musculus
ttctgctgctgtttccttttgcaga

SEQ ID NO: 987550 - DNA, 25 bp, Mus musculus
ttctgctgctgtttgcttttgcaga

SEQ ID NO: 987551 - DNA, 25 bp, Mus musculus
ttctgctgtatgcgtggtctatcac

SEQ ID NO: 987552 - DNA, 25 bp, Mus musculus
ttctgctgtatgctgcccagcacgg

SEQ ID NO: 987553 - DNA, 25 bp, Mus musculus
ttctgctgtatgggtggtctatcac

SEQ ID NO: 987554 - DNA, 25 bp, Mus musculus
ttctgctgtatggtgcccagcacgg

SEQ ID NO: 987555 - DNA, 25 bp, Mus musculus
ttctgctgtattacccacaggtttt

SEQ ID NO: 987556 - DNA, 25 bp, Mus musculus
ttctgctgtattactcacagatctt

SEQ ID NO: 987557 - DNA, 25 bp, Mus musculus
ttctgctgtatttcccacaggtttt

SEQ ID NO: 987558 - DNA, 25 bp, Mus musculus
ttctgctgtatttctcacagatctt

SEQ ID NO: 987559 - DNA, 25 bp, Mus musculus
ttctgcttcaagcaccatgattggg

SEQ ID NO: 987560 - DNA, 25 bp, Mus musculus
ttctgcttcaagcaccgttccacgc

SEQ ID NO: 987561 - DNA, 25 bp, Mus musculus
ttctgcttcaagcactgtggcattg

SEQ ID NO: 987562 - DNA, 25 bp, Mus musculus
ttctgcttcaagcagcatgattggg

SEQ ID NO: 987563 - DNA, 25 bp, Mus musculus
ttctgcttcaagcagcgttccacgc

SEQ ID NO: 987564 - DNA, 25 bp, Mus musculus
ttctgcttcaagcagtgtggcattg

SEQ ID NO: 987565 - DNA, 25 bp, Mus musculus
ttctggaaagaatatccagttatgg

SEQ ID NO: 987566 - DNA, 25 bp, Mus musculus
ttctggaaagtatatccagttatgg

SEQ ID NO: 987567 - DNA, 25 bp, Mus musculus
ttctggaaattaaacgatgaaggtc

SEQ ID NO: 987568 - DNA, 25 bp, Mus musculus
ttctggaaattaaaggatgaaggtc

SEQ ID NO: 987569 - DNA, 25 bp, Mus musculus
ttctggaacaccctatatgctcagt

SEQ ID NO: 987570 - DNA, 25 bp, Mus musculus
ttctggaacagcctatatgctcagt

SEQ ID NO: 987571 - DNA, 25 bp, Mus musculus
ttctggaaggttctcgccctaaaga

SEQ ID NO: 987572 - DNA, 25 bp, Mus musculus
ttctggaaggttctggccctaaaga

SEQ ID NO: 987573 - DNA, 25 bp, Mus musculus
ttctggaccaacctatagaggacca

SEQ ID NO: 987574 - DNA, 25 bp, Mus musculus
ttctggaccaacgtatagaggacca

SEQ ID NO: 987575 - DNA, 25 bp, Mus musculus
ttctggaccaagtacatgaaccacc

SEQ ID NO: 987576 - DNA, 25 bp, Mus musculus
ttctggaccatgtacatgaaccacc

SEQ ID NO: 987577 - DNA, 25 bp, Mus musculus
ttctggaccccccacaccaggtggt

SEQ ID NO: 987578 - DNA, 25 bp, Mus musculus
ttctggaccccccagaccaggtggt

SEQ ID NO: 987579 - DNA, 25 bp, Mus musculus
ttctggacctggctgcaggtcctgg

SEQ ID NO: 987580 - DNA, 25 bp, Mus musculus
ttctggacctgggtgcaggtcctgg

SEQ ID NO: 987581 - DNA, 25 bp, Mus musculus
ttctggactggaagaggcatctgtg

SEQ ID NO: 987582 - DNA, 25 bp, Mus musculus
ttctggactggaagtggcatctgtg

SEQ ID NO: 987583 - DNA, 25 bp, Mus musculus
ttctggactgtccggccttccacta

SEQ ID NO: 987584 - DNA, 25 bp, Mus musculus
ttctggactgtcgggccttccacta

SEQ ID NO: 987585 - DNA, 25 bp, Mus musculus
ttctggagacctccatggagaaaat

SEQ ID NO: 987586 - DNA, 25 bp, Mus musculus
ttctggagacctgcatggagaaaat

SEQ ID NO: 987587 - DNA, 25 bp, Mus musculus
ttctggagagaagtgtgctggtgtc

SEQ ID NO: 987588 - DNA, 25 bp, Mus musculus
ttctggagagcgcatcatggctctt

SEQ ID NO: 987589 - DNA, 25 bp, Mus musculus
ttctggagagggcatcatggctctt

SEQ ID NO: 987590 - DNA, 25 bp, Mus musculus
ttctggagagtagtgtgctggtgtc

SEQ ID NO: 987591 - DNA, 25 bp, Mus musculus
ttctggaggcaacgatggccaggct

SEQ ID NO: 987592 - DNA, 25 bp, Mus musculus
ttctggaggcaacgctatgctgtgg

SEQ ID NO: 987593 - DNA, 25 bp, Mus musculus
ttctggaggcaaggatggccaggct

SEQ ID NO: 987594 - DNA, 25 bp, Mus musculus
ttctggaggcaaggctatgctgtgg

SEQ ID NO: 987595 - DNA, 25 bp, Mus musculus
ttctggatggatcattgctcaagga

SEQ ID NO: 987596 - DNA, 25 bp, Mus musculus
ttctggatggttcattgctcaagga

SEQ ID NO: 987597 - DNA, 25 bp, Mus musculus
ttctggcaagcccagatcctgtccg

SEQ ID NO: 987598 - DNA, 25 bp, Mus musculus
ttctggcaaggccagatcctgtccg

SEQ ID NO: 987599 - DNA, 25 bp, Mus musculus
ttctggcccataaatgctgttggct

SEQ ID NO: 987600 - DNA, 25 bp, Mus musculus
ttctggcccatatatgctgttggct

SEQ ID NO: 987601 - DNA, 25 bp, Mus musculus
ttctggcctgaacggggagcctgga

SEQ ID NO: 987602 - DNA, 25 bp, Mus musculus
ttctggcctgaagggggagcctgga

SEQ ID NO: 987603 - DNA, 25 bp, Mus musculus
ttctggctcacacagaaggacttga

SEQ ID NO: 987604 - DNA, 25 bp, Mus musculus
ttctggctcacagagaaggacttga

SEQ ID NO: 987605 - DNA, 25 bp, Mus musculus
ttctggctttcagacgcagaaggct

SEQ ID NO: 987606 - DNA, 25 bp, Mus musculus
ttctggctttcagaggcagaaggct

SEQ ID NO: 987607 - DNA, 25 bp, Mus musculus
ttctgggaagagcgaaatcaaagtt

SEQ ID NO: 987608 - DNA, 25 bp, Mus musculus
ttctgggaagagcttggcctgtggc

SEQ ID NO: 987609 - DNA, 25 bp, Mus musculus
ttctgggaagaggttggcctgtggc

SEQ ID NO: 987610 - DNA, 25 bp, Mus musculus
ttctgggaagtgcgaaatcaaagtt

SEQ ID NO: 987611 - DNA, 25 bp, Mus musculus
ttctgggacagcaactgcctacttt

SEQ ID NO: 987612 - DNA, 25 bp, Mus musculus
ttctgggacagcaagtgcctacttt

SEQ ID NO: 987613 - DNA, 25 bp, Mus musculus
ttctgggccaagagagccaagcaga

SEQ ID NO: 987614 - DNA, 25 bp, Mus musculus
ttctgggccaagagtgccaagcaga

SEQ ID NO: 987615 - DNA, 25 bp, Mus musculus
ttctgggccatgcgccgggagggtg

SEQ ID NO: 987616 - DNA, 25 bp, Mus musculus
ttctgggccatgggccgggagggtg

SEQ ID NO: 987617 - DNA, 25 bp, Mus musculus
ttctggggaacacactttggacttc

SEQ ID NO: 987618 - DNA, 25 bp, Mus musculus
ttctggggaacagactttggacttc

SEQ ID NO: 987619 - DNA, 25 bp, Mus musculus
ttctggggtggtcaccttaaagcag

SEQ ID NO: 987620 - DNA, 25 bp, Mus musculus
ttctggggtggtgaccttaaagcag

SEQ ID NO: 987621 - DNA, 25 bp, Mus musculus
ttctggtgccagctctaggaatgat

SEQ ID NO: 987622 - DNA, 25 bp, Mus musculus
ttctggtgccaggtctaggaatgat

SEQ ID NO: 987623 - DNA, 25 bp, Mus musculus
ttctggtttaacacattggcatatt

SEQ ID NO: 987624 - DNA, 25 bp, Mus musculus
ttctggtttaacactttggcatatt

SEQ ID NO: 987625 - DNA, 25 bp, Mus musculus
ttctgtaacattcttcccacagagc

SEQ ID NO: 987626 - DNA, 25 bp, Mus musculus
ttctgtaacattgttcccacagagc

SEQ ID NO: 987627 - DNA, 25 bp, Mus musculus
ttctgtacatgaaacgtggcttaat

SEQ ID NO: 987628 - DNA, 25 bp, Mus musculus
ttctgtacatgaaaggtggcttaat

SEQ ID NO: 987629 - DNA, 25 bp, Mus musculus
ttctgtattatcgtaatgagtattg

SEQ ID NO: 987630 - DNA, 25 bp, Mus musculus
ttctgtattatcgttatgagtattg

SEQ ID NO: 987631 - DNA, 25 bp, Mus musculus
ttctgtccagactggaagaccaggc

SEQ ID NO: 987632 - DNA, 25 bp, Mus musculus
ttctgtccagcaccagacgacagta

SEQ ID NO: 987633 - DNA, 25 bp, Mus musculus
ttctgtccaggaccagacgacagta

SEQ ID NO: 987634 - DNA, 25 bp, Mus musculus
ttctgtccagtctggaagaccaggc

SEQ ID NO: 987635 - DNA, 25 bp, Mus musculus
ttctgtgaagaaaagacatgctcac

SEQ ID NO: 987636 - DNA, 25 bp, Mus musculus
ttctgtgaagaaaatgatgaaggac

SEQ ID NO: 987637 - DNA, 25 bp, Mus musculus
ttctgtgaagtaaagacatgctcac

SEQ ID NO: 987638 - DNA, 25 bp, Mus musculus
ttctgtgaagtaaatgatgaaggac

SEQ ID NO: 987639 - DNA, 25 bp, Mus musculus
ttctgtgcaaactgggtcgctgctg

SEQ ID NO: 987640 - DNA, 25 bp, Mus musculus
ttctgtgcaatctgggtcgctgctg

SEQ ID NO: 987641 - DNA, 25 bp, Mus musculus
ttctgtgcacacatgtctgagagca

SEQ ID NO: 987642 - DNA, 25 bp, Mus musculus
ttctgtgcacacttgtctgagagca

SEQ ID NO: 987643 - DNA, 25 bp, Mus musculus
ttctgtgccctgcacgcattgattg

SEQ ID NO: 987644 - DNA, 25 bp, Mus musculus
ttctgtgccctgcaggcattgattg

SEQ ID NO: 987645 - DNA, 25 bp, Mus musculus
ttctgtgctgccttcaaggtgaatg

SEQ ID NO: 987646 - DNA, 25 bp, Mus musculus
ttctgtgctggcttcaaggtgaatg

SEQ ID NO: 987647 - DNA, 25 bp, Mus musculus
ttctgtggcaagaccaagatgaaga

SEQ ID NO: 987648 - DNA, 25 bp, Mus musculus
ttctgtggcaagtccaagatgaaga

SEQ ID NO: 987649 - DNA, 25 bp, Mus musculus
ttctgtgtggagctactacaagcct

SEQ ID NO: 987650 - DNA, 25 bp, Mus musculus
ttctgtgtggaggtactacaagcct

SEQ ID NO: 987651 - DNA, 25 bp, Mus musculus
ttctgttcccatcagaacccctgag

SEQ ID NO: 987652 - DNA, 25 bp, Mus musculus
ttctgttcccatcgaatcattggtc

SEQ ID NO: 987653 - DNA, 25 bp, Mus musculus
ttctgttcccatgagaacccctgag

SEQ ID NO: 987654 - DNA, 25 bp, Mus musculus
ttctgttcccatggaatcattggtc

SEQ ID NO: 987655 - DNA, 25 bp, Mus musculus
ttctgttcctagcagccgttcagtc

SEQ ID NO: 987656 - DNA, 25 bp, Mus musculus
ttctgttcctaggagccgttcagtc

SEQ ID NO: 987657 - DNA, 25 bp, Mus musculus
ttctgttgcaagcctacttctccct

SEQ ID NO: 987658 - DNA, 25 bp, Mus musculus
ttctgttgcaagctgatctctgcac

SEQ ID NO: 987659 - DNA, 25 bp, Mus musculus
ttctgttgcaaggctacttctccct

SEQ ID NO: 987660 - DNA, 25 bp, Mus musculus
ttctgttgcaaggtgatctctgcac

SEQ ID NO: 987661 - DNA, 25 bp, Mus musculus
ttctgtttaccacgaagccatgaat

SEQ ID NO: 987662 - DNA, 25 bp, Mus musculus
ttctgtttaccaggaagccatgaat

SEQ ID NO: 987663 - DNA, 25 bp, Mus musculus
ttctgtttccggctgccatgcagaa

SEQ ID NO: 987664 - DNA, 25 bp, Mus musculus
ttctgtttccgggtgccatgcagaa

SEQ ID NO: 987665 - DNA, 25 bp, Mus musculus
ttcttaagaagaaaccagcacacac

SEQ ID NO: 987666 - DNA, 25 bp, Mus musculus
ttcttaagaagaaacgactgacaga

SEQ ID NO: 987667 - DNA, 25 bp, Mus musculus
ttcttaagaagaaagcagcacacac

SEQ ID NO: 987668 - DNA, 25 bp, Mus musculus
ttcttaagaagaaaggactgacaga

SEQ ID NO: 987669 - DNA, 25 bp, Mus musculus
ttcttaagcccacactgaccacaag

SEQ ID NO: 987670 - DNA, 25 bp, Mus musculus
ttcttaagcccacagtgaccacaag

SEQ ID NO: 987671 - DNA, 25 bp, Mus musculus
ttcttactacagcaatgagtgccac

SEQ ID NO: 987672 - DNA, 25 bp, Mus musculus
ttcttactacaggaatgagtgccac

SEQ ID NO: 987673 - DNA, 25 bp, Mus musculus
ttcttagaaaacgcctccttggcat

SEQ ID NO: 987674 - DNA, 25 bp, Mus musculus
ttcttagaaatcgcctccttggcat

SEQ ID NO: 987675 - DNA, 25 bp, Mus musculus
ttcttagctcagcgaaccatggaag

SEQ ID NO: 987676 - DNA, 25 bp, Mus musculus
ttcttagctcagggaaccatggaag

SEQ ID NO: 987677 - DNA, 25 bp, Mus musculus
ttcttagtcaagcgtctcatgtact

SEQ ID NO: 987678 - DNA, 25 bp, Mus musculus
ttcttagtcaagcttggcttcctga

SEQ ID NO: 987679 - DNA, 25 bp, Mus musculus
ttcttagtcaagggtctcatgtact

SEQ ID NO: 987680 - DNA, 25 bp, Mus musculus
ttcttagtcaaggttggcttcctga

SEQ ID NO: 987681 - DNA, 25 bp, Mus musculus
ttcttatcagctgaacgctccctgg

SEQ ID NO: 987682 - DNA, 25 bp, Mus musculus
ttcttatcagctgatcgctccctgg

SEQ ID NO: 987683 - DNA, 25 bp, Mus musculus
ttcttatctgagttgaactctttag

SEQ ID NO: 987684 - DNA, 25 bp, Mus musculus
ttcttatctgtgttgaactctttag

SEQ ID NO: 987685 - DNA, 25 bp, Mus musculus
ttcttattagcaaacgtgccaatgt

SEQ ID NO: 987686 - DNA, 25 bp, Mus musculus
ttcttattagcaaaggtgccaatgt

SEQ ID NO: 987687 - DNA, 25 bp, Mus musculus
ttcttcaacaagccattgtgaaatc

SEQ ID NO: 987688 - DNA, 25 bp, Mus musculus
ttcttcaacaaggcattgtgaaatc

SEQ ID NO: 987689 - DNA, 25 bp, Mus musculus
ttcttcaaggcgaagcagtactggg

SEQ ID NO: 987690 - DNA, 25 bp, Mus musculus
ttcttcaaggggaagcagtactggg

SEQ ID NO: 987691 - DNA, 25 bp, Mus musculus
ttcttcacaacatctcccctaacct

SEQ ID NO: 987692 - DNA, 25 bp, Mus musculus
ttcttcacaagatctcccctaacct

SEQ ID NO: 987693 - DNA, 25 bp, Mus musculus
ttcttcactcttccacggtgattgc

SEQ ID NO: 987694 - DNA, 25 bp, Mus musculus
ttcttcactcttgcacggtgattgc

SEQ ID NO: 987695 - DNA, 25 bp, Mus musculus
ttcttcagagctagaactagacctg

SEQ ID NO: 987696 - DNA, 25 bp, Mus musculus
ttcttcagaggtagaactagacctg

SEQ ID NO: 987697 - DNA, 25 bp, Mus musculus
ttcttcagtaagactgaagagctga

SEQ ID NO: 987698 - DNA, 25 bp, Mus musculus
ttcttcagtaagtctgaagagctga

SEQ ID NO: 987699 - DNA, 25 bp, Mus musculus
ttcttcataaaactctgaaggcatg

SEQ ID NO: 987700 - DNA, 25 bp, Mus musculus
ttcttcataatactctgaaggcatg

SEQ ID NO: 987701 - DNA, 25 bp, Mus musculus
ttcttcatagagaagatcttggaaa

SEQ ID NO: 987702 - DNA, 25 bp, Mus musculus
ttcttcatagtgaagatcttggaaa

SEQ ID NO: 987703 - DNA, 25 bp, Mus musculus
ttcttcatcaaccatgttattctca

SEQ ID NO: 987704 - DNA, 25 bp, Mus musculus
ttcttcatcaacgatgttattctca

SEQ ID NO: 987705 - DNA, 25 bp, Mus musculus
ttcttcatccccaacgggacgacac

SEQ ID NO: 987706 - DNA, 25 bp, Mus musculus
ttcttcatccccaaggggacgacac

SEQ ID NO: 987707 - DNA, 25 bp, Mus musculus
ttcttccacaagcaggtgtgtgagt

SEQ ID NO: 987708 - DNA, 25 bp, Mus musculus
ttcttccacaaggaggtgtgtgagt

SEQ ID NO: 987709 - DNA, 25 bp, Mus musculus
ttcttccacgaacgagccgcagccc

SEQ ID NO: 987710 - DNA, 25 bp, Mus musculus
ttcttccacgaaggagccgcagccc

SEQ ID NO: 987711 - DNA, 25 bp, Mus musculus
ttcttccacgaatttgaaagatgta

SEQ ID NO: 987712 - DNA, 25 bp, Mus musculus
ttcttccacgtatttgaaagatgta

SEQ ID NO: 987713 - DNA, 25 bp, Mus musculus
ttcttcccagcctcctggtggatta

SEQ ID NO: 987714 - DNA, 25 bp, Mus musculus
ttcttcccaggctcctggtggatta

SEQ ID NO: 987715 - DNA, 25 bp, Mus musculus
ttcttcccatcaccccaggccacag

SEQ ID NO: 987716 - DNA, 25 bp, Mus musculus
ttcttcccatcagcccaggccacag

SEQ ID NO: 987717 - DNA, 25 bp, Mus musculus
ttcttcccgtagatgccaccggcac

SEQ ID NO: 987718 - DNA, 25 bp, Mus musculus
ttcttcccgttgatgccaccggcac

SEQ ID NO: 987719 - DNA, 25 bp, Mus musculus
ttcttccctattccactggttgccc

SEQ ID NO: 987720 - DNA, 25 bp, Mus musculus
ttcttccctattgcactggttgccc

SEQ ID NO: 987721 - DNA, 25 bp, Mus musculus
ttcttccgagaactggaggagtttc

SEQ ID NO: 987722 - DNA, 25 bp, Mus musculus
ttcttccgagtactggaggagtttc

SEQ ID NO: 987723 - DNA, 25 bp, Mus musculus
ttcttcctgaacggaccgccgctgc

SEQ ID NO: 987724 - DNA, 25 bp, Mus musculus
ttcttcctgatcggaccgccgctgc

SEQ ID NO: 987725 - DNA, 25 bp, Mus musculus
ttcttccttaagcatcatgggaaaa

SEQ ID NO: 987726 - DNA, 25 bp, Mus musculus
ttcttccttaaggatcatgggaaaa

SEQ ID NO: 987727 - DNA, 25 bp, Mus musculus
ttcttcgaaaatatgttttggccag

SEQ ID NO: 987728 - DNA, 25 bp, Mus musculus
ttcttcgaaaatttgttttggccag

SEQ ID NO: 987729 - DNA, 25 bp, Mus musculus
ttcttcgaagccaacgcccaggcct

SEQ ID NO: 987730 - DNA, 25 bp, Mus musculus
ttcttcgaagccaaggcccaggcct

SEQ ID NO: 987731 - DNA, 25 bp, Mus musculus
ttcttcgaatctcacgctcaggtcc

SEQ ID NO: 987732 - DNA, 25 bp, Mus musculus
ttcttcgaatctcaggctcaggtcc

SEQ ID NO: 987733 - DNA, 25 bp, Mus musculus
ttcttctccacgatctaccacgcct

SEQ ID NO: 987734 - DNA, 25 bp, Mus musculus
ttcttctccacgctactacttgtcc

SEQ ID NO: 987735 - DNA, 25 bp, Mus musculus
ttcttctccacggtactacttgtcc

SEQ ID NO: 987736 - DNA, 25 bp, Mus musculus
ttcttctccacgttctaccacgcct

SEQ ID NO: 987737 - DNA, 25 bp, Mus musculus
ttcttctctgcacgtcaaatgtggg

SEQ ID NO: 987738 - DNA, 25 bp, Mus musculus
ttcttctctggacacaaatactacc

SEQ ID NO: 987739 - DNA, 25 bp, Mus musculus
ttcttctctggacgtcaaatgtggg

SEQ ID NO: 987740 - DNA, 25 bp, Mus musculus
ttcttctctggagacaaatactacc

SEQ ID NO: 987741 - DNA, 25 bp, Mus musculus
ttcttctgatgacctgggaagtcat

SEQ ID NO: 987742 - DNA, 25 bp, Mus musculus
ttcttctgatgagctgggaagtcat

SEQ ID NO: 987743 - DNA, 25 bp, Mus musculus
ttcttcttctctcgacgtcaaatgt

SEQ ID NO: 987744 - DNA, 25 bp, Mus musculus
ttcttcttctctggacgtcaaatgt

SEQ ID NO: 987745 - DNA, 25 bp, Mus musculus
ttcttcttgggtcacatcatggtct

SEQ ID NO: 987746 - DNA, 25 bp, Mus musculus
ttcttcttgggtcagatcatggtct

SEQ ID NO: 987747 - DNA, 25 bp, Mus musculus
ttcttgaaatcttacagattgatga

SEQ ID NO: 987748 - DNA, 25 bp, Mus musculus
ttcttgaaatcttagagattgatga

SEQ ID NO: 987749 - DNA, 25 bp, Mus musculus
ttcttgataacaccaccctgcagag

SEQ ID NO: 987750 - DNA, 25 bp, Mus musculus
ttcttgataacagcaccctgcagag

SEQ ID NO: 987751 - DNA, 25 bp, Mus musculus
ttcttgatcctgaacatgttgctac

SEQ ID NO: 987752 - DNA, 25 bp, Mus musculus
ttcttgatcctgaagatgttgctac

SEQ ID NO: 987753 - DNA, 25 bp, Mus musculus
ttcttgcagcagctctgctttgcct

SEQ ID NO: 987754 - DNA, 25 bp, Mus musculus
ttcttgcagcaggtctgctttgcct

SEQ ID NO: 987755 - DNA, 25 bp, Mus musculus
ttcttgcatgaatggagaaaagtcc

SEQ ID NO: 987756 - DNA, 25 bp, Mus musculus
ttcttgcatgcagaatggagaaaag

SEQ ID NO: 987757 - DNA, 25 bp, Mus musculus
ttcttgcatggagaatggagaaaag

SEQ ID NO: 987758 - DNA, 25 bp, Mus musculus
ttcttgcatgtatggagaaaagtcc

SEQ ID NO: 987759 - DNA, 25 bp, Mus musculus
ttcttgccattcaacgtggttgaaa

SEQ ID NO: 987760 - DNA, 25 bp, Mus musculus
ttcttgccattcaaggtggttgaaa

SEQ ID NO: 987761 - DNA, 25 bp, Mus musculus
ttcttgctctggcacacgtcccatt

SEQ ID NO: 987762 - DNA, 25 bp, Mus musculus
ttcttgctctggcagacgtcccatt

SEQ ID NO: 987763 - DNA, 25 bp, Mus musculus
ttcttggacggacatgcctggacca

SEQ ID NO: 987764 - DNA, 25 bp, Mus musculus
ttcttggacggagatgcctggacca

SEQ ID NO: 987765 - DNA, 25 bp, Mus musculus
ttcttggaggagggcaatgcgagca

SEQ ID NO: 987766 - DNA, 25 bp, Mus musculus
ttcttggaggtgggcaatgcgagca

SEQ ID NO: 987767 - DNA, 25 bp, Mus musculus
ttcttggagtcaggcgaaatgagca

SEQ ID NO: 987768 - DNA, 25 bp, Mus musculus
ttcttggagtcaggcgtcactagga

SEQ ID NO: 987769 - DNA, 25 bp, Mus musculus
ttcttggagtcaggggaaatgagca

SEQ ID NO: 987770 - DNA, 25 bp, Mus musculus
ttcttggagtcaggggtcactagga

SEQ ID NO: 987771 - DNA, 25 bp, Mus musculus
ttcttgggtcagatcatggtcttcg

SEQ ID NO: 987772 - DNA, 25 bp, Mus musculus
ttcttgggtcagttcatggtcttcg

SEQ ID NO: 987773 - DNA, 25 bp, Mus musculus
ttcttgtgtcagcaactagtggctg

SEQ ID NO: 987774 - DNA, 25 bp, Mus musculus
ttcttgtgtcaggaactagtggctg

SEQ ID NO: 987775 - DNA, 25 bp, Mus musculus
ttcttgttggcgatgtggctcaggc

SEQ ID NO: 987776 - DNA, 25 bp, Mus musculus
ttcttgttggggatgtggctcaggc

SEQ ID NO: 987777 - DNA, 25 bp, Mus musculus
ttcttgtttcagcaaatggctgcag

SEQ ID NO: 987778 - DNA, 25 bp, Mus musculus
ttcttgtttcagcacttcctccatc

SEQ ID NO: 987779 - DNA, 25 bp, Mus musculus
ttcttgtttcaggaaatggctgcag

SEQ ID NO: 987780 - DNA, 25 bp, Mus musculus
ttcttgtttcaggacttcctccatc

SEQ ID NO: 987781 - DNA, 25 bp, Mus musculus
ttcttgtttgatactttatgcatgg

SEQ ID NO: 987782 - DNA, 25 bp, Mus musculus
ttcttgtttgttactttatgcatgg

SEQ ID NO: 987783 - DNA, 25 bp, Mus musculus
ttctttaatgctatttacagtgtgg

SEQ ID NO: 987784 - DNA, 25 bp, Mus musculus
ttctttaatgctttttacagtgtgg

SEQ ID NO: 987785 - DNA, 25 bp, Mus musculus
ttctttactgaaaataagtaccata

SEQ ID NO: 987786 - DNA, 25 bp, Mus musculus
ttctttactgaatataagtaccata

SEQ ID NO: 987787 - DNA, 25 bp, Mus musculus
ttctttagacagcgtgacagagaag

SEQ ID NO: 987788 - DNA, 25 bp, Mus musculus
ttctttagacagggtgacagagaag

SEQ ID NO: 987789 - DNA, 25 bp, Mus musculus
ttctttagcactcggctaaagtatc

SEQ ID NO: 987790 - DNA, 25 bp, Mus musculus
ttctttagcactgggctaaagtatc

SEQ ID NO: 987791 - DNA, 25 bp, Mus musculus
ttctttatctagcagacgaccgaaa

SEQ ID NO: 987792 - DNA, 25 bp, Mus musculus
ttctttatctaggagacgaccgaaa

SEQ ID NO: 987793 - DNA, 25 bp, Mus musculus
ttctttcccgctcaatctgtgtgga

SEQ ID NO: 987794 - DNA, 25 bp, Mus musculus
ttctttcccggtcaatctgtgtgga

SEQ ID NO: 987795 - DNA, 25 bp, Mus musculus
ttctttcctggactaggtgacatgt

SEQ ID NO: 987796 - DNA, 25 bp, Mus musculus
ttctttcctggagtaggtgacatgt

SEQ ID NO: 987797 - DNA, 25 bp, Mus musculus
ttctttctctcacccaaagccttct

SEQ ID NO: 987798 - DNA, 25 bp, Mus musculus
ttctttctctcagccaaagccttct

SEQ ID NO: 987799 - DNA, 25 bp, Mus musculus
ttctttctgacgtgtcagatgcccg

SEQ ID NO: 987800 - DNA, 25 bp, Mus musculus
ttctttctgaggtgtcagatgcccg

SEQ ID NO: 987801 - DNA, 25 bp, Mus musculus
ttctttgacatcagtgatgagagta

SEQ ID NO: 987802 - DNA, 25 bp, Mus musculus
ttctttgacatctgtgatgagagta

SEQ ID NO: 987803 - DNA, 25 bp, Mus musculus
ttctttgacatgagccagtggaggc

SEQ ID NO: 987804 - DNA, 25 bp, Mus musculus
ttctttgacatgtgccagtggaggc

SEQ ID NO: 987805 - DNA, 25 bp, Mus musculus
ttctttgatccacatgccaaggggc

SEQ ID NO: 987806 - DNA, 25 bp, Mus musculus
ttctttgatccagatgccaaggggc

SEQ ID NO: 987807 - DNA, 25 bp, Mus musculus
ttcttttcacaaagctcatgatctc

SEQ ID NO: 987808 - DNA, 25 bp, Mus musculus
ttcttttcacaatgctcatgatctc

SEQ ID NO: 987809 - DNA, 25 bp, Mus musculus
ttcttttgaatccgagacagttccc

SEQ ID NO: 987810 - DNA, 25 bp, Mus musculus
ttcttttgaatcggagacagttccc

SEQ ID NO: 987811 - DNA, 25 bp, Mus musculus
ttgaaaaagaaacatcattactcct

SEQ ID NO: 987812 - DNA, 25 bp, Mus musculus
ttgaaaaagaaagatcattactcct

SEQ ID NO: 987813 - DNA, 25 bp, Mus musculus
ttgaaaaatgaaaaagtggatagac

SEQ ID NO: 987814 - DNA, 25 bp, Mus musculus
ttgaaaaatgaaaatgtggatagac

SEQ ID NO: 987815 - DNA, 25 bp, Mus musculus
ttgaaaactttagacctgccgcatg

SEQ ID NO: 987816 - DNA, 25 bp, Mus musculus
ttgaaaactttagagctgccgcatg

SEQ ID NO: 987817 - DNA, 25 bp, Mus musculus
ttgaaaagaaatacaaagatgactc

SEQ ID NO: 987818 - DNA, 25 bp, Mus musculus
ttgaaaagaaattcaaagatgactc

SEQ ID NO: 987819 - DNA, 25 bp, Mus musculus
ttgaaaagagaatgcctgtactcca

SEQ ID NO: 987820 - DNA, 25 bp, Mus musculus
ttgaaaagagaatggctgtactcca

SEQ ID NO: 987821 - DNA, 25 bp, Mus musculus
ttgaaaataaatggcaaccagaacg

SEQ ID NO: 987822 - DNA, 25 bp, Mus musculus
ttgaaaataattggcaaccagaacg

SEQ ID NO: 987823 - DNA, 25 bp, Mus musculus
ttgaaacaatggcaatactagctat

SEQ ID NO: 987824 - DNA, 25 bp, Mus musculus
ttgaaacaatggcattactagctat

SEQ ID NO: 987825 - DNA, 25 bp, Mus musculus
ttgaaacatgcacgtatgggttcat

SEQ ID NO: 987826 - DNA, 25 bp, Mus musculus
ttgaaacatgcaggtatgggttcat

SEQ ID NO: 987827 - DNA, 25 bp, Mus musculus
ttgaaaccaaaagaaggcctggcac

SEQ ID NO: 987828 - DNA, 25 bp, Mus musculus
ttgaaaccaaaagatggcctggcac

SEQ ID NO: 987829 - DNA, 25 bp, Mus musculus
ttgaaagcagccgctaacgtcctga

SEQ ID NO: 987830 - DNA, 25 bp, Mus musculus
ttgaaagcaggcgctaacgtcctga

SEQ ID NO: 987831 - DNA, 25 bp, Mus musculus
ttgaaaggaattccagatggtcaaa

SEQ ID NO: 987832 - DNA, 25 bp, Mus musculus
ttgaaaggaattgcagatggtcaaa

SEQ ID NO: 987833 - DNA, 25 bp, Mus musculus
ttgaaaggcaagcgacccacatcac

SEQ ID NO: 987834 - DNA, 25 bp, Mus musculus
ttgaaaggcaagggacccacatcac

SEQ ID NO: 987835 - DNA, 25 bp, Mus musculus
ttgaaagttttcacagctattgcag

SEQ ID NO: 987836 - DNA, 25 bp, Mus musculus
ttgaaagttttcactgctattgcag

SEQ ID NO: 987837 - DNA, 25 bp, Mus musculus
ttgaaataccaaatcacttcacctt

SEQ ID NO: 987838 - DNA, 25 bp, Mus musculus
ttgaaataccaaatgacttcacctt

SEQ ID NO: 987839 - DNA, 25 bp, Mus musculus
ttgaaatcttagagattgatgacct

SEQ ID NO: 987840 - DNA, 25 bp, Mus musculus
ttgaaatcttagtgattgatgacct

SEQ ID NO: 987841 - DNA, 25 bp, Mus musculus
ttgaacaaaacaagaatgtcattgc

SEQ ID NO: 987842 - DNA, 25 bp, Mus musculus
ttgaacaaaacatgaatgtcattgc

SEQ ID NO: 987843 - DNA, 25 bp, Mus musculus
ttgaacagctcgacatgcgtcggga

SEQ ID NO: 987844 - DNA, 25 bp, Mus musculus
ttgaacagctcgtcatgcgtcggga

SEQ ID NO: 987845 - DNA, 25 bp, Mus musculus
ttgaacatccactgcattcgaatga

SEQ ID NO: 987846 - DNA, 25 bp, Mus musculus
ttgaacatccactggattcgaatga

SEQ ID NO: 987847 - DNA, 25 bp, Mus musculus
ttgaacattgacccactgcagtgtg

SEQ ID NO: 987848 - DNA, 25 bp, Mus musculus
ttgaacattgacgcactgcagtgtg

SEQ ID NO: 987849 - DNA, 25 bp, Mus musculus
ttgaaccccagactgcctactccag

SEQ ID NO: 987850 - DNA, 25 bp, Mus musculus
ttgaaccccagagtgcctactccag

SEQ ID NO: 987851 - DNA, 25 bp, Mus musculus
ttgaacctcatccactcctgggctg

SEQ ID NO: 987852 - DNA, 25 bp, Mus musculus
ttgaacctcatccagtcctgggctg

SEQ ID NO: 987853 - DNA, 25 bp, Mus musculus
ttgaacctttcgtcagaaagcatgg

SEQ ID NO: 987854 - DNA, 25 bp, Mus musculus
ttgaacctttggtcagaaagcatgg

SEQ ID NO: 987855 - DNA, 25 bp, Mus musculus
ttgaacggtgcacatgtcgacgatt

SEQ ID NO: 987856 - DNA, 25 bp, Mus musculus
ttgaacggtgcagatgtcgacgatt

SEQ ID NO: 987857 - DNA, 25 bp, Mus musculus
ttgaactagcaaccttgcagggctt

SEQ ID NO: 987858 - DNA, 25 bp, Mus musculus
ttgaactagcaagcttgcagggctt

SEQ ID NO: 987859 - DNA, 25 bp, Mus musculus
ttgaagaaccagcgtgccaagttag

SEQ ID NO: 987860 - DNA, 25 bp, Mus musculus
ttgaagaaccagggtgccaagttag

SEQ ID NO: 987861 - DNA, 25 bp, Mus musculus
ttgaagaagaagcacatcaaatttg

SEQ ID NO: 987862 - DNA, 25 bp, Mus musculus
ttgaagaagaagcagatcaaatttg

SEQ ID NO: 987863 - DNA, 25 bp, Mus musculus
ttgaagaatttcaacactgcgagtg

SEQ ID NO: 987864 - DNA, 25 bp, Mus musculus
ttgaagaatttcaagactgcgagtg

SEQ ID NO: 987865 - DNA, 25 bp, Mus musculus
ttgaagatgattttcgaagttgctt

SEQ ID NO: 987866 - DNA, 25 bp, Mus musculus
ttgaagatgattttggaagttgctt

SEQ ID NO: 987867 - DNA, 25 bp, Mus musculus
ttgaagcaaaaccacaccccgcagg

SEQ ID NO: 987868 - DNA, 25 bp, Mus musculus
ttgaagcaaaaccagaccccgcagg

SEQ ID NO: 987869 - DNA, 25 bp, Mus musculus
ttgaagcagcaggcaatttgtaaaa

SEQ ID NO: 987870 - DNA, 25 bp, Mus musculus
ttgaagcagccacgcaatttgtaaa

SEQ ID NO: 987871 - DNA, 25 bp, Mus musculus
ttgaagcagccaggcaatttgtaaa

SEQ ID NO: 987872 - DNA, 25 bp, Mus musculus
ttgaagcagctggcaatttgtaaaa

SEQ ID NO: 987873 - DNA, 25 bp, Mus musculus
ttgaagcatttaatccctcctgcct

SEQ ID NO: 987874 - DNA, 25 bp, Mus musculus
ttgaagcatttaatgcctcctgcct

SEQ ID NO: 987875 - DNA, 25 bp, Mus musculus
ttgaagccagctgtttggccttggt

SEQ ID NO: 987876 - DNA, 25 bp, Mus musculus
ttgaagccaggtgtttggccttggt

SEQ ID NO: 987877 - DNA, 25 bp, Mus musculus
ttgaagccttcaagccgccccccac

SEQ ID NO: 987878 - DNA, 25 bp, Mus musculus
ttgaagccttcaagctgaagtacat

SEQ ID NO: 987879 - DNA, 25 bp, Mus musculus
ttgaagccttcaaggcgccccccac

SEQ ID NO: 987880 - DNA, 25 bp, Mus musculus
ttgaagccttcaaggtgaagtacat

SEQ ID NO: 987881 - DNA, 25 bp, Mus musculus
ttgaaggaagagcggatatgtggta

SEQ ID NO: 987882 - DNA, 25 bp, Mus musculus
ttgaaggaagaggggatatgtggta

SEQ ID NO: 987883 - DNA, 25 bp, Mus musculus
ttgaaggatcaacgcagagatgctt

SEQ ID NO: 987884 - DNA, 25 bp, Mus musculus
ttgaaggatcaaggcagagatgctt

SEQ ID NO: 987885 - DNA, 25 bp, Mus musculus
ttgaaggcaaagaatcctgtagagc

SEQ ID NO: 987886 - DNA, 25 bp, Mus musculus
ttgaaggcaaagtatcctgtagagc

SEQ ID NO: 987887 - DNA, 25 bp, Mus musculus
ttgaaggcaacacaatgaagggacc

SEQ ID NO: 987888 - DNA, 25 bp, Mus musculus
ttgaaggcaacagaatgaagggacc

SEQ ID NO: 987889 - DNA, 25 bp, Mus musculus
ttgaaggcaacatccctgtgggcaa

SEQ ID NO: 987890 - DNA, 25 bp, Mus musculus
ttgaaggcaacatccgatggcactt

SEQ ID NO: 987891 - DNA, 25 bp, Mus musculus
ttgaaggcaacatcgctgtgggcaa

SEQ ID NO: 987892 - DNA, 25 bp, Mus musculus
ttgaaggcaacatcggatggcactt

SEQ ID NO: 987893 - DNA, 25 bp, Mus musculus
ttgaaggcccagccggatatctaca

SEQ ID NO: 987894 - DNA, 25 bp, Mus musculus
ttgaaggcccaggcggatatctaca

SEQ ID NO: 987895 - DNA, 25 bp, Mus musculus
ttgaagggagcttgcctgttgccag

SEQ ID NO: 987896 - DNA, 25 bp, Mus musculus
ttgaagggaggttgcctgttgccag

SEQ ID NO: 987897 - DNA, 25 bp, Mus musculus
ttgaaggggctgaactatatccatg

SEQ ID NO: 987898 - DNA, 25 bp, Mus musculus
ttgaaggggctgaagtatatccatg

SEQ ID NO: 987899 - DNA, 25 bp, Mus musculus
ttgaagtcaacacatttgctcttgc

SEQ ID NO: 987900 - DNA, 25 bp, Mus musculus
ttgaagtcaacagatttgctcttgc

SEQ ID NO: 987901 - DNA, 25 bp, Mus musculus
ttgaagtgaaagcagatttctaata

SEQ ID NO: 987902 - DNA, 25 bp, Mus musculus
ttgaagtgaaagctgctcctgacat

SEQ ID NO: 987903 - DNA, 25 bp, Mus musculus
ttgaagtgaaaggagatttctaata

SEQ ID NO: 987904 - DNA, 25 bp, Mus musculus
ttgaagtgaaaggtgctcctgacat

SEQ ID NO: 987905 - DNA, 25 bp, Mus musculus
ttgaagtgttatacacaccaacagc

SEQ ID NO: 987906 - DNA, 25 bp, Mus musculus
ttgaagtgttattcacaccaacagc

SEQ ID NO: 987907 - DNA, 25 bp, Mus musculus
ttgaatacagcactcctgaaatttt

SEQ ID NO: 987908 - DNA, 25 bp, Mus musculus
ttgaatacaggactcctgaaatttt

SEQ ID NO: 987909 - DNA, 25 bp, Mus musculus
ttgaatatagacctgaaaaccatct

SEQ ID NO: 987910 - DNA, 25 bp, Mus musculus
ttgaatatagtcctgaaaaccatct

SEQ ID NO: 987911 - DNA, 25 bp, Mus musculus
ttgaatatcaagcggctgagaaaga

SEQ ID NO: 987912 - DNA, 25 bp, Mus musculus
ttgaatatcaaggggctgagaaaga

SEQ ID NO: 987913 - DNA, 25 bp, Mus musculus
ttgaatccagaacacattgatcagc

SEQ ID NO: 987914 - DNA, 25 bp, Mus musculus
ttgaatccagaagacattgatcagc

SEQ ID NO: 987915 - DNA, 25 bp, Mus musculus
ttgaatctgaagaggtagaagatga

SEQ ID NO: 987916 - DNA, 25 bp, Mus musculus
ttgaatctgaagtggtagaagatga

SEQ ID NO: 987917 - DNA, 25 bp, Mus musculus
ttgaatgaaacaagattttggtatc

SEQ ID NO: 987918 - DNA, 25 bp, Mus musculus
ttgaatgaaacatgattttggtatc

SEQ ID NO: 987919 - DNA, 25 bp, Mus musculus
ttgaatgtaacacattgccacactg

SEQ ID NO: 987920 - DNA, 25 bp, Mus musculus
ttgaatgtaacagattgccacactg

SEQ ID NO: 987921 - DNA, 25 bp, Mus musculus
ttgaattccaggatgagaacagcaa

SEQ ID NO: 987922 - DNA, 25 bp, Mus musculus
ttgaattccaggttgagaacagcaa

SEQ ID NO: 987923 - DNA, 25 bp, Mus musculus
ttgaattggttaaacatcggaccaa

SEQ ID NO: 987924 - DNA, 25 bp, Mus musculus
ttgaattggttaaagatcggaccaa

SEQ ID NO: 987925 - DNA, 25 bp, Mus musculus
ttgaatttttcaccccgtttgctta

SEQ ID NO: 987926 - DNA, 25 bp, Mus musculus
ttgaatttttcagcccgtttgctta

SEQ ID NO: 987927 - DNA, 25 bp, Mus musculus
ttgacaaaaacaccttatagagcac

SEQ ID NO: 987928 - DNA, 25 bp, Mus musculus
ttgacaaaaacagcttatagagcac

SEQ ID NO: 987929 - DNA, 25 bp, Mus musculus
ttgacaaagccacctaccgagtcta

SEQ ID NO: 987930 - DNA, 25 bp, Mus musculus
ttgacaaagccagctaccgagtcta

SEQ ID NO: 987931 - DNA, 25 bp, Mus musculus
ttgacaaagtaatcgaccttccacc

SEQ ID NO: 987932 - DNA, 25 bp, Mus musculus
ttgacaaagttatcgaccttccacc

SEQ ID NO: 987933 - DNA, 25 bp, Mus musculus
ttgacaaatgcgaacagtctggtaa

SEQ ID NO: 987934 - DNA, 25 bp, Mus musculus
ttgacaaatgggaacagtctggtaa

SEQ ID NO: 987935 - DNA, 25 bp, Mus musculus
ttgacaatagctctggtgcaagtgt

SEQ ID NO: 987936 - DNA, 25 bp, Mus musculus
ttgacaataggtctggtgcaagtgt

SEQ ID NO: 987937 - DNA, 25 bp, Mus musculus
ttgacaatatcacgctggtttacaa

SEQ ID NO: 987938 - DNA, 25 bp, Mus musculus
ttgacaatatcaggctggtttacaa

SEQ ID NO: 987939 - DNA, 25 bp, Mus musculus
ttgacaatgaaacccagaaaattag

SEQ ID NO: 987940 - DNA, 25 bp, Mus musculus
ttgacaatgaaagccagaaaattag

SEQ ID NO: 987941 - DNA, 25 bp, Mus musculus
ttgacaattgggacattgaagaagc

SEQ ID NO: 987942 - DNA, 25 bp, Mus musculus
ttgacaattgggtcattgaagaagc

SEQ ID NO: 987943 - DNA, 25 bp, Mus musculus
ttgacacagtggacccagatacttc

SEQ ID NO: 987944 - DNA, 25 bp, Mus musculus
ttgacacagtggtcccagatacttc

SEQ ID NO: 987945 - DNA, 25 bp, Mus musculus
ttgacacttaagcgctacttgatta

SEQ ID NO: 987946 - DNA, 25 bp, Mus musculus
ttgacacttaagggctacttgatta

SEQ ID NO: 987947 - DNA, 25 bp, Mus musculus
ttgacagagttaaaatgcttaaagc

SEQ ID NO: 987948 - DNA, 25 bp, Mus musculus
ttgacagagttaaattgcttaaagc

SEQ ID NO: 987949 - DNA, 25 bp, Mus musculus
ttgacagcaaagcctcccggattct

SEQ ID NO: 987950 - DNA, 25 bp, Mus musculus
ttgacagcaaaggctcccggattct

SEQ ID NO: 987951 - DNA, 25 bp, Mus musculus
ttgacagccctcgacgggacattgg

SEQ ID NO: 987952 - DNA, 25 bp, Mus musculus
ttgacagccctcgaggggacattgg

SEQ ID NO: 987953 - DNA, 25 bp, Mus musculus
ttgacagcctttcacttccagagac

SEQ ID NO: 987954 - DNA, 25 bp, Mus musculus
ttgacagcctttcagttccagagac

SEQ ID NO: 987955 - DNA, 25 bp, Mus musculus
ttgacatagcctgcagggtccacca

SEQ ID NO: 987956 - DNA, 25 bp, Mus musculus
ttgacatagcctgctgggtccacca

SEQ ID NO: 987957 - DNA, 25 bp, Mus musculus
ttgacataggcaacgtctagctcgt

SEQ ID NO: 987958 - DNA, 25 bp, Mus musculus
ttgacataggctcgttcaggcctgt

SEQ ID NO: 987959 - DNA, 25 bp, Mus musculus
ttgacatagggaacgtctagctcgt

SEQ ID NO: 987960 - DNA, 25 bp, Mus musculus
ttgacatagggtcgttcaggcctgt

SEQ ID NO: 987961 - DNA, 25 bp, Mus musculus
ttgacatctgctcctttggggtggt

SEQ ID NO: 987962 - DNA, 25 bp, Mus musculus
ttgacatctggtcctttggggtggt

SEQ ID NO: 987963 - DNA, 25 bp, Mus musculus
ttgacatgtgcggagttggctgtat

SEQ ID NO: 987964 - DNA, 25 bp, Mus musculus
ttgacatgtggggagttggctgtat

SEQ ID NO: 987965 - DNA, 25 bp, Mus musculus
ttgaccaacttcaggatgttttcct

SEQ ID NO: 987966 - DNA, 25 bp, Mus musculus
ttgaccaacttctggatgttttcct

SEQ ID NO: 987967 - DNA, 25 bp, Mus musculus
ttgaccacactgcttcggagtgccg

SEQ ID NO: 987968 - DNA, 25 bp, Mus musculus
ttgaccacactggttcggagtgccg

SEQ ID NO: 987969 - DNA, 25 bp, Mus musculus
ttgaccactacgcacgaggattaca

SEQ ID NO: 987970 - DNA, 25 bp, Mus musculus
ttgaccactacgcacttaccgtgac

SEQ ID NO: 987971 - DNA, 25 bp, Mus musculus
ttgaccactacgcaggaggattaca

SEQ ID NO: 987972 - DNA, 25 bp, Mus musculus
ttgaccactacgcagttaccgtgac

SEQ ID NO: 987973 - DNA, 25 bp, Mus musculus
ttgaccagactgccgctctccacct

SEQ ID NO: 987974 - DNA, 25 bp, Mus musculus
ttgaccagactggcgctctccacct

SEQ ID NO: 987975 - DNA, 25 bp, Mus musculus
ttgaccccagcccctgcaggtcgga

SEQ ID NO: 987976 - DNA, 25 bp, Mus musculus
ttgaccccaggccctgcaggtcgga

SEQ ID NO: 987977 - DNA, 25 bp, Mus musculus
ttgacccttgcgatccttgcacttg

SEQ ID NO: 987978 - DNA, 25 bp, Mus musculus
ttgacccttgcgttccttgcacttg

SEQ ID NO: 987979 - DNA, 25 bp, Mus musculus
ttgaccgcacagctactgagacaga

SEQ ID NO: 987980 - DNA, 25 bp, Mus musculus
ttgaccgcacaggtactgagacaga

SEQ ID NO: 987981 - DNA, 25 bp, Mus musculus
ttgacctccaaccacgagtatctgg

SEQ ID NO: 987982 - DNA, 25 bp, Mus musculus
ttgacctccaaccaggagtatctgg

SEQ ID NO: 987983 - DNA, 25 bp, Mus musculus
ttgacctgaaaacgaaacctgcaga

SEQ ID NO: 987984 - DNA, 25 bp, Mus musculus
ttgacctgaaaaggaaacctgcaga

SEQ ID NO: 987985 - DNA, 25 bp, Mus musculus
ttgacctgaaacatcctataaatga

SEQ ID NO: 987986 - DNA, 25 bp, Mus musculus
ttgacctgaatcatcctataaatga

SEQ ID NO: 987987 - DNA, 25 bp, Mus musculus
ttgacctgttccacatcgggcacgt

SEQ ID NO: 987988 - DNA, 25 bp, Mus musculus
ttgacctgttcctcatcgggcacgt

SEQ ID NO: 987989 - DNA, 25 bp, Mus musculus
ttgacgtcgtggaacgatctccgca

SEQ ID NO: 987990 - DNA, 25 bp, Mus musculus
ttgacgtcgtggtacgatctccgca

SEQ ID NO: 987991 - DNA, 25 bp, Mus musculus
ttgacgttatagatgttatcccact

SEQ ID NO: 987992 - DNA, 25 bp, Mus musculus
ttgacgttatagttgttatcccact

SEQ ID NO: 987993 - DNA, 25 bp, Mus musculus
ttgactgcagctccctggaaacaag

SEQ ID NO: 987994 - DNA, 25 bp, Mus musculus
ttgactgcaggtccctggaaacaag

SEQ ID NO: 987995 - DNA, 25 bp, Mus musculus
ttgacttacaagcagtgggagaaaa

SEQ ID NO: 987996 - DNA, 25 bp, Mus musculus
ttgacttacaaggagtgggagaaaa

SEQ ID NO: 987997 - DNA, 25 bp, Mus musculus
ttgacttcagacagcactctagcaa

SEQ ID NO: 987998 - DNA, 25 bp, Mus musculus
ttgacttcagacaggactctagcaa

SEQ ID NO: 987999 - DNA, 25 bp, Mus musculus
ttgacttctgctaagcggtacatcg

SEQ ID NO: 988000 - DNA, 25 bp, Mus musculus
ttgacttctggtaagcggtacatcg

SEQ ID NO: 988001 - DNA, 25 bp, Mus musculus
ttgactttgaagcttgtcttgacac

SEQ ID NO: 988002 - DNA, 25 bp, Mus musculus
ttgactttgaaggttgtcttgacac

SEQ ID NO: 988003 - DNA, 25 bp, Mus musculus
ttgagaaacatgctcgtggctggga

SEQ ID NO: 988004 - DNA, 25 bp, Mus musculus
ttgagaaacatgctcgtggtgtcac

SEQ ID NO: 988005 - DNA, 25 bp, Mus musculus
ttgagaaacatgctggtggctggga

SEQ ID NO: 988006 - DNA, 25 bp, Mus musculus
ttgagaaacatgctggtggtgtcac

SEQ ID NO: 988007 - DNA, 25 bp, Mus musculus
ttgagaacaacacgaacctgaggag

SEQ ID NO: 988008 - DNA, 25 bp, Mus musculus
ttgagaacaacacgactccgggaga

SEQ ID NO: 988009 - DNA, 25 bp, Mus musculus
ttgagaacaacaggaacctgaggag

SEQ ID NO: 988010 - DNA, 25 bp, Mus musculus
ttgagaacaacaggactccgggaga

SEQ ID NO: 988011 - DNA, 25 bp, Mus musculus
ttgagaagctggctatcagtaccat

SEQ ID NO: 988012 - DNA, 25 bp, Mus musculus
ttgagaagctgggtatcagtaccat

SEQ ID NO: 988013 - DNA, 25 bp, Mus musculus
ttgagaatcttccgcggcaggcctg

SEQ ID NO: 988014 - DNA, 25 bp, Mus musculus
ttgagaatcttcggcggcaggcctg

SEQ ID NO: 988015 - DNA, 25 bp, Mus musculus
ttgagacaccgacagtgtgggttcg

SEQ ID NO: 988016 - DNA, 25 bp, Mus musculus
ttgagacaccgagagtgtgggttcg

SEQ ID NO: 988017 - DNA, 25 bp, Mus musculus
ttgagagagaagaaattttccacca

SEQ ID NO: 988018 - DNA, 25 bp, Mus musculus
ttgagagagaagtaattttccacca

SEQ ID NO: 988019 - DNA, 25 bp, Mus musculus
ttgagagagctgcaagcaggggtag

SEQ ID NO: 988020 - DNA, 25 bp, Mus musculus
ttgagagagctgcatgcaggggtag

SEQ ID NO: 988021 - DNA, 25 bp, Mus musculus
ttgagaggctgctccattatgtccc

SEQ ID NO: 988022 - DNA, 25 bp, Mus musculus
ttgagaggctgctcgattatgtccc

SEQ ID NO: 988023 - DNA, 25 bp, Mus musculus
ttgagaggggcacgtggcagctcag

SEQ ID NO: 988024 - DNA, 25 bp, Mus musculus
ttgagaggggcaggtggcagctcag

SEQ ID NO: 988025 - DNA, 25 bp, Mus musculus
ttgagataaaagccagagttactta

SEQ ID NO: 988026 - DNA, 25 bp, Mus musculus
ttgagataaatgccagagttactta

SEQ ID NO: 988027 - DNA, 25 bp, Mus musculus
ttgagcaagcagagctggacagtga

SEQ ID NO: 988028 - DNA, 25 bp, Mus musculus
ttgagcaagcagtgctggacagtga

SEQ ID NO: 988029 - DNA, 25 bp, Mus musculus
ttgagcacaggacacaatctggagc

SEQ ID NO: 988030 - DNA, 25 bp, Mus musculus
ttgagcacaggagacaatctggagc

SEQ ID NO: 988031 - DNA, 25 bp, Mus musculus
ttgagcaccacctcttccccactat

SEQ ID NO: 988032 - DNA, 25 bp, Mus musculus
ttgagcaccagctcttccccactat

SEQ ID NO: 988033 - DNA, 25 bp, Mus musculus
ttgagcagaagtcacaaattacact

SEQ ID NO: 988034 - DNA, 25 bp, Mus musculus
ttgagcagaagtcagaaattacact

SEQ ID NO: 988035 - DNA, 25 bp, Mus musculus
ttgagcagctgacacacctgaagag

SEQ ID NO: 988036 - DNA, 25 bp, Mus musculus
ttgagcagctgacagacctgaagag

SEQ ID NO: 988037 - DNA, 25 bp, Mus musculus
ttgagcagggagatggcggtaaatg

SEQ ID NO: 988038 - DNA, 25 bp, Mus musculus
ttgagcagggagttggcggtaaatg

SEQ ID NO: 988039 - DNA, 25 bp, Mus musculus
ttgagccagagttacgtgtcaagac

SEQ ID NO: 988040 - DNA, 25 bp, Mus musculus
ttgagccagagttaggtgtcaagac

SEQ ID NO: 988041 - DNA, 25 bp, Mus musculus
ttgagcgcttagcagacaagcaatt

SEQ ID NO: 988042 - DNA, 25 bp, Mus musculus
ttgagcgcttaggagacaagcaatt

SEQ ID NO: 988043 - DNA, 25 bp, Mus musculus
ttgagctactcacgcctgcctactt

SEQ ID NO: 988044 - DNA, 25 bp, Mus musculus
ttgagctactcacgtcaaggctttg

SEQ ID NO: 988045 - DNA, 25 bp, Mus musculus
ttgagctactcaggcctgcctactt

SEQ ID NO: 988046 - DNA, 25 bp, Mus musculus
ttgagctactcaggtcaaggctttg

SEQ ID NO: 988047 - DNA, 25 bp, Mus musculus
ttgagctcctcattcgaagcaatcc

SEQ ID NO: 988048 - DNA, 25 bp, Mus musculus
ttgagctcctcattggaagcaatcc

SEQ ID NO: 988049 - DNA, 25 bp, Mus musculus
ttgagctggctgcgtttgactctgc

SEQ ID NO: 988050 - DNA, 25 bp, Mus musculus
ttgagctggctgctgctggcatgaa

SEQ ID NO: 988051 - DNA, 25 bp, Mus musculus
ttgagctggctgggtttgactctgc

SEQ ID NO: 988052 - DNA, 25 bp, Mus musculus
ttgagctggctggtgctggcatgaa

SEQ ID NO: 988053 - DNA, 25 bp, Mus musculus
ttgaggaatggaagcgtgtgactta

SEQ ID NO: 988054 - DNA, 25 bp, Mus musculus
ttgaggaatggaagggtgtgactta

SEQ ID NO: 988055 - DNA, 25 bp, Mus musculus
ttgaggacaatgcttccttggattc

SEQ ID NO: 988056 - DNA, 25 bp, Mus musculus
ttgaggacaatggttccttggattc

SEQ ID NO: 988057 - DNA, 25 bp, Mus musculus
ttgaggaggaagcccaggtgccccc

SEQ ID NO: 988058 - DNA, 25 bp, Mus musculus
ttgaggaggaaggccaggtgccccc

SEQ ID NO: 988059 - DNA, 25 bp, Mus musculus
ttgaggattctgagagggaggagac

SEQ ID NO: 988060 - DNA, 25 bp, Mus musculus
ttgaggattctgagtgggaggagac

SEQ ID NO: 988061 - DNA, 25 bp, Mus musculus
ttgaggcaagagcctaaagaaggtg

SEQ ID NO: 988062 - DNA, 25 bp, Mus musculus
ttgaggcaagaggctaaagaaggtg

SEQ ID NO: 988063 - DNA, 25 bp, Mus musculus
ttgaggcagaatgcaatcaaaagcc

SEQ ID NO: 988064 - DNA, 25 bp, Mus musculus
ttgaggcagaatgctatcaaaagcc

SEQ ID NO: 988065 - DNA, 25 bp, Mus musculus
ttgaggccagcttcttccatttggc

SEQ ID NO: 988066 - DNA, 25 bp, Mus musculus
ttgaggccaggttcttccatttggc

SEQ ID NO: 988067 - DNA, 25 bp, Mus musculus
ttgaggccgtgaagagtgagccggt

SEQ ID NO: 988068 - DNA, 25 bp, Mus musculus
ttgaggccgtgaagtgtgagccggt

SEQ ID NO: 988069 - DNA, 25 bp, Mus musculus
ttgagggagcagaaggacaggcaga

SEQ ID NO: 988070 - DNA, 25 bp, Mus musculus
ttgagggagcagtaggacaggcaga

SEQ ID NO: 988071 - DNA, 25 bp, Mus musculus
ttgagggcagcctggacactgcaac

SEQ ID NO: 988072 - DNA, 25 bp, Mus musculus
ttgagggcaggctggacactgcaac

SEQ ID NO: 988073 - DNA, 25 bp, Mus musculus
ttgagggcctcgagaatggctctga

SEQ ID NO: 988074 - DNA, 25 bp, Mus musculus
ttgagggcctcgtgaatggctctga

SEQ ID NO: 988075 - DNA, 25 bp, Mus musculus
ttgaggtcttcacatttggaaataa

SEQ ID NO: 988076 - DNA, 25 bp, Mus musculus
ttgaggtcttcagatttggaaataa

SEQ ID NO: 988077 - DNA, 25 bp, Mus musculus
ttgagtacaagaagaatcgcggcgg

SEQ ID NO: 988078 - DNA, 25 bp, Mus musculus
ttgagtacaagatgaatcgcggcgg

SEQ ID NO: 988079 - DNA, 25 bp, Mus musculus
ttgagtacagctgatttgaactgtg

SEQ ID NO: 988080 - DNA, 25 bp, Mus musculus
ttgagtacaggtctgtaccacaaca

SEQ ID NO: 988081 - DNA, 25 bp, Mus musculus
ttgagtacaggtgatttgaactgtg

SEQ ID NO: 988082 - DNA, 25 bp, Mus musculus
ttgagtacaggtgtgtaccacaaca

SEQ ID NO: 988083 - DNA, 25 bp, Mus musculus
ttgagtacatcgccccagagattct

SEQ ID NO: 988084 - DNA, 25 bp, Mus musculus
ttgagtacatggccccagagattct

SEQ ID NO: 988085 - DNA, 25 bp, Mus musculus
ttgagtatatggcaagtactggaga

SEQ ID NO: 988086 - DNA, 25 bp, Mus musculus
ttgagtatatggcgcagagcccggg

SEQ ID NO: 988087 - DNA, 25 bp, Mus musculus
ttgagtatatgggaagtactggaga

SEQ ID NO: 988088 - DNA, 25 bp, Mus musculus
ttgagtatatggggcagagcccggg

SEQ ID NO: 988089 - DNA, 25 bp, Mus musculus
ttgagtattgggaatattacagcca

SEQ ID NO: 988090 - DNA, 25 bp, Mus musculus
ttgagtattgggtatattacagcca

SEQ ID NO: 988091 - DNA, 25 bp, Mus musculus
ttgagtccagcttcacattgagatc

SEQ ID NO: 988092 - DNA, 25 bp, Mus musculus
ttgagtccaggttcacattgagatc

SEQ ID NO: 988093 - DNA, 25 bp, Mus musculus
ttgagtctacagctttgtacagcgc

SEQ ID NO: 988094 - DNA, 25 bp, Mus musculus
ttgagtctacaggtttgtacagcgc

SEQ ID NO: 988095 - DNA, 25 bp, Mus musculus
ttgagtctgcagcgtaggtttggca

SEQ ID NO: 988096 - DNA, 25 bp, Mus musculus
ttgagtctgcagcgtttggcatgac

SEQ ID NO: 988097 - DNA, 25 bp, Mus musculus
ttgagtctgcagggtaggtttggca

SEQ ID NO: 988098 - DNA, 25 bp, Mus musculus
ttgagtctgcagggtttggcatgac

SEQ ID NO: 988099 - DNA, 25 bp, Mus musculus
ttgagttacttagtcgagagaacag

SEQ ID NO: 988100 - DNA, 25 bp, Mus musculus
ttgagttacttagtcgtgagacgtg

SEQ ID NO: 988101 - DNA, 25 bp, Mus musculus
ttgagttacttagtggagagaacag

SEQ ID NO: 988102 - DNA, 25 bp, Mus musculus
ttgagttacttagtggtgagacgtg

SEQ ID NO: 988103 - DNA, 25 bp, Mus musculus
ttgataaaacatcctggaggcattc

SEQ ID NO: 988104 - DNA, 25 bp, Mus musculus
ttgataaaacatcgcattctgcatt

SEQ ID NO: 988105 - DNA, 25 bp, Mus musculus
ttgataaaacatgctggaggcattc

SEQ ID NO: 988106 - DNA, 25 bp, Mus musculus
ttgataaaacatggcattctgcatt

SEQ ID NO: 988107 - DNA, 25 bp, Mus musculus
ttgataacagcaccctgcagagtga

SEQ ID NO: 988108 - DNA, 25 bp, Mus musculus
ttgataacaggaccctgcagagtga

SEQ ID NO: 988109 - DNA, 25 bp, Mus musculus
ttgataataccacgattgtctacaa

SEQ ID NO: 988110 - DNA, 25 bp, Mus musculus
ttgataataccaggattgtctacaa

SEQ ID NO: 988111 - DNA, 25 bp, Mus musculus
ttgataatcccgaccagcgaatcag

SEQ ID NO: 988112 - DNA, 25 bp, Mus musculus
ttgataatccggaccagcgaatcag

SEQ ID NO: 988113 - DNA, 25 bp, Mus musculus
ttgatactgcagcgcaagaggatta

SEQ ID NO: 988114 - DNA, 25 bp, Mus musculus
ttgatactgcagggcaagaggatta

SEQ ID NO: 988115 - DNA, 25 bp, Mus musculus
ttgatagtcacacagctctttgctg

SEQ ID NO: 988116 - DNA, 25 bp, Mus musculus
ttgatagtcacagagctctttgctg

SEQ ID NO: 988117 - DNA, 25 bp, Mus musculus
ttgatataaaatcaatggcagggaa

SEQ ID NO: 988118 - DNA, 25 bp, Mus musculus
ttgatataaaatgaatggcagggaa

SEQ ID NO: 988119 - DNA, 25 bp, Mus musculus
ttgatataatggacagccgatgcac

SEQ ID NO: 988120 - DNA, 25 bp, Mus musculus
ttgatataatggtcagccgatgcac

SEQ ID NO: 988121 - DNA, 25 bp, Mus musculus
ttgatcaaggagccaggctttcccc

SEQ ID NO: 988122 - DNA, 25 bp, Mus musculus
ttgatcaaggaggcaggctttcccc

SEQ ID NO: 988123 - DNA, 25 bp, Mus musculus
ttgatcatcccaccctatgggaagg

SEQ ID NO: 988124 - DNA, 25 bp, Mus musculus
ttgatcatcccagcctatgggaagg

SEQ ID NO: 988125 - DNA, 25 bp, Mus musculus
ttgatccgagagcagtatgaggagc

SEQ ID NO: 988126 - DNA, 25 bp, Mus musculus
ttgatccgagaggagtatgaggagc

SEQ ID NO: 988127 - DNA, 25 bp, Mus musculus
ttgatcctgaagatgttgctaccac

SEQ ID NO: 988128 - DNA, 25 bp, Mus musculus
ttgatcctgaagttgttgctaccac

SEQ ID NO: 988129 - DNA, 25 bp, Mus musculus
ttgatctgatagattatctgcgaac

SEQ ID NO: 988130 - DNA, 25 bp, Mus musculus
ttgatctgatagtttatctgcgaac

SEQ ID NO: 988131 - DNA, 25 bp, Mus musculus
ttgatctgtcagaagctccagtttg

SEQ ID NO: 988132 - DNA, 25 bp, Mus musculus
ttgatctgtcagaggaagaagctcc

SEQ ID NO: 988133 - DNA, 25 bp, Mus musculus
ttgatctgtcagcaagaagctccag

SEQ ID NO: 988134 - DNA, 25 bp, Mus musculus
ttgatctgtcaggaagaagctccag

SEQ ID NO: 988135 - DNA, 25 bp, Mus musculus
ttgatctgtcagtagctccagtttg

SEQ ID NO: 988136 - DNA, 25 bp, Mus musculus
ttgatctgtcagtggaagaagctcc

SEQ ID NO: 988137 - DNA, 25 bp, Mus musculus
ttgatcttgcagattctacgcatca

SEQ ID NO: 988138 - DNA, 25 bp, Mus musculus
ttgatcttgcagtttctacgcatca

SEQ ID NO: 988139 - DNA, 25 bp, Mus musculus
ttgatgaaacaacgcgactgctgga

SEQ ID NO: 988140 - DNA, 25 bp, Mus musculus
ttgatgaaacaaggcgactgctgga

SEQ ID NO: 988141 - DNA, 25 bp, Mus musculus
ttgatgaaagcagagatgtcttgga

SEQ ID NO: 988142 - DNA, 25 bp, Mus musculus
ttgatgaaaggagagatgtcttgga

SEQ ID NO: 988143 - DNA, 25 bp, Mus musculus
ttgatgaaatagactctttcctacg

SEQ ID NO: 988144 - DNA, 25 bp, Mus musculus
ttgatgaaatagtctctttcctacg

SEQ ID NO: 988145 - DNA, 25 bp, Mus musculus
ttgatgaagaagcaaagggagctgt

SEQ ID NO: 988146 - DNA, 25 bp, Mus musculus
ttgatgaagaaggaaagggagctgt

SEQ ID NO: 988147 - DNA, 25 bp, Mus musculus
ttgatgaagagacatacaactcagt

SEQ ID NO: 988148 - DNA, 25 bp, Mus musculus
ttgatgaagagagatacaactcagt

SEQ ID NO: 988149 - DNA, 25 bp, Mus musculus
ttgatgaagcctcaggaactgtgtg

SEQ ID NO: 988150 - DNA, 25 bp, Mus musculus
ttgatgaagcgtcaggaactgtgtg

SEQ ID NO: 988151 - DNA, 25 bp, Mus musculus
ttgatgacaatgcaagaaatttcaa

SEQ ID NO: 988152 - DNA, 25 bp, Mus musculus
ttgatgacaatggaagaaatttcaa

SEQ ID NO: 988153 - DNA, 25 bp, Mus musculus
ttgatgaccagacttacaagcacct

SEQ ID NO: 988154 - DNA, 25 bp, Mus musculus
ttgatgaccagagttacaagcacct

SEQ ID NO: 988155 - DNA, 25 bp, Mus musculus
ttgatgacctggaacacgagctcta

SEQ ID NO: 988156 - DNA, 25 bp, Mus musculus
ttgatgacctggaacataaactgaa

SEQ ID NO: 988157 - DNA, 25 bp, Mus musculus
ttgatgacctggaagacgagctcta

SEQ ID NO: 988158 - DNA, 25 bp, Mus musculus
ttgatgacctggaagataaactgaa

SEQ ID NO: 988159 - DNA, 25 bp, Mus musculus
ttgatgacttagaacacgagctgta

SEQ ID NO: 988160 - DNA, 25 bp, Mus musculus
ttgatgacttagaacagaaagtggc

SEQ ID NO: 988161 - DNA, 25 bp, Mus musculus
ttgatgacttagaacataagtttct

SEQ ID NO: 988162 - DNA, 25 bp, Mus musculus
ttgatgacttagaacatcaactcta

SEQ ID NO: 988163 - DNA, 25 bp, Mus musculus
ttgatgacttagaagacgagctgta

SEQ ID NO: 988164 - DNA, 25 bp, Mus musculus
ttgatgacttagaagagaaagtggc

SEQ ID NO: 988165 - DNA, 25 bp, Mus musculus
ttgatgacttagaagataagtttct

SEQ ID NO: 988166 - DNA, 25 bp, Mus musculus
ttgatgacttagaagatcaactcta

SEQ ID NO: 988167 - DNA, 25 bp, Mus musculus
ttgatgagattctacttaatgctgc

SEQ ID NO: 988168 - DNA, 25 bp, Mus musculus
ttgatgagattctagttaatgctgc

SEQ ID NO: 988169 - DNA, 25 bp, Mus musculus
ttgatgagggcacgttgatgctgga

SEQ ID NO: 988170 - DNA, 25 bp, Mus musculus
ttgatgagggcaggttgatgctgga

SEQ ID NO: 988171 - DNA, 25 bp, Mus musculus
ttgatgatacagagcatgtggtgat

SEQ ID NO: 988172 - DNA, 25 bp, Mus musculus
ttgatgatacagtgcatgtggtgat

SEQ ID NO: 988173 - DNA, 25 bp, Mus musculus
ttgatgatgcggcatgctgggatat

SEQ ID NO: 988174 - DNA, 25 bp, Mus musculus
ttgatgatgcgggatgctgggatat

SEQ ID NO: 988175 - DNA, 25 bp, Mus musculus
ttgatgcaaaatttgctgatcagga

SEQ ID NO: 988176 - DNA, 25 bp, Mus musculus
ttgatgcaaattttgctgatcagga

SEQ ID NO: 988177 - DNA, 25 bp, Mus musculus
ttgatgccagacggaaaaggcgtaa

SEQ ID NO: 988178 - DNA, 25 bp, Mus musculus
ttgatgccagtcggaaaaggcgtaa

SEQ ID NO: 988179 - DNA, 25 bp, Mus musculus
ttgatgcccaagccaacttaagggc

SEQ ID NO: 988180 - DNA, 25 bp, Mus musculus
ttgatgcccaaggcaacttaagggc

SEQ ID NO: 988181 - DNA, 25 bp, Mus musculus
ttgatgcccatgaaggtttctcgga

SEQ ID NO: 988182 - DNA, 25 bp, Mus musculus
ttgatgcccatgtaggtttctcgga

SEQ ID NO: 988183 - DNA, 25 bp, Mus musculus
ttgatggaggagcctatgggggaag

SEQ ID NO: 988184 - DNA, 25 bp, Mus musculus
ttgatggaggaggctatgggggaag

SEQ ID NO: 988185 - DNA, 25 bp, Mus musculus
ttgatggcaactatgtctatatagc

SEQ ID NO: 988186 - DNA, 25 bp, Mus musculus
ttgatggcaagtatgtctatatagc

SEQ ID NO: 988187 - DNA, 25 bp, Mus musculus
ttgatgggtacaatcgtaccatcat

SEQ ID NO: 988188 - DNA, 25 bp, Mus musculus
ttgatgggtacaatggtaccatcat

SEQ ID NO: 988189 - DNA, 25 bp, Mus musculus
ttgatgtaaaagcaaaagaacataa

SEQ ID NO: 988190 - DNA, 25 bp, Mus musculus
ttgatgtaaaaggaaaagaacataa

SEQ ID NO: 988191 - DNA, 25 bp, Mus musculus
ttgatgtagatgcacaccgtccaga

SEQ ID NO: 988192 - DNA, 25 bp, Mus musculus
ttgatgtagatgcagaccgtccaga

SEQ ID NO: 988193 - DNA, 25 bp, Mus musculus
ttgatgtgccaactaatgtatattt

SEQ ID NO: 988194 - DNA, 25 bp, Mus musculus
ttgatgtgccaagtaatgtatattt

SEQ ID NO: 988195 - DNA, 25 bp, Mus musculus
ttgatgtggcatcgttcctgacgga

SEQ ID NO: 988196 - DNA, 25 bp, Mus musculus
ttgatgtggcatggttcctgacgga

SEQ ID NO: 988197 - DNA, 25 bp, Mus musculus
ttgattcagaagatgcagaatgagc

SEQ ID NO: 988198 - DNA, 25 bp, Mus musculus
ttgattcagaagttgcagaatgagc

SEQ ID NO: 988199 - DNA, 25 bp, Mus musculus
ttgattccagctttgatgttcacaa

SEQ ID NO: 988200 - DNA, 25 bp, Mus musculus
ttgattccaggtttgatgttcacaa

SEQ ID NO: 988201 - DNA, 25 bp, Mus musculus
ttgattgaggactctcaaagaagga

SEQ ID NO: 988202 - DNA, 25 bp, Mus musculus
ttgattgaggtctctcaaagaagga

SEQ ID NO: 988203 - DNA, 25 bp, Mus musculus
ttgattgagtcgcaccctgatgctt

SEQ ID NO: 988204 - DNA, 25 bp, Mus musculus
ttgattgagtcggaccctgatgctt

SEQ ID NO: 988205 - DNA, 25 bp, Mus musculus
ttgattgcagagcgagcaaagaaga

SEQ ID NO: 988206 - DNA, 25 bp, Mus musculus
ttgattgcagagggagcaaagaaga

SEQ ID NO: 988207 - DNA, 25 bp, Mus musculus
ttgattgccagacgcatgaatccta

SEQ ID NO: 988208 - DNA, 25 bp, Mus musculus
ttgattgccagaggcatgaatccta

SEQ ID NO: 988209 - DNA, 25 bp, Mus musculus
ttgattgttgaacatataattgaca

SEQ ID NO: 988210 - DNA, 25 bp, Mus musculus
ttgattgttgaagatataattgaca

SEQ ID NO: 988211 - DNA, 25 bp, Mus musculus
ttgattttcggcaacgatgagcccc

SEQ ID NO: 988212 - DNA, 25 bp, Mus musculus
ttgattttcggcaacggcgtctact

SEQ ID NO: 988213 - DNA, 25 bp, Mus musculus
ttgattttcggcaaggatgagcccc

SEQ ID NO: 988214 - DNA, 25 bp, Mus musculus
ttgattttcggcaagggcgtctact

SEQ ID NO: 988215 - DNA, 25 bp, Mus musculus
ttgatttttacaaggacttgacatc

SEQ ID NO: 988216 - DNA, 25 bp, Mus musculus
ttgatttttacatggacttgacatc

SEQ ID NO: 988217 - DNA, 25 bp, Mus musculus
ttgatttttcggaacacagcgtgga

SEQ ID NO: 988218 - DNA, 25 bp, Mus musculus
ttgatttttcggaagacagcgtgga

SEQ ID NO: 988219 - DNA, 25 bp, Mus musculus
ttgcaaaatatgcacatcccaatgg

SEQ ID NO: 988220 - DNA, 25 bp, Mus musculus
ttgcaaaatatggacatcccaatgg

SEQ ID NO: 988221 - DNA, 25 bp, Mus musculus
ttgcaaacagcatgtctctccattc

SEQ ID NO: 988222 - DNA, 25 bp, Mus musculus
ttgcaaacaggatgtctctccattc

SEQ ID NO: 988223 - DNA, 25 bp, Mus musculus
ttgcaaagattttaatcgcactcct

SEQ ID NO: 988224 - DNA, 25 bp, Mus musculus
ttgcaaagattttattcgcactcct

SEQ ID NO: 988225 - DNA, 25 bp, Mus musculus
ttgcaaagcttcagtggttctctgc

SEQ ID NO: 988226 - DNA, 25 bp, Mus musculus
ttgcaaagcttctgtggttctctgc

SEQ ID NO: 988227 - DNA, 25 bp, Mus musculus
ttgcaacacgccctcggccgacaac

SEQ ID NO: 988228 - DNA, 25 bp, Mus musculus
ttgcaacacgccctgggccgacaac

SEQ ID NO: 988229 - DNA, 25 bp, Mus musculus
ttgcaaccaccgcagaagaggctca

SEQ ID NO: 988230 - DNA, 25 bp, Mus musculus
ttgcaaccaccggagaagaggctca

SEQ ID NO: 988231 - DNA, 25 bp, Mus musculus
ttgcaactctatcgtgctttttgac

SEQ ID NO: 988232 - DNA, 25 bp, Mus musculus
ttgcaactctatggtgctttttgac

SEQ ID NO: 988233 - DNA, 25 bp, Mus musculus
ttgcaagaaaattgaaaaagagtgt

SEQ ID NO: 988234 - DNA, 25 bp, Mus musculus
ttgcaagaaatttgaaaaagagtgt

SEQ ID NO: 988235 - DNA, 25 bp, Mus musculus
ttgcaagggcaaggcttcttggccc

SEQ ID NO: 988236 - DNA, 25 bp, Mus musculus
ttgcaagggcaagggttcttggccc

SEQ ID NO: 988237 - DNA, 25 bp, Mus musculus
ttgcaagtatagcacgtctggaatt

SEQ ID NO: 988238 - DNA, 25 bp, Mus musculus
ttgcaagtatagcaggtctggaatt

SEQ ID NO: 988239 - DNA, 25 bp, Mus musculus
ttgcaagtcatgacattgtgcttct

SEQ ID NO: 988240 - DNA, 25 bp, Mus musculus
ttgcaagtcatgtcattgtgcttct

SEQ ID NO: 988241 - DNA, 25 bp, Mus musculus
ttgcaatgtgtccacagcaagattt

SEQ ID NO: 988242 - DNA, 25 bp, Mus musculus
ttgcaatgtgtccagagcaagattt

SEQ ID NO: 988243 - DNA, 25 bp, Mus musculus
ttgcaattgcaacatcaagtcctgc

SEQ ID NO: 988244 - DNA, 25 bp, Mus musculus
ttgcaattgcaagatcaagtcctgc

SEQ ID NO: 988245 - DNA, 25 bp, Mus musculus
ttgcacaaagctttgtggtgaactt

SEQ ID NO: 988246 - DNA, 25 bp, Mus musculus
ttgcacaaaggtttgtggtgaactt

SEQ ID NO: 988247 - DNA, 25 bp, Mus musculus
ttgcacagcactcccagggggaagg

SEQ ID NO: 988248 - DNA, 25 bp, Mus musculus
ttgcacagcactgccagggggaagg

SEQ ID NO: 988249 - DNA, 25 bp, Mus musculus
ttgcacagtcctgacgtgtgccacc

SEQ ID NO: 988250 - DNA, 25 bp, Mus musculus
ttgcacagtcctgaggtgtgccacc

SEQ ID NO: 988251 - DNA, 25 bp, Mus musculus
ttgcacccctacactttctgacctg

SEQ ID NO: 988252 - DNA, 25 bp, Mus musculus
ttgcacccctactctttctgacctg

SEQ ID NO: 988253 - DNA, 25 bp, Mus musculus
ttgcacctatagagtctataatata

SEQ ID NO: 988254 - DNA, 25 bp, Mus musculus
ttgcacctatagatggcattcgctc

SEQ ID NO: 988255 - DNA, 25 bp, Mus musculus
ttgcacctatagtgtctataatata

SEQ ID NO: 988256 - DNA, 25 bp, Mus musculus
ttgcacctatagttggcattcgctc

SEQ ID NO: 988257 - DNA, 25 bp, Mus musculus
ttgcactccgactacatccggagaa

SEQ ID NO: 988258 - DNA, 25 bp, Mus musculus
ttgcactccgtctacatccggagaa

SEQ ID NO: 988259 - DNA, 25 bp, Mus musculus
ttgcagaaagacattagtactgaag

SEQ ID NO: 988260 - DNA, 25 bp, Mus musculus
ttgcagaaagcacgccgtctactgt

SEQ ID NO: 988261 - DNA, 25 bp, Mus musculus
ttgcagaaagcacggctgactgtga

SEQ ID NO: 988262 - DNA, 25 bp, Mus musculus
ttgcagaaagcaggccgtctactgt

SEQ ID NO: 988263 - DNA, 25 bp, Mus musculus
ttgcagaaagcagggctgactgtga

SEQ ID NO: 988264 - DNA, 25 bp, Mus musculus
ttgcagaaagtcattagtactgaag

SEQ ID NO: 988265 - DNA, 25 bp, Mus musculus
ttgcagaaatagcgcagatttgtag

SEQ ID NO: 988266 - DNA, 25 bp, Mus musculus
ttgcagaaatagggcagatttgtag

SEQ ID NO: 988267 - DNA, 25 bp, Mus musculus
ttgcagagccagatcactatgttgt

SEQ ID NO: 988268 - DNA, 25 bp, Mus musculus
ttgcagagccagttcactatgttgt

SEQ ID NO: 988269 - DNA, 25 bp, Mus musculus
ttgcagagctaacacgacgaagagg

SEQ ID NO: 988270 - DNA, 25 bp, Mus musculus
ttgcagagctaacaggacgaagagg

SEQ ID NO: 988271 - DNA, 25 bp, Mus musculus
ttgcagatggaaagatgacatcgtt

SEQ ID NO: 988272 - DNA, 25 bp, Mus musculus
ttgcagatggaatgatgacatcgtt

SEQ ID NO: 988273 - DNA, 25 bp, Mus musculus
ttgcagattcaaagttcacagtcag

SEQ ID NO: 988274 - DNA, 25 bp, Mus musculus
ttgcagattcaaatgaccagcagtt

SEQ ID NO: 988275 - DNA, 25 bp, Mus musculus
ttgcagattcaatgttcacagtcag

SEQ ID NO: 988276 - DNA, 25 bp, Mus musculus
ttgcagattcaattgaccagcagtt

SEQ ID NO: 988277 - DNA, 25 bp, Mus musculus
ttgcagcagaagatcctgtgcagca

SEQ ID NO: 988278 - DNA, 25 bp, Mus musculus
ttgcagcagaagttcctgtgcagca

SEQ ID NO: 988279 - DNA, 25 bp, Mus musculus
ttgcagcaggactgctttgccttga

SEQ ID NO: 988280 - DNA, 25 bp, Mus musculus
ttgcagcaggtctgctttgccttga

SEQ ID NO: 988281 - DNA, 25 bp, Mus musculus
ttgcagccagctatggtgtggagcc

SEQ ID NO: 988282 - DNA, 25 bp, Mus musculus
ttgcagccaggtatggtgtggagcc

SEQ ID NO: 988283 - DNA, 25 bp, Mus musculus
ttgcagccggagcacgggagcccaa

SEQ ID NO: 988284 - DNA, 25 bp, Mus musculus
ttgcagccggagcaggggagcccaa

SEQ ID NO: 988285 - DNA, 25 bp, Mus musculus
ttgcagcgctcacgcgaaccagtga

SEQ ID NO: 988286 - DNA, 25 bp, Mus musculus
ttgcagcgctcacgggaaccagtga

SEQ ID NO: 988287 - DNA, 25 bp, Mus musculus
ttgcagctggacaacttccctggct

SEQ ID NO: 988288 - DNA, 25 bp, Mus musculus
ttgcagctggacaagttccctggct

SEQ ID NO: 988289 - DNA, 25 bp, Mus musculus
ttgcagctggtggacgcatggctgg

SEQ ID NO: 988290 - DNA, 25 bp, Mus musculus
ttgcagctggtggaggcatggctgg

SEQ ID NO: 988291 - DNA, 25 bp, Mus musculus
ttgcagctgtctagcccatgccatt

SEQ ID NO: 988292 - DNA, 25 bp, Mus musculus
ttgcagctgtgtagcccatgccatt

SEQ ID NO: 988293 - DNA, 25 bp, Mus musculus
ttgcaggaaaggccaaataagttgg

SEQ ID NO: 988294 - DNA, 25 bp, Mus musculus
ttgcaggaaagggcaaataagttgg

SEQ ID NO: 988295 - DNA, 25 bp, Mus musculus
ttgcaggagggacacgcatcacccc

SEQ ID NO: 988296 - DNA, 25 bp, Mus musculus
ttgcaggagggacaggcatcacccc

SEQ ID NO: 988297 - DNA, 25 bp, Mus musculus
ttgcagggcttaccaggtgtccctg

SEQ ID NO: 988298 - DNA, 25 bp, Mus musculus
ttgcagggcttacctggtgtccctg

SEQ ID NO: 988299 - DNA, 25 bp, Mus musculus
ttgcaggtgtatcatgaagaccctc

SEQ ID NO: 988300 - DNA, 25 bp, Mus musculus
ttgcaggtgtatgatgaagaccctc

SEQ ID NO: 988301 - DNA, 25 bp, Mus musculus
ttgcagtgcaggagcgacgactgac

SEQ ID NO: 988302 - DNA, 25 bp, Mus musculus
ttgcagtgcaggagggacgactgac

SEQ ID NO: 988303 - DNA, 25 bp, Mus musculus
ttgcagttaccacacgacaacaaca

SEQ ID NO: 988304 - DNA, 25 bp, Mus musculus
ttgcagttaccacaggacaacaaca

SEQ ID NO: 988305 - DNA, 25 bp, Mus musculus
ttgcagttttcacaaagaagcaact

SEQ ID NO: 988306 - DNA, 25 bp, Mus musculus
ttgcagttttcagaaagaagcaact

SEQ ID NO: 988307 - DNA, 25 bp, Mus musculus
ttgcataacaagatttggcaagaaa

SEQ ID NO: 988308 - DNA, 25 bp, Mus musculus
ttgcataacaagttttggcaagaaa

SEQ ID NO: 988309 - DNA, 25 bp, Mus musculus
ttgcatacagaaatgtgcaagaaag

SEQ ID NO: 988310 - DNA, 25 bp, Mus musculus
ttgcatacagtaatgtgcaagaaag

SEQ ID NO: 988311 - DNA, 25 bp, Mus musculus
ttgcatgatcttgcaattgaagtgg

SEQ ID NO: 988312 - DNA, 25 bp, Mus musculus
ttgcatgatcttgctattgaagtgg

SEQ ID NO: 988313 - DNA, 25 bp, Mus musculus
ttgcatggatatgacgtccagagat

SEQ ID NO: 988314 - DNA, 25 bp, Mus musculus
ttgcatggatatgaggtccagagat

SEQ ID NO: 988315 - DNA, 25 bp, Mus musculus
ttgcatgtcatgcgtgaagataaat

SEQ ID NO: 988316 - DNA, 25 bp, Mus musculus
ttgcatgtcatgggtgaagataaat

SEQ ID NO: 988317 - DNA, 25 bp, Mus musculus
ttgcattcacagaacttgggatgct

SEQ ID NO: 988318 - DNA, 25 bp, Mus musculus
ttgcattcacagtacttgggatgct

SEQ ID NO: 988319 - DNA, 25 bp, Mus musculus
ttgcattccgcttgcttcccagagc

SEQ ID NO: 988320 - DNA, 25 bp, Mus musculus
ttgcattccggttgcttcccagagc

SEQ ID NO: 988321 - DNA, 25 bp, Mus musculus
ttgcatttagcaggactgacaaacg

SEQ ID NO: 988322 - DNA, 25 bp, Mus musculus
ttgcatttaggaggactgacaaacg

SEQ ID NO: 988323 - DNA, 25 bp, Mus musculus
ttgcattttgaggcaatcagtgacg

SEQ ID NO: 988324 - DNA, 25 bp, Mus musculus
ttgcattttgaggctatcagtgacg

SEQ ID NO: 988325 - DNA, 25 bp, Mus musculus
ttgccaaaaacatgaaaacataatg

SEQ ID NO: 988326 - DNA, 25 bp, Mus musculus
ttgccaaaaacgcaagtttgcagat

SEQ ID NO: 988327 - DNA, 25 bp, Mus musculus
ttgccaaaaacggaagtttgcagat

SEQ ID NO: 988328 - DNA, 25 bp, Mus musculus
ttgccaaaaagatgaaaacataatg

SEQ ID NO: 988329 - DNA, 25 bp, Mus musculus
ttgccaaaagctacagtgattgtac

SEQ ID NO: 988330 - DNA, 25 bp, Mus musculus
ttgccaaaaggtacagtgattgtac

SEQ ID NO: 988331 - DNA, 25 bp, Mus musculus
ttgccaaaatcacactgaacacctt

SEQ ID NO: 988332 - DNA, 25 bp, Mus musculus
ttgccaaaatcacagtgaacacctt

SEQ ID NO: 988333 - DNA, 25 bp, Mus musculus
ttgccaaagtcataccgatggcaac

SEQ ID NO: 988334 - DNA, 25 bp, Mus musculus
ttgccaaagtgataccgatggcaac

SEQ ID NO: 988335 - DNA, 25 bp, Mus musculus
ttgccaaagttgataccgatggcaa

SEQ ID NO: 988336 - DNA, 25 bp, Mus musculus
ttgccaaagttgttaccgatggcaa

SEQ ID NO: 988337 - DNA, 25 bp, Mus musculus
ttgccaacacagcgtgtgggcctgg

SEQ ID NO: 988338 - DNA, 25 bp, Mus musculus
ttgccaacacagggtgtgggcctgg

SEQ ID NO: 988339 - DNA, 25 bp, Mus musculus
ttgccaagaacgctatttgaatatc

SEQ ID NO: 988340 - DNA, 25 bp, Mus musculus
ttgccaagaacggtatttgaatatc

SEQ ID NO: 988341 - DNA, 25 bp, Mus musculus
ttgccaagatctagatccagttttt

SEQ ID NO: 988342 - DNA, 25 bp, Mus musculus
ttgccaagatctcgtggatcgcact

SEQ ID NO: 988343 - DNA, 25 bp, Mus musculus
ttgccaagatctggtggatcgcact

SEQ ID NO: 988344 - DNA, 25 bp, Mus musculus
ttgccaagatcttgatccagttttt

SEQ ID NO: 988345 - DNA, 25 bp, Mus musculus
ttgccaagcaagcaagcctgctgac

SEQ ID NO: 988346 - DNA, 25 bp, Mus musculus
ttgccaagcaaggaagcctgctgac

SEQ ID NO: 988347 - DNA, 25 bp, Mus musculus
ttgccacaccatataccgaagcaaa

SEQ ID NO: 988348 - DNA, 25 bp, Mus musculus
ttgccacaccatatataaactacac

SEQ ID NO: 988349 - DNA, 25 bp, Mus musculus
ttgccacaccatttaccgaagcaaa

SEQ ID NO: 988350 - DNA, 25 bp, Mus musculus
ttgccacaccatttataaactacac

SEQ ID NO: 988351 - DNA, 25 bp, Mus musculus
ttgccacaggcacgagagatggcca

SEQ ID NO: 988352 - DNA, 25 bp, Mus musculus
ttgccacagggacgagagatggcca

SEQ ID NO: 988353 - DNA, 25 bp, Mus musculus
ttgccacatcagcgcacttgatttc

SEQ ID NO: 988354 - DNA, 25 bp, Mus musculus
ttgccacatcagggcacttgatttc

SEQ ID NO: 988355 - DNA, 25 bp, Mus musculus
ttgccacctcacgacgttcctggac

SEQ ID NO: 988356 - DNA, 25 bp, Mus musculus
ttgccacctcacgaggttcctggac

SEQ ID NO: 988357 - DNA, 25 bp, Mus musculus
ttgccacgtgacgacggcagaactt

SEQ ID NO: 988358 - DNA, 25 bp, Mus musculus
ttgccacgtgacgagggcagaactt

SEQ ID NO: 988359 - DNA, 25 bp, Mus musculus
ttgccagaagcaacctgaatgaacc

SEQ ID NO: 988360 - DNA, 25 bp, Mus musculus
ttgccagaaggaacctgaatgaacc

SEQ ID NO: 988361 - DNA, 25 bp, Mus musculus
ttgccagaattactccatctcccct

SEQ ID NO: 988362 - DNA, 25 bp, Mus musculus
ttgccagaattactgcatctcccct

SEQ ID NO: 988363 - DNA, 25 bp, Mus musculus
ttgccagacataaacgtacatactt

SEQ ID NO: 988364 - DNA, 25 bp, Mus musculus
ttgccagacataaaggtacatactt

SEQ ID NO: 988365 - DNA, 25 bp, Mus musculus
ttgccatatctccgctgatatactg

SEQ ID NO: 988366 - DNA, 25 bp, Mus musculus
ttgccatatctcggctgatatactg

SEQ ID NO: 988367 - DNA, 25 bp, Mus musculus
ttgccatcattgcaaagatctatac

SEQ ID NO: 988368 - DNA, 25 bp, Mus musculus
ttgccatcattggaaagatctatac

SEQ ID NO: 988369 - DNA, 25 bp, Mus musculus
ttgccattcaagctggttgaaaaga

SEQ ID NO: 988370 - DNA, 25 bp, Mus musculus
ttgccattcaaggtggttgaaaaga

SEQ ID NO: 988371 - DNA, 25 bp, Mus musculus
ttgcccaagcagccatgtggcagca

SEQ ID NO: 988372 - DNA, 25 bp, Mus musculus
ttgcccaagcagccttgtggcagca

SEQ ID NO: 988373 - DNA, 25 bp, Mus musculus
ttgcccagatcctgtgggccgaagc

SEQ ID NO: 988374 - DNA, 25 bp, Mus musculus
ttgcccagatgctgtgggccgaagc

SEQ ID NO: 988375 - DNA, 25 bp, Mus musculus
ttgcccggtgttcgacatatgaaac

SEQ ID NO: 988376 - DNA, 25 bp, Mus musculus
ttgcccggtgttggacatatgaaac

SEQ ID NO: 988377 - DNA, 25 bp, Mus musculus
ttgccctgcatcaacgagcttgtgt

SEQ ID NO: 988378 - DNA, 25 bp, Mus musculus
ttgccctgcatcaaggagcttgtgt

SEQ ID NO: 988379 - DNA, 25 bp, Mus musculus
ttgccgattgaaaaacatccatttc

SEQ ID NO: 988380 - DNA, 25 bp, Mus musculus
ttgccgattgaataacatccatttc

SEQ ID NO: 988381 - DNA, 25 bp, Mus musculus
ttgccgccatagctttatggagccg

SEQ ID NO: 988382 - DNA, 25 bp, Mus musculus
ttgccgccataggtttatggagccg

SEQ ID NO: 988383 - DNA, 25 bp, Mus musculus
ttgccgcctatgattctatggcaca

SEQ ID NO: 988384 - DNA, 25 bp, Mus musculus
ttgccgcctatgtttctatggcaca

SEQ ID NO: 988385 - DNA, 25 bp, Mus musculus
ttgccgggcgagctggaaaccatgg

SEQ ID NO: 988386 - DNA, 25 bp, Mus musculus
ttgccgggcgaggtggaaaccatgg

SEQ ID NO: 988387 - DNA, 25 bp, Mus musculus
ttgcctacaactacctgggcagccc

SEQ ID NO: 988388 - DNA, 25 bp, Mus musculus
ttgcctacaactacgtgggcagccc

SEQ ID NO: 988389 - DNA, 25 bp, Mus musculus
ttgcctattggaatcgtgccaacac

SEQ ID NO: 988390 - DNA, 25 bp, Mus musculus
ttgcctattggaatggtgccaacac

SEQ ID NO: 988391 - DNA, 25 bp, Mus musculus
ttgcctcaaacaaggtgctcatggg

SEQ ID NO: 988392 - DNA, 25 bp, Mus musculus
ttgcctcaaacatggtgctcatggg

SEQ ID NO: 988393 - DNA, 25 bp, Mus musculus
ttgcctcaagaggacgtgtcctaac

SEQ ID NO: 988394 - DNA, 25 bp, Mus musculus
ttgcctcaagaggaggtgtcctaac

SEQ ID NO: 988395 - DNA, 25 bp, Mus musculus
ttgcctcaagctgagctgtcctccc

SEQ ID NO: 988396 - DNA, 25 bp, Mus musculus
ttgcctcaaggtgagctgtcctccc

SEQ ID NO: 988397 - DNA, 25 bp, Mus musculus
ttgcctctacctcgctgagaggcca

SEQ ID NO: 988398 - DNA, 25 bp, Mus musculus
ttgcctctacctcggtgagaggcca

SEQ ID NO: 988399 - DNA, 25 bp, Mus musculus
ttgcctgaacaacatgcactcccat

SEQ ID NO: 988400 - DNA, 25 bp, Mus musculus
ttgcctgaacaacctcagccctggg

SEQ ID NO: 988401 - DNA, 25 bp, Mus musculus
ttgcctgaacaagatgcactcccat

SEQ ID NO: 988402 - DNA, 25 bp, Mus musculus
ttgcctgaacaagctcagccctggg

SEQ ID NO: 988403 - DNA, 25 bp, Mus musculus
ttgcctgacgtcaatagccccacct

SEQ ID NO: 988404 - DNA, 25 bp, Mus musculus
ttgcctgacgtctatagccccacct

SEQ ID NO: 988405 - DNA, 25 bp, Mus musculus
ttgcctgcaacgaagcggtgcgtta

SEQ ID NO: 988406 - DNA, 25 bp, Mus musculus
ttgcctgcaaggaagcggtgcgtta

SEQ ID NO: 988407 - DNA, 25 bp, Mus musculus
ttgcctgcatcccttctcattgacg

SEQ ID NO: 988408 - DNA, 25 bp, Mus musculus
ttgcctgcatgccttctcattgacg

SEQ ID NO: 988409 - DNA, 25 bp, Mus musculus
ttgcctgccaagctcctcttctgtg

SEQ ID NO: 988410 - DNA, 25 bp, Mus musculus
ttgcctgccaaggtcctcttctgtg

SEQ ID NO: 988411 - DNA, 25 bp, Mus musculus
ttgcctgccgccaacgcttccagga

SEQ ID NO: 988412 - DNA, 25 bp, Mus musculus
ttgcctgccgccaaggcttccagga

SEQ ID NO: 988413 - DNA, 25 bp, Mus musculus
ttgcctgctggaagtctctaataaa

SEQ ID NO: 988414 - DNA, 25 bp, Mus musculus
ttgcctgctggatgtctctaataaa

SEQ ID NO: 988415 - DNA, 25 bp, Mus musculus
ttgcctggaacaaacgatgtaatgg

SEQ ID NO: 988416 - DNA, 25 bp, Mus musculus
ttgcctggaacaaaggatgtaatgg

SEQ ID NO: 988417 - DNA, 25 bp, Mus musculus
ttgcctggatatatcgcggtgataa

SEQ ID NO: 988418 - DNA, 25 bp, Mus musculus
ttgcctggatatatggcggtgataa

SEQ ID NO: 988419 - DNA, 25 bp, Mus musculus
ttgcctgtcagtcccaggtcctgcc

SEQ ID NO: 988420 - DNA, 25 bp, Mus musculus
ttgcctgtcagtgccaggtcctgcc

SEQ ID NO: 988421 - DNA, 25 bp, Mus musculus
ttgccttagccaagagctgtcccga

SEQ ID NO: 988422 - DNA, 25 bp, Mus musculus
ttgccttagccatgagctgtcccga

SEQ ID NO: 988423 - DNA, 25 bp, Mus musculus
ttgccttatgcccacctccaggcta

SEQ ID NO: 988424 - DNA, 25 bp, Mus musculus
ttgccttatgcccagctccaggcta

SEQ ID NO: 988425 - DNA, 25 bp, Mus musculus
ttgccttccgagatgagacggcagt

SEQ ID NO: 988426 - DNA, 25 bp, Mus musculus
ttgccttccgagcgcagtactgcta

SEQ ID NO: 988427 - DNA, 25 bp, Mus musculus
ttgccttccgagggcagtactgcta

SEQ ID NO: 988428 - DNA, 25 bp, Mus musculus
ttgccttccgagttgagacggcagt

SEQ ID NO: 988429 - DNA, 25 bp, Mus musculus
ttgcctttctctctttgacgggcat

SEQ ID NO: 988430 - DNA, 25 bp, Mus musculus
ttgcctttctctgtttgacgggcat

SEQ ID NO: 988431 - DNA, 25 bp, Mus musculus
ttgcgacaacagatggagaagtctt

SEQ ID NO: 988432 - DNA, 25 bp, Mus musculus
ttgcgacaacagttggagaagtctt

SEQ ID NO: 988433 - DNA, 25 bp, Mus musculus
ttgcgacagcagctcaaggagatca

SEQ ID NO: 988434 - DNA, 25 bp, Mus musculus
ttgcgacagcaggtcaaggagatca

SEQ ID NO: 988435 - DNA, 25 bp, Mus musculus
ttgcgactgctgaccatgagcatct

SEQ ID NO: 988436 - DNA, 25 bp, Mus musculus
ttgcgactgctgagaccatgagcat

SEQ ID NO: 988437 - DNA, 25 bp, Mus musculus
ttgcgactgctgtccatgagcatct

SEQ ID NO: 988438 - DNA, 25 bp, Mus musculus
ttgcgactgctgtgaccatgagcat

SEQ ID NO: 988439 - DNA, 25 bp, Mus musculus
ttgcgagctctgcttgctggttgtt

SEQ ID NO: 988440 - DNA, 25 bp, Mus musculus
ttgcgagctctggttgctggttgtt

SEQ ID NO: 988441 - DNA, 25 bp, Mus musculus
ttgcgatggcggaacagagactcag

SEQ ID NO: 988442 - DNA, 25 bp, Mus musculus
ttgcgatggcggtacagagactcag

SEQ ID NO: 988443 - DNA, 25 bp, Mus musculus
ttgcgcagttcgtttacggcagcca

SEQ ID NO: 988444 - DNA, 25 bp, Mus musculus
ttgcgcagttggtttacggcagcca

SEQ ID NO: 988445 - DNA, 25 bp, Mus musculus
ttgcgcatcctgcagccacattgcc

SEQ ID NO: 988446 - DNA, 25 bp, Mus musculus
ttgcgcatcctggagccacattgcc

SEQ ID NO: 988447 - DNA, 25 bp, Mus musculus
ttgcgctgtatacaatgcggggttc

SEQ ID NO: 988448 - DNA, 25 bp, Mus musculus
ttgcgctgtatagaatgcggggttc

SEQ ID NO: 988449 - DNA, 25 bp, Mus musculus
ttgcggaaattacacataaatttgg

SEQ ID NO: 988450 - DNA, 25 bp, Mus musculus
ttgcggaaattacagataaatttgg

SEQ ID NO: 988451 - DNA, 25 bp, Mus musculus
ttgcggacaccgcacgcagtgtcct

SEQ ID NO: 988452 - DNA, 25 bp, Mus musculus
ttgcggacaccgcaggcagtgtcct

SEQ ID NO: 988453 - DNA, 25 bp, Mus musculus
ttgcggagggccaaccaactccaca

SEQ ID NO: 988454 - DNA, 25 bp, Mus musculus
ttgcggagggcctaccaactccaca

SEQ ID NO: 988455 - DNA, 25 bp, Mus musculus
ttgcggcgccaacatccccagctca

SEQ ID NO: 988456 - DNA, 25 bp, Mus musculus
ttgcggcgccaagatccccagctca

SEQ ID NO: 988457 - DNA, 25 bp, Mus musculus
ttgcggcgctgtcacatcaagatcc

SEQ ID NO: 988458 - DNA, 25 bp, Mus musculus
ttgcggcgctgtcagatcaagatcc

SEQ ID NO: 988459 - DNA, 25 bp, Mus musculus
ttgcggctatctagtgtgtgccaag

SEQ ID NO: 988460 - DNA, 25 bp, Mus musculus
ttgcggctatgtagtgtgtgccaag

SEQ ID NO: 988461 - DNA, 25 bp, Mus musculus
ttgcggttcgaacggcctgctatgg

SEQ ID NO: 988462 - DNA, 25 bp, Mus musculus
ttgcggttcgaagggcctgctatgg

SEQ ID NO: 988463 - DNA, 25 bp, Mus musculus
ttgcggttgaaaatggaagacaagg

SEQ ID NO: 988464 - DNA, 25 bp, Mus musculus
ttgcggttgataatggaagacaagg

SEQ ID NO: 988465 - DNA, 25 bp, Mus musculus
ttgcggttgatgaaaatggaagaca

SEQ ID NO: 988466 - DNA, 25 bp, Mus musculus
ttgcggttgatgtaaatggaagaca

SEQ ID NO: 988467 - DNA, 25 bp, Mus musculus
ttgcgtctggatcacgacccctccc

SEQ ID NO: 988468 - DNA, 25 bp, Mus musculus
ttgcgtctggatcaggacccctccc

SEQ ID NO: 988469 - DNA, 25 bp, Mus musculus
ttgcgtgtcctgaacattcccctcg

SEQ ID NO: 988470 - DNA, 25 bp, Mus musculus
ttgcgtgtcctgaagattcccctcg

SEQ ID NO: 988471 - DNA, 25 bp, Mus musculus
ttgcgttagatgcacatgggagaag

SEQ ID NO: 988472 - DNA, 25 bp, Mus musculus
ttgcgttagatgcagatgggagaag

SEQ ID NO: 988473 - DNA, 25 bp, Mus musculus
ttgctaacagcatgcccatcccaga

SEQ ID NO: 988474 - DNA, 25 bp, Mus musculus
ttgctaacagcggatcatgagggac

SEQ ID NO: 988475 - DNA, 25 bp, Mus musculus
ttgctaacaggatgcccatcccaga

SEQ ID NO: 988476 - DNA, 25 bp, Mus musculus
ttgctaacaggggatcatgagggac

SEQ ID NO: 988477 - DNA, 25 bp, Mus musculus
ttgctacagctgcgctgggaggatc

SEQ ID NO: 988478 - DNA, 25 bp, Mus musculus
ttgctacagctgggctgggaggatc

SEQ ID NO: 988479 - DNA, 25 bp, Mus musculus
ttgctaccagcgtccgcctggctgg

SEQ ID NO: 988480 - DNA, 25 bp, Mus musculus
ttgctaccagggtccgcctggctgg

SEQ ID NO: 988481 - DNA, 25 bp, Mus musculus
ttgctacctcagactcacggatgat

SEQ ID NO: 988482 - DNA, 25 bp, Mus musculus
ttgctacctcagtctcacggatgat

SEQ ID NO: 988483 - DNA, 25 bp, Mus musculus
ttgctagcagcaatcatctggggaa

SEQ ID NO: 988484 - DNA, 25 bp, Mus musculus
ttgctagcaggaatcatctggggaa

SEQ ID NO: 988485 - DNA, 25 bp, Mus musculus
ttgctagtgctgcacgctgctggag

SEQ ID NO: 988486 - DNA, 25 bp, Mus musculus
ttgctagtgctggacgctgctggag

SEQ ID NO: 988487 - DNA, 25 bp, Mus musculus
ttgctatcagctgtactgcagtcgc

SEQ ID NO: 988488 - DNA, 25 bp, Mus musculus
ttgctatcaggtgtactgcagtcgc

SEQ ID NO: 988489 - DNA, 25 bp, Mus musculus
ttgctatgctaactatgagagccag

SEQ ID NO: 988490 - DNA, 25 bp, Mus musculus
ttgctatgctaagtatgagagccag

SEQ ID NO: 988491 - DNA, 25 bp, Mus musculus
ttgctatttgcgtacccgcctgtgt

SEQ ID NO: 988492 - DNA, 25 bp, Mus musculus
ttgctatttgcgtagccgcctgtgt

SEQ ID NO: 988493 - DNA, 25 bp, Mus musculus
ttgctattttctatcctgtttacat

SEQ ID NO: 988494 - DNA, 25 bp, Mus musculus
ttgctattttgtatcctgtttacat

SEQ ID NO: 988495 - DNA, 25 bp, Mus musculus
ttgctcaaagcaaccaacgcatcag

SEQ ID NO: 988496 - DNA, 25 bp, Mus musculus
ttgctcaaaggaaccaacgcatcag

SEQ ID NO: 988497 - DNA, 25 bp, Mus musculus
ttgctcaaccagatccttgcatgaa

SEQ ID NO: 988498 - DNA, 25 bp, Mus musculus
ttgctcaaccagcgcatcgttctgc

SEQ ID NO: 988499 - DNA, 25 bp, Mus musculus
ttgctcaaccagggcatcgttctgc

SEQ ID NO: 988500 - DNA, 25 bp, Mus musculus
ttgctcaaccagttccttgcatgaa

SEQ ID NO: 988501 - DNA, 25 bp, Mus musculus
ttgctcacagcggactacattcctg

SEQ ID NO: 988502 - DNA, 25 bp, Mus musculus
ttgctcacaggggactacattcctg

SEQ ID NO: 988503 - DNA, 25 bp, Mus musculus
ttgctcacccaggaagtgagagtct

SEQ ID NO: 988504 - DNA, 25 bp, Mus musculus
ttgctcacccaggatgtgagagtct

SEQ ID NO: 988505 - DNA, 25 bp, Mus musculus
ttgctcagaaccttacaatcttcct

SEQ ID NO: 988506 - DNA, 25 bp, Mus musculus
ttgctcagaacctttcaatcttcct

SEQ ID NO: 988507 - DNA, 25 bp, Mus musculus
ttgctcaggcttgtctttctatctt

SEQ ID NO: 988508 - DNA, 25 bp, Mus musculus
ttgctcaggcttgtgtttctatctt

SEQ ID NO: 988509 - DNA, 25 bp, Mus musculus
ttgctcatcagtcacttctcaggtt

SEQ ID NO: 988510 - DNA, 25 bp, Mus musculus
ttgctcatcagtcagttctcaggtt

SEQ ID NO: 988511 - DNA, 25 bp, Mus musculus
ttgctccaagcgccccgccgtcacc

SEQ ID NO: 988512 - DNA, 25 bp, Mus musculus
ttgctccaagggccccgccgtcacc

SEQ ID NO: 988513 - DNA, 25 bp, Mus musculus
ttgctcctggtgcacagccttcacc

SEQ ID NO: 988514 - DNA, 25 bp, Mus musculus
ttgctcctggtgcagagccttcacc

SEQ ID NO: 988515 - DNA, 25 bp, Mus musculus
ttgctcggaatgcgaaccctaatgg

SEQ ID NO: 988516 - DNA, 25 bp, Mus musculus
ttgctcggaatgggaaccctaatgg

SEQ ID NO: 988517 - DNA, 25 bp, Mus musculus
ttgctctctagaacagaactcatta

SEQ ID NO: 988518 - DNA, 25 bp, Mus musculus
ttgctctctagaactgaactcatta

SEQ ID NO: 988519 - DNA, 25 bp, Mus musculus
ttgctctggcagacgtcccattcct

SEQ ID NO: 988520 - DNA, 25 bp, Mus musculus
ttgctctggcagtcgtcccattcct

SEQ ID NO: 988521 - DNA, 25 bp, Mus musculus
ttgctcttctcacacgcacagcgga

SEQ ID NO: 988522 - DNA, 25 bp, Mus musculus
ttgctcttctcacaggcacagcgga

SEQ ID NO: 988523 - DNA, 25 bp, Mus musculus
ttgctgaaaaagacaactggcctgg

SEQ ID NO: 988524 - DNA, 25 bp, Mus musculus
ttgctgaaaaagtcaactggcctgg

SEQ ID NO: 988525 - DNA, 25 bp, Mus musculus
ttgctgaacccccacagaacctgat

SEQ ID NO: 988526 - DNA, 25 bp, Mus musculus
ttgctgaaccgccacagaacctgat

SEQ ID NO: 988527 - DNA, 25 bp, Mus musculus
ttgctgaacgtcgtcgtggacggac

SEQ ID NO: 988528 - DNA, 25 bp, Mus musculus
ttgctgaacgtcgtggtggacggac

SEQ ID NO: 988529 - DNA, 25 bp, Mus musculus
ttgctgaagaagagcatcatggtcc

SEQ ID NO: 988530 - DNA, 25 bp, Mus musculus
ttgctgaagaagcatgtggatgccg

SEQ ID NO: 988531 - DNA, 25 bp, Mus musculus
ttgctgaagaaggatgtggatgccg

SEQ ID NO: 988532 - DNA, 25 bp, Mus musculus
ttgctgaagaagtgcatcatggtcc

SEQ ID NO: 988533 - DNA, 25 bp, Mus musculus
ttgctgaattctgtctaataccacg

SEQ ID NO: 988534 - DNA, 25 bp, Mus musculus
ttgctgaattctgtgtaataccacg

SEQ ID NO: 988535 - DNA, 25 bp, Mus musculus
ttgctgacagcatgcctagccgagg

SEQ ID NO: 988536 - DNA, 25 bp, Mus musculus
ttgctgacaggatgcctagccgagg

SEQ ID NO: 988537 - DNA, 25 bp, Mus musculus
ttgctgagatcaaggcccagctgga

SEQ ID NO: 988538 - DNA, 25 bp, Mus musculus
ttgctgagatcatggcccagctgga

SEQ ID NO: 988539 - DNA, 25 bp, Mus musculus
ttgctgataagacgcaagtgtcaat

SEQ ID NO: 988540 - DNA, 25 bp, Mus musculus
ttgctgataagaggcaagtgtcaat

SEQ ID NO: 988541 - DNA, 25 bp, Mus musculus
ttgctgatctcacatgctgtttccg

SEQ ID NO: 988542 - DNA, 25 bp, Mus musculus
ttgctgatctcagatgctgtttccg

SEQ ID NO: 988543 - DNA, 25 bp, Mus musculus
ttgctgcagaggccccgtggggccc

SEQ ID NO: 988544 - DNA, 25 bp, Mus musculus
ttgctgcagagggcccgtggggccc

SEQ ID NO: 988545 - DNA, 25 bp, Mus musculus
ttgctgccagctatgaatcaagtcc

SEQ ID NO: 988546 - DNA, 25 bp, Mus musculus
ttgctgccaggtatgaatcaagtcc

SEQ ID NO: 988547 - DNA, 25 bp, Mus musculus
ttgctgccttacttcgtgacattgg

SEQ ID NO: 988548 - DNA, 25 bp, Mus musculus
ttgctgccttacttggtgacattgg

SEQ ID NO: 988549 - DNA, 25 bp, Mus musculus
ttgctgctagaatccgtctttggtc

SEQ ID NO: 988550 - DNA, 25 bp, Mus musculus
ttgctgctagaatcggtctttggtc

SEQ ID NO: 988551 - DNA, 25 bp, Mus musculus
ttgctgctcactcgattgctggttt

SEQ ID NO: 988552 - DNA, 25 bp, Mus musculus
ttgctgctcactggattgctggttt

SEQ ID NO: 988553 - DNA, 25 bp, Mus musculus
ttgctgctgcagcctgtgcacagct

SEQ ID NO: 988554 - DNA, 25 bp, Mus musculus
ttgctgctgcagcttaccaacatat

SEQ ID NO: 988555 - DNA, 25 bp, Mus musculus
ttgctgctgcaggctgtgcacagct

SEQ ID NO: 988556 - DNA, 25 bp, Mus musculus
ttgctgctgcaggttaccaacatat

SEQ ID NO: 988557 - DNA, 25 bp, Mus musculus
ttgctgctggaggtgccttactcag

SEQ ID NO: 988558 - DNA, 25 bp, Mus musculus
ttgctgctggcgtctgcgagcttta

SEQ ID NO: 988559 - DNA, 25 bp, Mus musculus
ttgctgctggctgacactttgcaaa

SEQ ID NO: 988560 - DNA, 25 bp, Mus musculus
ttgctgctggggtctgcgagcttta

SEQ ID NO: 988561 - DNA, 25 bp, Mus musculus
ttgctgctgggtgacactttgcaaa

SEQ ID NO: 988562 - DNA, 25 bp, Mus musculus
ttgctgctggtggtgccttactcag

SEQ ID NO: 988563 - DNA, 25 bp, Mus musculus
ttgctggaagagaaagaacgggacc

SEQ ID NO: 988564 - DNA, 25 bp, Mus musculus
ttgctggaagagtaagaacgggacc

SEQ ID NO: 988565 - DNA, 25 bp, Mus musculus
ttgctggactttcccttagagaagg

SEQ ID NO: 988566 - DNA, 25 bp, Mus musculus
ttgctggactttgccttagagaagg

SEQ ID NO: 988567 - DNA, 25 bp, Mus musculus
ttgctggagtcagacgagtttgaca

SEQ ID NO: 988568 - DNA, 25 bp, Mus musculus
ttgctggagtcagaggagtttgaca

SEQ ID NO: 988569 - DNA, 25 bp, Mus musculus
ttgctggcatgacagccctaaaggc

SEQ ID NO: 988570 - DNA, 25 bp, Mus musculus
ttgctggcatgagagccctaaaggc

SEQ ID NO: 988571 - DNA, 25 bp, Mus musculus
ttgctgggaggacagcgacatgttt

SEQ ID NO: 988572 - DNA, 25 bp, Mus musculus
ttgctgggaggagagcgacatgttt

SEQ ID NO: 988573 - DNA, 25 bp, Mus musculus
ttgctgggtctgaactttgtcttcc

SEQ ID NO: 988574 - DNA, 25 bp, Mus musculus
ttgctgggtctgtactttgtcttcc

SEQ ID NO: 988575 - DNA, 25 bp, Mus musculus
ttgctggtgaagatatgtaatccaa

SEQ ID NO: 988576 - DNA, 25 bp, Mus musculus
ttgctggtgaagcttcaattgtgaa

SEQ ID NO: 988577 - DNA, 25 bp, Mus musculus
ttgctggtgaaggttcaattgtgaa

SEQ ID NO: 988578 - DNA, 25 bp, Mus musculus
ttgctggtgaagttatgtaatccaa

SEQ ID NO: 988579 - DNA, 25 bp, Mus musculus
ttgctggtgcggctgagcagcatcc

SEQ ID NO: 988580 - DNA, 25 bp, Mus musculus
ttgctggtgcgggtgagcagcatcc

SEQ ID NO: 988581 - DNA, 25 bp, Mus musculus
ttgctggtggaacgaggcaggattg

SEQ ID NO: 988582 - DNA, 25 bp, Mus musculus
ttgctggtggaaggaggcaggattg

SEQ ID NO: 988583 - DNA, 25 bp, Mus musculus
ttgctggttggtcgttttgggctgt

SEQ ID NO: 988584 - DNA, 25 bp, Mus musculus
ttgctggttggtggttttgggctgt

SEQ ID NO: 988585 - DNA, 25 bp, Mus musculus
ttgctgtatttgccaaatgtggtcc

SEQ ID NO: 988586 - DNA, 25 bp, Mus musculus
ttgctgtatttggcaaatgtggtcc

SEQ ID NO: 988587 - DNA, 25 bp, Mus musculus
ttgctgtcagcaacccatgtgatgg

SEQ ID NO: 988588 - DNA, 25 bp, Mus musculus
ttgctgtcagcgtcgaaattgggat

SEQ ID NO: 988589 - DNA, 25 bp, Mus musculus
ttgctgtcaggaacccatgtgatgg

SEQ ID NO: 988590 - DNA, 25 bp, Mus musculus
ttgctgtcagggtcgaaattgggat

SEQ ID NO: 988591 - DNA, 25 bp, Mus musculus
ttgctgtgatcatgctccttacgat

SEQ ID NO: 988592 - DNA, 25 bp, Mus musculus
ttgctgtgatgatgctccttacgat

SEQ ID NO: 988593 - DNA, 25 bp, Mus musculus
ttgctgtgggaaagtacattgagca

SEQ ID NO: 988594 - DNA, 25 bp, Mus musculus
ttgctgtgggaatgtacattgagca

SEQ ID NO: 988595 - DNA, 25 bp, Mus musculus
ttgctgttctctttgtgaagttctc

SEQ ID NO: 988596 - DNA, 25 bp, Mus musculus
ttgctgttctgtttgtgaagttctc

SEQ ID NO: 988597 - DNA, 25 bp, Mus musculus
ttgctgttcttgcggcactgcaaaa

SEQ ID NO: 988598 - DNA, 25 bp, Mus musculus
ttgctgttcttggggcactgcaaaa

SEQ ID NO: 988599 - DNA, 25 bp, Mus musculus
ttgctgttctttatcctgggtgctg

SEQ ID NO: 988600 - DNA, 25 bp, Mus musculus
ttgctgttctttttcctgggtgctg

SEQ ID NO: 988601 - DNA, 25 bp, Mus musculus
ttgcttatggatcactccttaacct

SEQ ID NO: 988602 - DNA, 25 bp, Mus musculus
ttgcttatggatgactccttaacct

SEQ ID NO: 988603 - DNA, 25 bp, Mus musculus
ttgcttcatgataggatgtgacaac

SEQ ID NO: 988604 - DNA, 25 bp, Mus musculus
ttgcttcatgattggatgtgacaac

SEQ ID NO: 988605 - DNA, 25 bp, Mus musculus
ttgcttccaaagcaaaagcgacatg

SEQ ID NO: 988606 - DNA, 25 bp, Mus musculus
ttgcttccaaagcaggaaaagcgac

SEQ ID NO: 988607 - DNA, 25 bp, Mus musculus
ttgcttccaaaggaaaagcgacatg

SEQ ID NO: 988608 - DNA, 25 bp, Mus musculus
ttgcttccaaaggaggaaaagcgac

SEQ ID NO: 988609 - DNA, 25 bp, Mus musculus
ttgcttctgacaatcgaatcccgcc

SEQ ID NO: 988610 - DNA, 25 bp, Mus musculus
ttgcttctgacaatggaatcccgcc

SEQ ID NO: 988611 - DNA, 25 bp, Mus musculus
ttgcttctggagacatctctgggaa

SEQ ID NO: 988612 - DNA, 25 bp, Mus musculus
ttgcttctggagtcatctctgggaa

SEQ ID NO: 988613 - DNA, 25 bp, Mus musculus
ttgcttctggcgtcacaggatgctg

SEQ ID NO: 988614 - DNA, 25 bp, Mus musculus
ttgcttctggggtcacaggatgctg

SEQ ID NO: 988615 - DNA, 25 bp, Mus musculus
ttgcttctgttacgtgctggagagt

SEQ ID NO: 988616 - DNA, 25 bp, Mus musculus
ttgcttctgttaggtgctggagagt

SEQ ID NO: 988617 - DNA, 25 bp, Mus musculus
ttgcttgaatcggcctgtgttttat

SEQ ID NO: 988618 - DNA, 25 bp, Mus musculus
ttgcttgaatgggcctgtgttttat

SEQ ID NO: 988619 - DNA, 25 bp, Mus musculus
ttgcttggtgctcggatcctgttta

SEQ ID NO: 988620 - DNA, 25 bp, Mus musculus
ttgcttggtgctgggatcctgttta

SEQ ID NO: 988621 - DNA, 25 bp, Mus musculus
ttgctttgattccacctttgatgtt

SEQ ID NO: 988622 - DNA, 25 bp, Mus musculus
ttgctttgattccagctttgatgtt

SEQ ID NO: 988623 - DNA, 25 bp, Mus musculus
ttgctttgtgacctactctacagta

SEQ ID NO: 988624 - DNA, 25 bp, Mus musculus
ttgctttgtgacgtactctacagta

SEQ ID NO: 988625 - DNA, 25 bp, Mus musculus
ttgcttttatcaattattttcaaaa

SEQ ID NO: 988626 - DNA, 25 bp, Mus musculus
ttgcttttatcatttattttcaaaa

SEQ ID NO: 988627 - DNA, 25 bp, Mus musculus
ttggaaaagataagatgaggaattt

SEQ ID NO: 988628 - DNA, 25 bp, Mus musculus
ttggaaaagatatgatgaggaattt

SEQ ID NO: 988629 - DNA, 25 bp, Mus musculus
ttggaaacagcttcagacaatgaat

SEQ ID NO: 988630 - DNA, 25 bp, Mus musculus
ttggaaacaggttcagacaatgaat

SEQ ID NO: 988631 - DNA, 25 bp, Mus musculus
ttggaaagctcagacctgccgagag

SEQ ID NO: 988632 - DNA, 25 bp, Mus musculus
ttggaaagctcagagctgccgagag

SEQ ID NO: 988633 - DNA, 25 bp, Mus musculus
ttggaaatcaatacttgtatcaaat

SEQ ID NO: 988634 - DNA, 25 bp, Mus musculus
ttggaaatcattacttgtatcaaat

SEQ ID NO: 988635 - DNA, 25 bp, Mus musculus
ttggaaatgacacgagatattgatg

SEQ ID NO: 988636 - DNA, 25 bp, Mus musculus
ttggaaatgacaggagatattgatg

SEQ ID NO: 988637 - DNA, 25 bp, Mus musculus
ttggaaattacctgcctttcctaat

SEQ ID NO: 988638 - DNA, 25 bp, Mus musculus
ttggaaattacctggctttcctaat

SEQ ID NO: 988639 - DNA, 25 bp, Mus musculus
ttggaacaaaatagatcgtggctca

SEQ ID NO: 988640 - DNA, 25 bp, Mus musculus
ttggaacaaaattgatcgtggctca

SEQ ID NO: 988641 - DNA, 25 bp, Mus musculus
ttggaacagcagatgcaaactccaa

SEQ ID NO: 988642 - DNA, 25 bp, Mus musculus
ttggaacagcagttgcaaactccaa

SEQ ID NO: 988643 - DNA, 25 bp, Mus musculus
ttggaaccagacgggcatgcgggac

SEQ ID NO: 988644 - DNA, 25 bp, Mus musculus
ttggaaccagtcgggcatgcgggac

SEQ ID NO: 988645 - DNA, 25 bp, Mus musculus
ttggaacctgattgccaacgtgctg

SEQ ID NO: 988646 - DNA, 25 bp, Mus musculus
ttggaacctgtttgccaacgtgctg

SEQ ID NO: 988647 - DNA, 25 bp, Mus musculus
ttggaagaaaggcttgttggagctc

SEQ ID NO: 988648 - DNA, 25 bp, Mus musculus
ttggaagaaagggttgttggagctc

SEQ ID NO: 988649 - DNA, 25 bp, Mus musculus
ttggaagaatctcactttagcatgg

SEQ ID NO: 988650 - DNA, 25 bp, Mus musculus
ttggaagaatctgactttagcatgg

SEQ ID NO: 988651 - DNA, 25 bp, Mus musculus
ttggaagaatttcagatgcccgtgt

SEQ ID NO: 988652 - DNA, 25 bp, Mus musculus
ttggaagaatttcagtgtctctgaa

SEQ ID NO: 988653 - DNA, 25 bp, Mus musculus
ttggaagaatttgagatgcccgtgt

SEQ ID NO: 988654 - DNA, 25 bp, Mus musculus
ttggaagaatttgagtgtctctgaa

SEQ ID NO: 988655 - DNA, 25 bp, Mus musculus
ttggaagatcagctcgctttggtca

SEQ ID NO: 988656 - DNA, 25 bp, Mus musculus
ttggaagatcaggtcgctttggtca

SEQ ID NO: 988657 - DNA, 25 bp, Mus musculus
ttggaagctacttacgctactcagt

SEQ ID NO: 988658 - DNA, 25 bp, Mus musculus
ttggaagctacttaggctactcagt

SEQ ID NO: 988659 - DNA, 25 bp, Mus musculus
ttggaaggttcaccgagccccatgc

SEQ ID NO: 988660 - DNA, 25 bp, Mus musculus
ttggaaggttcagcgagccccatgc

SEQ ID NO: 988661 - DNA, 25 bp, Mus musculus
ttggaagtcggctgacattaacagc

SEQ ID NO: 988662 - DNA, 25 bp, Mus musculus
ttggaagtcggctgtcattaacagc

SEQ ID NO: 988663 - DNA, 25 bp, Mus musculus
ttggaatcctagctcctgtcatttg

SEQ ID NO: 988664 - DNA, 25 bp, Mus musculus
ttggaatcctaggtcctgtcatttg

SEQ ID NO: 988665 - DNA, 25 bp, Mus musculus
ttggaatgaccgagagtgggaccgt

SEQ ID NO: 988666 - DNA, 25 bp, Mus musculus
ttggaatgaccgtgagtgggaccgt

SEQ ID NO: 988667 - DNA, 25 bp, Mus musculus
ttggaatgagactgcagatcttgga

SEQ ID NO: 988668 - DNA, 25 bp, Mus musculus
ttggaatgagtctgcagatcttgga

SEQ ID NO: 988669 - DNA, 25 bp, Mus musculus
ttggacaacccacgcgctaagcgag

SEQ ID NO: 988670 - DNA, 25 bp, Mus musculus
ttggacaacccaggcgctaagcgag

SEQ ID NO: 988671 - DNA, 25 bp, Mus musculus
ttggacagagcgcgaacggccacag

SEQ ID NO: 988672 - DNA, 25 bp, Mus musculus
ttggacagagcgggaacggccacag

SEQ ID NO: 988673 - DNA, 25 bp, Mus musculus
ttggacagcaagcgccatgtgaaac

SEQ ID NO: 988674 - DNA, 25 bp, Mus musculus
ttggacagcaagggccatgtgaaac

SEQ ID NO: 988675 - DNA, 25 bp, Mus musculus
ttggacagtgagctggtgacccctc

SEQ ID NO: 988676 - DNA, 25 bp, Mus musculus
ttggacagtgaggtggtgacccctc

SEQ ID NO: 988677 - DNA, 25 bp, Mus musculus
ttggaccacgagattctcgagttcg

SEQ ID NO: 988678 - DNA, 25 bp, Mus musculus
ttggaccacgagtttctcgagttcg

SEQ ID NO: 988679 - DNA, 25 bp, Mus musculus
ttggaccacgctatggttttggaga

SEQ ID NO: 988680 - DNA, 25 bp, Mus musculus
ttggaccacggtatggttttggaga

SEQ ID NO: 988681 - DNA, 25 bp, Mus musculus
ttggaccctggtaacgtgccagagc

SEQ ID NO: 988682 - DNA, 25 bp, Mus musculus
ttggaccctggtaaggtgccagagc

SEQ ID NO: 988683 - DNA, 25 bp, Mus musculus
ttggaccgactgcttactgatgtca

SEQ ID NO: 988684 - DNA, 25 bp, Mus musculus
ttggaccgactggttactgatgtca

SEQ ID NO: 988685 - DNA, 25 bp, Mus musculus
ttggacggagatgcctggaccaacc

SEQ ID NO: 988686 - DNA, 25 bp, Mus musculus
ttggacggagttgcctggaccaacc

SEQ ID NO: 988687 - DNA, 25 bp, Mus musculus
ttggactcagaggccactacttatg

SEQ ID NO: 988688 - DNA, 25 bp, Mus musculus
ttggactcagtggccactacttatg

SEQ ID NO: 988689 - DNA, 25 bp, Mus musculus
ttggactgccagaacttggctccag

SEQ ID NO: 988690 - DNA, 25 bp, Mus musculus
ttggactgccagcaagtctcaggtc

SEQ ID NO: 988691 - DNA, 25 bp, Mus musculus
ttggactgccagcgtcacgtggtac

SEQ ID NO: 988692 - DNA, 25 bp, Mus musculus
ttggactgccaggaagtctcaggtc

SEQ ID NO: 988693 - DNA, 25 bp, Mus musculus
ttggactgccagggtcacgtggtac

SEQ ID NO: 988694 - DNA, 25 bp, Mus musculus
ttggactgccagtacttggctccag

SEQ ID NO: 988695 - DNA, 25 bp, Mus musculus
ttggactgtgagaaggcttctttgg

SEQ ID NO: 988696 - DNA, 25 bp, Mus musculus
ttggactgtgagccttctttggctt

SEQ ID NO: 988697 - DNA, 25 bp, Mus musculus
ttggactgtgaggcttctttggctt

SEQ ID NO: 988698 - DNA, 25 bp, Mus musculus
ttggactgtgagtaggcttctttgg

SEQ ID NO: 988699 - DNA, 25 bp, Mus musculus
ttggacttcagacaatctgttaaaa

SEQ ID NO: 988700 - DNA, 25 bp, Mus musculus
ttggacttcagagaatctgttaaaa

SEQ ID NO: 988701 - DNA, 25 bp, Mus musculus
ttggacttgcaactctctttacaga

SEQ ID NO: 988702 - DNA, 25 bp, Mus musculus
ttggacttgcaagtctctttacaga

SEQ ID NO: 988703 - DNA, 25 bp, Mus musculus
ttggacttggcgatcctgtactacg

SEQ ID NO: 988704 - DNA, 25 bp, Mus musculus
ttggacttggggatcctgtactacg

SEQ ID NO: 988705 - DNA, 25 bp, Mus musculus
ttggagaaagctaacgcttatgcag

SEQ ID NO: 988706 - DNA, 25 bp, Mus musculus
ttggagaaagctaaggcttatgcag

SEQ ID NO: 988707 - DNA, 25 bp, Mus musculus
ttggagaagtccaaaaggatgataa

SEQ ID NO: 988708 - DNA, 25 bp, Mus musculus
ttggagaagtgcaaaaggatgataa

SEQ ID NO: 988709 - DNA, 25 bp, Mus musculus
ttggagaatgcttataagtacatgg

SEQ ID NO: 988710 - DNA, 25 bp, Mus musculus
ttggagaatggttataagtacatgg

SEQ ID NO: 988711 - DNA, 25 bp, Mus musculus
ttggagacaacttagtaggaggact

SEQ ID NO: 988712 - DNA, 25 bp, Mus musculus
ttggagacaagttagtaggaggact

SEQ ID NO: 988713 - DNA, 25 bp, Mus musculus
ttggagacagaaaagccaccacccc

SEQ ID NO: 988714 - DNA, 25 bp, Mus musculus
ttggagacagtaaagccaccacccc

SEQ ID NO: 988715 - DNA, 25 bp, Mus musculus
ttggagacatgaccagctactccat

SEQ ID NO: 988716 - DNA, 25 bp, Mus musculus
ttggagacatgacgaactcagccac

SEQ ID NO: 988717 - DNA, 25 bp, Mus musculus
ttggagacatgacggctcatccgct

SEQ ID NO: 988718 - DNA, 25 bp, Mus musculus
ttggagacatgactctaaggttgtg

SEQ ID NO: 988719 - DNA, 25 bp, Mus musculus
ttggagacatgagcagctactccat

SEQ ID NO: 988720 - DNA, 25 bp, Mus musculus
ttggagacatgaggaactcagccac

SEQ ID NO: 988721 - DNA, 25 bp, Mus musculus
ttggagacatgagggctcatccgct

SEQ ID NO: 988722 - DNA, 25 bp, Mus musculus
ttggagacatgagtctaaggttgtg

SEQ ID NO: 988723 - DNA, 25 bp, Mus musculus
ttggagagagagccacgattacagg

SEQ ID NO: 988724 - DNA, 25 bp, Mus musculus
ttggagagagaggcacgattacagg

SEQ ID NO: 988725 - DNA, 25 bp, Mus musculus
ttggagagagtgcgcatgttactgg

SEQ ID NO: 988726 - DNA, 25 bp, Mus musculus
ttggagagagtgggcatgttactgg

SEQ ID NO: 988727 - DNA, 25 bp, Mus musculus
ttggagagggctcttatggcagcgt

SEQ ID NO: 988728 - DNA, 25 bp, Mus musculus
ttggagaggggtcttatggcagcgt

SEQ ID NO: 988729 - DNA, 25 bp, Mus musculus
ttggagatatgacacgaaagtaggt

SEQ ID NO: 988730 - DNA, 25 bp, Mus musculus
ttggagatatgacgtactccatccg

SEQ ID NO: 988731 - DNA, 25 bp, Mus musculus
ttggagatatgagacgaaagtaggt

SEQ ID NO: 988732 - DNA, 25 bp, Mus musculus
ttggagatatgaggtactccatccg

SEQ ID NO: 988733 - DNA, 25 bp, Mus musculus
ttggagatcacacacatgggggtcg

SEQ ID NO: 988734 - DNA, 25 bp, Mus musculus
ttggagatcacagacatgggggtcg

SEQ ID NO: 988735 - DNA, 25 bp, Mus musculus
ttggagattgcggcctgtgttttat

SEQ ID NO: 988736 - DNA, 25 bp, Mus musculus
ttggagattggggcctgtgttttat

SEQ ID NO: 988737 - DNA, 25 bp, Mus musculus
ttggagcaatccaagttaaagaaag

SEQ ID NO: 988738 - DNA, 25 bp, Mus musculus
ttggagcaatccattaaagaaagaa

SEQ ID NO: 988739 - DNA, 25 bp, Mus musculus
ttggagcaatcctagttaaagaaag

SEQ ID NO: 988740 - DNA, 25 bp, Mus musculus
ttggagcaatcctttaaagaaagaa

SEQ ID NO: 988741 - DNA, 25 bp, Mus musculus
ttggagcagcctcgggaatctatat

SEQ ID NO: 988742 - DNA, 25 bp, Mus musculus
ttggagcagcctggggaatctatat

SEQ ID NO: 988743 - DNA, 25 bp, Mus musculus
ttggagcatttgtgcgacacagaga

SEQ ID NO: 988744 - DNA, 25 bp, Mus musculus
ttggagcatttgtgggacacagaga

SEQ ID NO: 988745 - DNA, 25 bp, Mus musculus
ttggagccagccaggtgcagtctat

SEQ ID NO: 988746 - DNA, 25 bp, Mus musculus
ttggagccagctacgtacagacgct

SEQ ID NO: 988747 - DNA, 25 bp, Mus musculus
ttggagccaggcaggtgcagtctat

SEQ ID NO: 988748 - DNA, 25 bp, Mus musculus
ttggagccaggtacgtacagacgct

SEQ ID NO: 988749 - DNA, 25 bp, Mus musculus
ttggagcctctacactaatgatggg

SEQ ID NO: 988750 - DNA, 25 bp, Mus musculus
ttggagcctctacagtaatgatggg

SEQ ID NO: 988751 - DNA, 25 bp, Mus musculus
ttggagctgaccatctgacaaaacc

SEQ ID NO: 988752 - DNA, 25 bp, Mus musculus
ttggagctgaccatgtgacaaaacc

SEQ ID NO: 988753 - DNA, 25 bp, Mus musculus
ttggaggaagccaacccctggggct

SEQ ID NO: 988754 - DNA, 25 bp, Mus musculus
ttggaggaagccaagccctggggct

SEQ ID NO: 988755 - DNA, 25 bp, Mus musculus
ttggaggaataaacattgctgaggc

SEQ ID NO: 988756 - DNA, 25 bp, Mus musculus
ttggaggaattaacattgctgaggc

SEQ ID NO: 988757 - DNA, 25 bp, Mus musculus
ttggaggagaatataaaagaagatg

SEQ ID NO: 988758 - DNA, 25 bp, Mus musculus
ttggaggagaatttaaaagaagatg

SEQ ID NO: 988759 - DNA, 25 bp, Mus musculus
ttggaggagagacaatgactctgtg

SEQ ID NO: 988760 - DNA, 25 bp, Mus musculus
ttggaggagagacgtacaatttctt

SEQ ID NO: 988761 - DNA, 25 bp, Mus musculus
ttggaggagagagaatgactctgtg

SEQ ID NO: 988762 - DNA, 25 bp, Mus musculus
ttggaggagagaggtacaatttctt

SEQ ID NO: 988763 - DNA, 25 bp, Mus musculus
ttggaggatagaaccatcaggctgc

SEQ ID NO: 988764 - DNA, 25 bp, Mus musculus
ttggaggatagaaccgtgcgattgc

SEQ ID NO: 988765 - DNA, 25 bp, Mus musculus
ttggaggatagaacgatcaggctgc

SEQ ID NO: 988766 - DNA, 25 bp, Mus musculus
ttggaggatagaacggtgcgattgc

SEQ ID NO: 988767 - DNA, 25 bp, Mus musculus
ttggaggtcaacaacgtggctggaa

SEQ ID NO: 988768 - DNA, 25 bp, Mus musculus
ttggaggtcaacaaggtggctggaa

SEQ ID NO: 988769 - DNA, 25 bp, Mus musculus
ttggaggtggagcacgaccacagga

SEQ ID NO: 988770 - DNA, 25 bp, Mus musculus
ttggaggtggaggacgaccacagga

SEQ ID NO: 988771 - DNA, 25 bp, Mus musculus
ttggaggtgtggctgccagtggaat

SEQ ID NO: 988772 - DNA, 25 bp, Mus musculus
ttggaggtgtgggtgccagtggaat

SEQ ID NO: 988773 - DNA, 25 bp, Mus musculus
ttggaggttggcggagctcactctt

SEQ ID NO: 988774 - DNA, 25 bp, Mus musculus
ttggaggttggcggtgctcactctt

SEQ ID NO: 988775 - DNA, 25 bp, Mus musculus
ttggaggtttaaagtgtctcatgcg

SEQ ID NO: 988776 - DNA, 25 bp, Mus musculus
ttggaggtttaatgtgtctcatgcg

SEQ ID NO: 988777 - DNA, 25 bp, Mus musculus
ttggagtagaacaatccccttctgc

SEQ ID NO: 988778 - DNA, 25 bp, Mus musculus
ttggagtagatcaatccccttctgc

SEQ ID NO: 988779 - DNA, 25 bp, Mus musculus
ttggagtagatttacatgccagcac

SEQ ID NO: 988780 - DNA, 25 bp, Mus musculus
ttggagtagatttagatgccagcac

SEQ ID NO: 988781 - DNA, 25 bp, Mus musculus
ttggagtcagggcaaatgagcatct

SEQ ID NO: 988782 - DNA, 25 bp, Mus musculus
ttggagtcagggctcactaggattg

SEQ ID NO: 988783 - DNA, 25 bp, Mus musculus
ttggagtcaggggaaatgagcatct

SEQ ID NO: 988784 - DNA, 25 bp, Mus musculus
ttggagtcaggggtcactaggattg

SEQ ID NO: 988785 - DNA, 25 bp, Mus musculus
ttggatatcgagcctgaagtccctg

SEQ ID NO: 988786 - DNA, 25 bp, Mus musculus
ttggatatcgaggctgaagtccctg

SEQ ID NO: 988787 - DNA, 25 bp, Mus musculus
ttggatattagaaatgctacaaagc

SEQ ID NO: 988788 - DNA, 25 bp, Mus musculus
ttggatattagatatgctacaaagc

SEQ ID NO: 988789 - DNA, 25 bp, Mus musculus
ttggatcacatgctgggcctagagc

SEQ ID NO: 988790 - DNA, 25 bp, Mus musculus
ttggatcacatggtgggcctagagc

SEQ ID NO: 988791 - DNA, 25 bp, Mus musculus
ttggatccagcaagtggaccagagt

SEQ ID NO: 988792 - DNA, 25 bp, Mus musculus
ttggatccagcatgtggaccagagt

SEQ ID NO: 988793 - DNA, 25 bp, Mus musculus
ttggatccagcccgtggtcccaaac

SEQ ID NO: 988794 - DNA, 25 bp, Mus musculus
ttggatccagccggtggtcccaaac

SEQ ID NO: 988795 - DNA, 25 bp, Mus musculus
ttggatctactgagggcccagccac

SEQ ID NO: 988796 - DNA, 25 bp, Mus musculus
ttggatctactgcttctgcagtaca

SEQ ID NO: 988797 - DNA, 25 bp, Mus musculus
ttggatctactggttctgcagtaca

SEQ ID NO: 988798 - DNA, 25 bp, Mus musculus
ttggatctactgtgggcccagccac

SEQ ID NO: 988799 - DNA, 25 bp, Mus musculus
ttggatctcaggccatgcccaagag

SEQ ID NO: 988800 - DNA, 25 bp, Mus musculus
ttggatctcagggcatgcccaagag

SEQ ID NO: 988801 - DNA, 25 bp, Mus musculus
ttggatctcataagagaggagccaa

SEQ ID NO: 988802 - DNA, 25 bp, Mus musculus
ttggatctcatatgagaggagccaa

SEQ ID NO: 988803 - DNA, 25 bp, Mus musculus
ttggatcttcagaaatactgggact

SEQ ID NO: 988804 - DNA, 25 bp, Mus musculus
ttggatcttcagtaatactgggact

SEQ ID NO: 988805 - DNA, 25 bp, Mus musculus
ttggatgaaacgctgtcttcattga

SEQ ID NO: 988806 - DNA, 25 bp, Mus musculus
ttggatgaaacggtgtcttcattga

SEQ ID NO: 988807 - DNA, 25 bp, Mus musculus
ttggatgagaatcaatgcagagtca

SEQ ID NO: 988808 - DNA, 25 bp, Mus musculus
ttggatgagaatgaatgcagagtca

SEQ ID NO: 988809 - DNA, 25 bp, Mus musculus
ttggatgcacagcagtatgagttca

SEQ ID NO: 988810 - DNA, 25 bp, Mus musculus
ttggatgcacaggagtatgagttca

SEQ ID NO: 988811 - DNA, 25 bp, Mus musculus
ttggatgctgagcacatcgtgaaca

SEQ ID NO: 988812 - DNA, 25 bp, Mus musculus
ttggatgctgagcatattgtaggca

SEQ ID NO: 988813 - DNA, 25 bp, Mus musculus
ttggatgctgagcgcactctgaggc

SEQ ID NO: 988814 - DNA, 25 bp, Mus musculus
ttggatgctgaggacatcgtgaaca

SEQ ID NO: 988815 - DNA, 25 bp, Mus musculus
ttggatgctgaggatattgtaggca

SEQ ID NO: 988816 - DNA, 25 bp, Mus musculus
ttggatgctgagggcactctgaggc

SEQ ID NO: 988817 - DNA, 25 bp, Mus musculus
ttggatgtccagacaactacagggc

SEQ ID NO: 988818 - DNA, 25 bp, Mus musculus
ttggatgtccagtcaactacagggc

SEQ ID NO: 988819 - DNA, 25 bp, Mus musculus
ttggatgttaaaccatgggatgatg

SEQ ID NO: 988820 - DNA, 25 bp, Mus musculus
ttggatgttaaaccttgggatgatg

SEQ ID NO: 988821 - DNA, 25 bp, Mus musculus
ttggatgttccgctatctgccccac

SEQ ID NO: 988822 - DNA, 25 bp, Mus musculus
ttggatgttccggtatctgccccac

SEQ ID NO: 988823 - DNA, 25 bp, Mus musculus
ttggattataatgacgcaaagggtg

SEQ ID NO: 988824 - DNA, 25 bp, Mus musculus
ttggattataatgaggcaaagggtg

SEQ ID NO: 988825 - DNA, 25 bp, Mus musculus
ttggattcagcagtgcactcacaga

SEQ ID NO: 988826 - DNA, 25 bp, Mus musculus
ttggattcagctacagaagcctaaa

SEQ ID NO: 988827 - DNA, 25 bp, Mus musculus
ttggattcaggagtgcactcacaga

SEQ ID NO: 988828 - DNA, 25 bp, Mus musculus
ttggattcaggtacagaagcctaaa

SEQ ID NO: 988829 - DNA, 25 bp, Mus musculus
ttggatttttgaagccatatgaaaa

SEQ ID NO: 988830 - DNA, 25 bp, Mus musculus
ttggatttttgatgccatatgaaaa

SEQ ID NO: 988831 - DNA, 25 bp, Mus musculus
ttggcaaactcacatccaatctcat

SEQ ID NO: 988832 - DNA, 25 bp, Mus musculus
ttggcaaactcagatccaatctcat

SEQ ID NO: 988833 - DNA, 25 bp, Mus musculus
ttggcaacaacgctctggtgcaagt

SEQ ID NO: 988834 - DNA, 25 bp, Mus musculus
ttggcaacaacggtctggtgcaagt

SEQ ID NO: 988835 - DNA, 25 bp, Mus musculus
ttggcaacagaccccaatatcctga

SEQ ID NO: 988836 - DNA, 25 bp, Mus musculus
ttggcaacagtccccaatatcctga

SEQ ID NO: 988837 - DNA, 25 bp, Mus musculus
ttggcaagcactggtgacgtatgcc

SEQ ID NO: 988838 - DNA, 25 bp, Mus musculus
ttggcaagcagtggtgacgtatgcc

SEQ ID NO: 988839 - DNA, 25 bp, Mus musculus
ttggcaagtttgcgcctgccttaag

SEQ ID NO: 988840 - DNA, 25 bp, Mus musculus
ttggcaagtttgggcctgccttaag

SEQ ID NO: 988841 - DNA, 25 bp, Mus musculus
ttggcaataactattacaactggac

SEQ ID NO: 988842 - DNA, 25 bp, Mus musculus
ttggcaataagtattacaactggac

SEQ ID NO: 988843 - DNA, 25 bp, Mus musculus
ttggcaatgatgcaagcaattttgg

SEQ ID NO: 988844 - DNA, 25 bp, Mus musculus
ttggcaatgatgctggctatggcgg

SEQ ID NO: 988845 - DNA, 25 bp, Mus musculus
ttggcaatgatgctggttatggagg

SEQ ID NO: 988846 - DNA, 25 bp, Mus musculus
ttggcaatgatggaagcaattttgg

SEQ ID NO: 988847 - DNA, 25 bp, Mus musculus
ttggcaatgatggtggctatggcgg

SEQ ID NO: 988848 - DNA, 25 bp, Mus musculus
ttggcaatgatggtggttatggagg

SEQ ID NO: 988849 - DNA, 25 bp, Mus musculus
ttggcacaagctgcaaatataaatg

SEQ ID NO: 988850 - DNA, 25 bp, Mus musculus
ttggcacaaggtgcaaatataaatg

SEQ ID NO: 988851 - DNA, 25 bp, Mus musculus
ttggcacctgagcacaaagtctgga

SEQ ID NO: 988852 - DNA, 25 bp, Mus musculus
ttggcacctgaggacaaagtctgga

SEQ ID NO: 988853 - DNA, 25 bp, Mus musculus
ttggcacgagagcaccctctcaaag

SEQ ID NO: 988854 - DNA, 25 bp, Mus musculus
ttggcacgagaggaccctctcaaag

SEQ ID NO: 988855 - DNA, 25 bp, Mus musculus
ttggcactcccatgcgttctccata

SEQ ID NO: 988856 - DNA, 25 bp, Mus musculus
ttggcactcccatgggttctccata

SEQ ID NO: 988857 - DNA, 25 bp, Mus musculus
ttggcactctttgacgaagaaatgg

SEQ ID NO: 988858 - DNA, 25 bp, Mus musculus
ttggcactctttgaggaagaaatgg

SEQ ID NO: 988859 - DNA, 25 bp, Mus musculus
ttggcagaagctagcacggcttctc

SEQ ID NO: 988860 - DNA, 25 bp, Mus musculus
ttggcagaagctctgcagatccaca

SEQ ID NO: 988861 - DNA, 25 bp, Mus musculus
ttggcagaaggtagcacggcttctc

SEQ ID NO: 988862 - DNA, 25 bp, Mus musculus
ttggcagaaggtctgcagatccaca

SEQ ID NO: 988863 - DNA, 25 bp, Mus musculus
ttggcagaggagagcctgaacatct

SEQ ID NO: 988864 - DNA, 25 bp, Mus musculus
ttggcagaggagtgcctgaacatct

SEQ ID NO: 988865 - DNA, 25 bp, Mus musculus
ttggcagctcagccctatgggcttt

SEQ ID NO: 988866 - DNA, 25 bp, Mus musculus
ttggcagctcaggcctatgggcttt

SEQ ID NO: 988867 - DNA, 25 bp, Mus musculus
ttggcagcttcacattcccttcagg

SEQ ID NO: 988868 - DNA, 25 bp, Mus musculus
ttggcagcttcagattcccttcagg

SEQ ID NO: 988869 - DNA, 25 bp, Mus musculus
ttggcaggaggccacagacaagagg

SEQ ID NO: 988870 - DNA, 25 bp, Mus musculus
ttggcaggaggccagagacaagagg

SEQ ID NO: 988871 - DNA, 25 bp, Mus musculus
ttggcaggcctgaccagcttggtgg

SEQ ID NO: 988872 - DNA, 25 bp, Mus musculus
ttggcaggcctgtccagcttggtgg

SEQ ID NO: 988873 - DNA, 25 bp, Mus musculus
ttggcatcaaggagacatcaacaag

SEQ ID NO: 988874 - DNA, 25 bp, Mus musculus
ttggcatcaaggagcaggacatcaa

SEQ ID NO: 988875 - DNA, 25 bp, Mus musculus
ttggcatcaaggaggaggacatcaa

SEQ ID NO: 988876 - DNA, 25 bp, Mus musculus
ttggcatcaaggtgacatcaacaag

SEQ ID NO: 988877 - DNA, 25 bp, Mus musculus
ttggcatcaccttgtttgggcccaa

SEQ ID NO: 988878 - DNA, 25 bp, Mus musculus
ttggcatcacgttgtttgggcccaa

SEQ ID NO: 988879 - DNA, 25 bp, Mus musculus
ttggcatcccctatcatcctataca

SEQ ID NO: 988880 - DNA, 25 bp, Mus musculus
ttggcatcccctatgatcctataca

SEQ ID NO: 988881 - DNA, 25 bp, Mus musculus
ttggcatgaaagcaggaagcggctg

SEQ ID NO: 988882 - DNA, 25 bp, Mus musculus
ttggcatgaaagccccagcttcggt

SEQ ID NO: 988883 - DNA, 25 bp, Mus musculus
ttggcatgaaaggaggaagcggctg

SEQ ID NO: 988884 - DNA, 25 bp, Mus musculus
ttggcatgaaaggcccagcttcggt

SEQ ID NO: 988885 - DNA, 25 bp, Mus musculus
ttggcatttactatcacggactcat

SEQ ID NO: 988886 - DNA, 25 bp, Mus musculus
ttggcatttactatgacggactcat

SEQ ID NO: 988887 - DNA, 25 bp, Mus musculus
ttggccaagcagcgaaaagctgctt

SEQ ID NO: 988888 - DNA, 25 bp, Mus musculus
ttggccaagcagggaaaagctgctt

SEQ ID NO: 988889 - DNA, 25 bp, Mus musculus
ttggccaccactcctaatagtacag

SEQ ID NO: 988890 - DNA, 25 bp, Mus musculus
ttggccaccagtcctaatagtacag

SEQ ID NO: 988891 - DNA, 25 bp, Mus musculus
ttggccacttcaccaagttcattcc

SEQ ID NO: 988892 - DNA, 25 bp, Mus musculus
ttggccacttcagcaagttcattcc

SEQ ID NO: 988893 - DNA, 25 bp, Mus musculus
ttggccagctcgagtagatgaagtt

SEQ ID NO: 988894 - DNA, 25 bp, Mus musculus
ttggccagctcgtgtagatgaagtt

SEQ ID NO: 988895 - DNA, 25 bp, Mus musculus
ttggccatctatgacgacaaagtgt

SEQ ID NO: 988896 - DNA, 25 bp, Mus musculus
ttggccatctatgaggacaaagtgt

SEQ ID NO: 988897 - DNA, 25 bp, Mus musculus
ttggccatgtcttcaagcgctgtct

SEQ ID NO: 988898 - DNA, 25 bp, Mus musculus
ttggccatgtgttcaagcgctgtct

SEQ ID NO: 988899 - DNA, 25 bp, Mus musculus
ttggcccaccagctcctcaagggga

SEQ ID NO: 988900 - DNA, 25 bp, Mus musculus
ttggcccaccaggtcctcaagggga

SEQ ID NO: 988901 - DNA, 25 bp, Mus musculus
ttggcccgacagatctctttggagt

SEQ ID NO: 988902 - DNA, 25 bp, Mus musculus
ttggcccgacagttctctttggagt

SEQ ID NO: 988903 - DNA, 25 bp, Mus musculus
ttggccgcagcttctctccactatg

SEQ ID NO: 988904 - DNA, 25 bp, Mus musculus
ttggccgcaggttctctccactatg

SEQ ID NO: 988905 - DNA, 25 bp, Mus musculus
ttggcctcactgcgcacattccagc

SEQ ID NO: 988906 - DNA, 25 bp, Mus musculus
ttggcctcactgggcacattccagc

SEQ ID NO: 988907 - DNA, 25 bp, Mus musculus
ttggcctccccacacggcgccatga

SEQ ID NO: 988908 - DNA, 25 bp, Mus musculus
ttggcctccccacagggcgccatga

SEQ ID NO: 988909 - DNA, 25 bp, Mus musculus
ttggcctggcagccccttttagcta

SEQ ID NO: 988910 - DNA, 25 bp, Mus musculus
ttggcctggcaggcccttttagcta

SEQ ID NO: 988911 - DNA, 25 bp, Mus musculus
ttggcgacctgtgcaacctcgcatc

SEQ ID NO: 988912 - DNA, 25 bp, Mus musculus
ttggcgacctgtgctacctcgcatc

SEQ ID NO: 988913 - DNA, 25 bp, Mus musculus
ttggcgattagacgtctgacatggc

SEQ ID NO: 988914 - DNA, 25 bp, Mus musculus
ttggcgattagactctgccttcagg

SEQ ID NO: 988915 - DNA, 25 bp, Mus musculus
ttggcgattagaggtctgacatggc

SEQ ID NO: 988916 - DNA, 25 bp, Mus musculus
ttggcgattagagtctgccttcagg

SEQ ID NO: 988917 - DNA, 25 bp, Mus musculus
ttggcgcctactcacggctaacatc

SEQ ID NO: 988918 - DNA, 25 bp, Mus musculus
ttggcgcctactcagggctaacatc

SEQ ID NO: 988919 - DNA, 25 bp, Mus musculus
ttggcggagccctcactctttgacg

SEQ ID NO: 988920 - DNA, 25 bp, Mus musculus
ttggcggagcgctcactctttgacg

SEQ ID NO: 988921 - DNA, 25 bp, Mus musculus
ttggcggcgtgaccccagatcatgc

SEQ ID NO: 988922 - DNA, 25 bp, Mus musculus
ttggcggcgtgagcccagatcatgc

SEQ ID NO: 988923 - DNA, 25 bp, Mus musculus
ttggcggtgatgaacacaatagatg

SEQ ID NO: 988924 - DNA, 25 bp, Mus musculus
ttggcggtgatgaagacaatagatg

SEQ ID NO: 988925 - DNA, 25 bp, Mus musculus
ttggcggtggtagtcgtggctatgg

SEQ ID NO: 988926 - DNA, 25 bp, Mus musculus
ttggcggtggtagtggtggctatgg

SEQ ID NO: 988927 - DNA, 25 bp, Mus musculus
ttggcgttttagagaacaacgtggg

SEQ ID NO: 988928 - DNA, 25 bp, Mus musculus
ttggcgttttagtgaacaacgtggg

SEQ ID NO: 988929 - DNA, 25 bp, Mus musculus
ttggctacagcattatcagacttgg

SEQ ID NO: 988930 - DNA, 25 bp, Mus musculus
ttggctacaggattatcagacttgg

SEQ ID NO: 988931 - DNA, 25 bp, Mus musculus
ttggctacatcacggtgcggttcta

SEQ ID NO: 988932 - DNA, 25 bp, Mus musculus
ttggctacatcagggtgcggttcta

SEQ ID NO: 988933 - DNA, 25 bp, Mus musculus
ttggctataaaaaatgccaggcaga

SEQ ID NO: 988934 - DNA, 25 bp, Mus musculus
ttggctataataaatgccaggcaga

SEQ ID NO: 988935 - DNA, 25 bp, Mus musculus
ttggctatagagaagtgcatgcgga

SEQ ID NO: 988936 - DNA, 25 bp, Mus musculus
ttggctatagtgaagtgcatgcgga

SEQ ID NO: 988937 - DNA, 25 bp, Mus musculus
ttggctatccctttggtgtttatgt

SEQ ID NO: 988938 - DNA, 25 bp, Mus musculus
ttggctatccgtttggtgtttatgt

SEQ ID NO: 988939 - DNA, 25 bp, Mus musculus
ttggctatttcacgctttgatggga

SEQ ID NO: 988940 - DNA, 25 bp, Mus musculus
ttggctatttcaggctttgatggga

SEQ ID NO: 988941 - DNA, 25 bp, Mus musculus
ttggctcatcagatggcagttctgc

SEQ ID NO: 988942 - DNA, 25 bp, Mus musculus
ttggctcatcagcaggactgacaaa

SEQ ID NO: 988943 - DNA, 25 bp, Mus musculus
ttggctcatcaggaggactgacaaa

SEQ ID NO: 988944 - DNA, 25 bp, Mus musculus
ttggctcatcagttggcagttctgc

SEQ ID NO: 988945 - DNA, 25 bp, Mus musculus
ttggctccagctttagttgccccca

SEQ ID NO: 988946 - DNA, 25 bp, Mus musculus
ttggctccaggtttagttgccccca

SEQ ID NO: 988947 - DNA, 25 bp, Mus musculus
ttggctcctccacggtccggtactg

SEQ ID NO: 988948 - DNA, 25 bp, Mus musculus
ttggctcctccacgtgtttgtggta

SEQ ID NO: 988949 - DNA, 25 bp, Mus musculus
ttggctcctccagggtccggtactg

SEQ ID NO: 988950 - DNA, 25 bp, Mus musculus
ttggctcctccaggtgtttgtggta

SEQ ID NO: 988951 - DNA, 25 bp, Mus musculus
ttggctgaatctttgttaactgaaa

SEQ ID NO: 988952 - DNA, 25 bp, Mus musculus
ttggctgaatgtttgttaactgaaa

SEQ ID NO: 988953 - DNA, 25 bp, Mus musculus
ttggctgaccagcatattttcaatg

SEQ ID NO: 988954 - DNA, 25 bp, Mus musculus
ttggctgaccaggatattttcaatg

SEQ ID NO: 988955 - DNA, 25 bp, Mus musculus
ttggctgacgcgcaccaaccccaga

SEQ ID NO: 988956 - DNA, 25 bp, Mus musculus
ttggctgacgggcaccaaccccaga

SEQ ID NO: 988957 - DNA, 25 bp, Mus musculus
ttggctgctgctgctaatgtgcatg

SEQ ID NO: 988958 - DNA, 25 bp, Mus musculus
ttggctgctggtgctaatgtgcatg

SEQ ID NO: 988959 - DNA, 25 bp, Mus musculus
ttggctggaccacatgcggtgagca

SEQ ID NO: 988960 - DNA, 25 bp, Mus musculus
ttggctggaccagatgcggtgagca

SEQ ID NO: 988961 - DNA, 25 bp, Mus musculus
ttggctggagcacgttcatccctga

SEQ ID NO: 988962 - DNA, 25 bp, Mus musculus
ttggctggagcaggttcatccctga

SEQ ID NO: 988963 - DNA, 25 bp, Mus musculus
ttggctggagcgaaggtggctgggg

SEQ ID NO: 988964 - DNA, 25 bp, Mus musculus
ttggctggagggaaggtggctgggg

SEQ ID NO: 988965 - DNA, 25 bp, Mus musculus
ttggctggtggactgttctccagtt

SEQ ID NO: 988966 - DNA, 25 bp, Mus musculus
ttggctggtggagtgttctccagtt

SEQ ID NO: 988967 - DNA, 25 bp, Mus musculus
ttggcttatgcccacctcatccttg

SEQ ID NO: 988968 - DNA, 25 bp, Mus musculus
ttggcttatgcccagctcatccttg

SEQ ID NO: 988969 - DNA, 25 bp, Mus musculus
ttggcttcattggacgtttaggatt

SEQ ID NO: 988970 - DNA, 25 bp, Mus musculus
ttggcttcattggaggtttaggatt

SEQ ID NO: 988971 - DNA, 25 bp, Mus musculus
ttggcttcccaaaaatgtatccatc

SEQ ID NO: 988972 - DNA, 25 bp, Mus musculus
ttggcttcccaaaattgtatccatc

SEQ ID NO: 988973 - DNA, 25 bp, Mus musculus
ttggcttccgcttgccctatgctag

SEQ ID NO: 988974 - DNA, 25 bp, Mus musculus
ttggcttccggttgccctatgctag

SEQ ID NO: 988975 - DNA, 25 bp, Mus musculus
ttggcttctcagaactgtattcaca

SEQ ID NO: 988976 - DNA, 25 bp, Mus musculus
ttggcttctcagaagtgtattcaca

SEQ ID NO: 988977 - DNA, 25 bp, Mus musculus
ttggcttctccactccatttgctga

SEQ ID NO: 988978 - DNA, 25 bp, Mus musculus
ttggcttctccactgcatttgctga

SEQ ID NO: 988979 - DNA, 25 bp, Mus musculus
ttggctttatcacgcgttctgtcaa

SEQ ID NO: 988980 - DNA, 25 bp, Mus musculus
ttggctttatcacgggcgttcaatt

SEQ ID NO: 988981 - DNA, 25 bp, Mus musculus
ttggctttatcaggcgttctgtcaa

SEQ ID NO: 988982 - DNA, 25 bp, Mus musculus
ttggctttatcaggggcgttcaatt

SEQ ID NO: 988983 - DNA, 25 bp, Mus musculus
ttggctttgccacgatggaatcaac

SEQ ID NO: 988984 - DNA, 25 bp, Mus musculus
ttggctttgccaggatggaatcaac

SEQ ID NO: 988985 - DNA, 25 bp, Mus musculus
ttggctttgctgaatgaagtaaact

SEQ ID NO: 988986 - DNA, 25 bp, Mus musculus
ttggctttgctgtatgaagtaaact

SEQ ID NO: 988987 - DNA, 25 bp, Mus musculus
ttggctttggagctcctgatggttt

SEQ ID NO: 988988 - DNA, 25 bp, Mus musculus
ttggctttggagctcggtgagctgg

SEQ ID NO: 988989 - DNA, 25 bp, Mus musculus
ttggctttggaggtcctgatggttt

SEQ ID NO: 988990 - DNA, 25 bp, Mus musculus
ttggctttggaggtcggtgagctgg

SEQ ID NO: 988991 - DNA, 25 bp, Mus musculus
ttggcttttaatcatctagtgaagc

SEQ ID NO: 988992 - DNA, 25 bp, Mus musculus
ttggcttttaatgatctagtgaagc

SEQ ID NO: 988993 - DNA, 25 bp, Mus musculus
ttgggaaagaagcttacccatgcag

SEQ ID NO: 988994 - DNA, 25 bp, Mus musculus
ttgggaaagaaggttacccatgcag

SEQ ID NO: 988995 - DNA, 25 bp, Mus musculus
ttgggaacagagcactctggggcct

SEQ ID NO: 988996 - DNA, 25 bp, Mus musculus
ttgggaacagaggactctggggcct

SEQ ID NO: 988997 - DNA, 25 bp, Mus musculus
ttgggaacagcatgggggctgctgg

SEQ ID NO: 988998 - DNA, 25 bp, Mus musculus
ttgggaacagccttagctacatcaa

SEQ ID NO: 988999 - DNA, 25 bp, Mus musculus
ttgggaacagcctttgctacatcaa

SEQ ID NO: 989000 - DNA, 25 bp, Mus musculus
ttgggaacaggatgggggctgctgg

SEQ ID NO: 989001 - DNA, 25 bp, Mus musculus
ttgggaagagtgagtcctgagttgc

SEQ ID NO: 989002 - DNA, 25 bp, Mus musculus
ttgggaagagtgccatgacaatgca

SEQ ID NO: 989003 - DNA, 25 bp, Mus musculus
ttgggaagagtggcatgacaatgca

SEQ ID NO: 989004 - DNA, 25 bp, Mus musculus
ttgggaagagtgtgtcctgagttgc

SEQ ID NO: 989005 - DNA, 25 bp, Mus musculus
ttgggaagtatgcgcgagggcttcc

SEQ ID NO: 989006 - DNA, 25 bp, Mus musculus
ttgggaagtatgggcgagggcttcc

SEQ ID NO: 989007 - DNA, 25 bp, Mus musculus
ttgggactaccacgcctgtacggag

SEQ ID NO: 989008 - DNA, 25 bp, Mus musculus
ttgggactaccaggcctgtacggag

SEQ ID NO: 989009 - DNA, 25 bp, Mus musculus
ttgggagccaagaactcatcctgcc

SEQ ID NO: 989010 - DNA, 25 bp, Mus musculus
ttgggagccaagtactcatcctgcc

SEQ ID NO: 989011 - DNA, 25 bp, Mus musculus
ttgggagctacactccctatagggc

SEQ ID NO: 989012 - DNA, 25 bp, Mus musculus
ttgggagctacactgcctatagggc

SEQ ID NO: 989013 - DNA, 25 bp, Mus musculus
ttgggatacgatgacgggatccttt

SEQ ID NO: 989014 - DNA, 25 bp, Mus musculus
ttgggatacgatgaggggatccttt

SEQ ID NO: 989015 - DNA, 25 bp, Mus musculus
ttgggatctttgcaccttcctggtg

SEQ ID NO: 989016 - DNA, 25 bp, Mus musculus
ttgggatctttgcagcttcctggtg

SEQ ID NO: 989017 - DNA, 25 bp, Mus musculus
ttgggatttcaacaccctagagtct

SEQ ID NO: 989018 - DNA, 25 bp, Mus musculus
ttgggatttcaagaccctagagtct

SEQ ID NO: 989019 - DNA, 25 bp, Mus musculus
ttgggcaaagagcagagccgccggg

SEQ ID NO: 989020 - DNA, 25 bp, Mus musculus
ttgggcaaagagccgccgggatgac

SEQ ID NO: 989021 - DNA, 25 bp, Mus musculus
ttgggcaaagtgcagagccgccggg

SEQ ID NO: 989022 - DNA, 25 bp, Mus musculus
ttgggcaaagtgccgccgggatgac

SEQ ID NO: 989023 - DNA, 25 bp, Mus musculus
ttgggcacagcggcccagtggatcg

SEQ ID NO: 989024 - DNA, 25 bp, Mus musculus
ttgggcacaggggcccagtggatcg

SEQ ID NO: 989025 - DNA, 25 bp, Mus musculus
ttgggcacctggaacctgtggtgta

SEQ ID NO: 989026 - DNA, 25 bp, Mus musculus
ttgggcacctggaacgcctccccag

SEQ ID NO: 989027 - DNA, 25 bp, Mus musculus
ttgggcacctggaagctgtggtgta

SEQ ID NO: 989028 - DNA, 25 bp, Mus musculus
ttgggcacctggaaggcctccccag

SEQ ID NO: 989029 - DNA, 25 bp, Mus musculus
ttgggcagggatcacatgggactga

SEQ ID NO: 989030 - DNA, 25 bp, Mus musculus
ttgggcagggatcagatgggactga

SEQ ID NO: 989031 - DNA, 25 bp, Mus musculus
ttgggcatccttcggccaccaattc

SEQ ID NO: 989032 - DNA, 25 bp, Mus musculus
ttgggcatccttgggccaccaattc

SEQ ID NO: 989033 - DNA, 25 bp, Mus musculus
ttgggcctcctctcatgactcggca

SEQ ID NO: 989034 - DNA, 25 bp, Mus musculus
ttgggcctcctctcttgactcggca

SEQ ID NO: 989035 - DNA, 25 bp, Mus musculus
ttgggctatggacctggtgctgtcc

SEQ ID NO: 989036 - DNA, 25 bp, Mus musculus
ttgggctatggactcccaacaggag

SEQ ID NO: 989037 - DNA, 25 bp, Mus musculus
ttgggctatggagctggtgctgtcc

SEQ ID NO: 989038 - DNA, 25 bp, Mus musculus
ttgggctatggagtcccaacaggag

SEQ ID NO: 989039 - DNA, 25 bp, Mus musculus
ttgggctcaaccataagtcctgctt

SEQ ID NO: 989040 - DNA, 25 bp, Mus musculus
ttgggctcaaccttaagtcctgctt

SEQ ID NO: 989041 - DNA, 25 bp, Mus musculus
ttgggctgctggcacgtaccttggc

SEQ ID NO: 989042 - DNA, 25 bp, Mus musculus
ttgggctgctggcaggtaccttggc

SEQ ID NO: 989043 - DNA, 25 bp, Mus musculus
ttgggcttctagtgtccattgtcca

SEQ ID NO: 989044 - DNA, 25 bp, Mus musculus
ttgggcttcttgtgtccattgtcca

SEQ ID NO: 989045 - DNA, 25 bp, Mus musculus
ttggggaagcagatggagttccaga

SEQ ID NO: 989046 - DNA, 25 bp, Mus musculus
ttggggaagcagttggagttccaga

SEQ ID NO: 989047 - DNA, 25 bp, Mus musculus
ttggggaaggaacaagatcaggttt

SEQ ID NO: 989048 - DNA, 25 bp, Mus musculus
ttggggaaggaagaagatcaggttt

SEQ ID NO: 989049 - DNA, 25 bp, Mus musculus
ttggggagagcgatgagttcagcat

SEQ ID NO: 989050 - DNA, 25 bp, Mus musculus
ttggggagagggatgagttcagcat

SEQ ID NO: 989051 - DNA, 25 bp, Mus musculus
ttggggaggcagactgtggcctgcg

SEQ ID NO: 989052 - DNA, 25 bp, Mus musculus
ttggggaggcagtctgtggcctgcg

SEQ ID NO: 989053 - DNA, 25 bp, Mus musculus
ttggggataaagagtactggaatta

SEQ ID NO: 989054 - DNA, 25 bp, Mus musculus
ttggggataaagtgtactggaatta

SEQ ID NO: 989055 - DNA, 25 bp, Mus musculus
ttggggatgcccctgcctccctgga

SEQ ID NO: 989056 - DNA, 25 bp, Mus musculus
ttggggatgcgcctgcctccctgga

SEQ ID NO: 989057 - DNA, 25 bp, Mus musculus
ttggggattatttaccacaggtgat

SEQ ID NO: 989058 - DNA, 25 bp, Mus musculus
ttggggattatttagcacaggtgat

SEQ ID NO: 989059 - DNA, 25 bp, Mus musculus
ttggggccccaccgatgctggtgga

SEQ ID NO: 989060 - DNA, 25 bp, Mus musculus
ttggggccccacggatgctggtgga

SEQ ID NO: 989061 - DNA, 25 bp, Mus musculus
ttggggcgagatgtacaacatcttc

SEQ ID NO: 989062 - DNA, 25 bp, Mus musculus
ttggggcgagcagacctgcacccag

SEQ ID NO: 989063 - DNA, 25 bp, Mus musculus
ttggggcgagcagagctgcacccag

SEQ ID NO: 989064 - DNA, 25 bp, Mus musculus
ttggggcgagttgtacaacatcttc

SEQ ID NO: 989065 - DNA, 25 bp, Mus musculus
ttggggctggacatatggagggtat

SEQ ID NO: 989066 - DNA, 25 bp, Mus musculus
ttggggctggtcatatggagggtat

SEQ ID NO: 989067 - DNA, 25 bp, Mus musculus
ttgggggaaatgaggtgacagcagc

SEQ ID NO: 989068 - DNA, 25 bp, Mus musculus
ttgggggaaatgtggtgacagcagc

SEQ ID NO: 989069 - DNA, 25 bp, Mus musculus
ttggggtgatcggttcagcattggc

SEQ ID NO: 989070 - DNA, 25 bp, Mus musculus
ttggggtgatgggttcagcattggc

SEQ ID NO: 989071 - DNA, 25 bp, Mus musculus
ttgggtcaagctcgagtatgcctac

SEQ ID NO: 989072 - DNA, 25 bp, Mus musculus
ttgggtcaaggtcgagtatgcctac

SEQ ID NO: 989073 - DNA, 25 bp, Mus musculus
ttgggtccgccacatcttcattcac

SEQ ID NO: 989074 - DNA, 25 bp, Mus musculus
ttgggtccgccagatcttcattcac

SEQ ID NO: 989075 - DNA, 25 bp, Mus musculus
ttgggtcttgggaacaaagacgatg

SEQ ID NO: 989076 - DNA, 25 bp, Mus musculus
ttgggtcttgggaagaaagacgatg

SEQ ID NO: 989077 - DNA, 25 bp, Mus musculus
ttgggtgcgaagctaacagagagaa

SEQ ID NO: 989078 - DNA, 25 bp, Mus musculus
ttgggtgcgaaggtaacagagagaa

SEQ ID NO: 989079 - DNA, 25 bp, Mus musculus
ttgggtgtacaacatacttgggggc

SEQ ID NO: 989080 - DNA, 25 bp, Mus musculus
ttgggtgtacaagatacttgggggc

SEQ ID NO: 989081 - DNA, 25 bp, Mus musculus
ttgggtgttaagaacgaaatgatcc

SEQ ID NO: 989082 - DNA, 25 bp, Mus musculus
ttgggtgttaagaaggaaatgatcc

SEQ ID NO: 989083 - DNA, 25 bp, Mus musculus
ttgggttcctcgcctcccaggagct

SEQ ID NO: 989084 - DNA, 25 bp, Mus musculus
ttgggttcctcggctcccaggagct

SEQ ID NO: 989085 - DNA, 25 bp, Mus musculus
ttgggttgctgtcacggtcgaaatt

SEQ ID NO: 989086 - DNA, 25 bp, Mus musculus
ttgggttgctgtcagggtcgaaatt

SEQ ID NO: 989087 - DNA, 25 bp, Mus musculus
ttggtaaaagccatggccatgcaaa

SEQ ID NO: 989088 - DNA, 25 bp, Mus musculus
ttggtaaaagcgcagtcacaatgca

SEQ ID NO: 989089 - DNA, 25 bp, Mus musculus
ttggtaaaagcggagtcacaatgca

SEQ ID NO: 989090 - DNA, 25 bp, Mus musculus
ttggtaaaaggcatggccatgcaaa

SEQ ID NO: 989091 - DNA, 25 bp, Mus musculus
ttggtaaaatatcggatgcccgggt

SEQ ID NO: 989092 - DNA, 25 bp, Mus musculus
ttggtaaaatatgggatgcccgggt

SEQ ID NO: 989093 - DNA, 25 bp, Mus musculus
ttggtaccaaacccttcgacagtga

SEQ ID NO: 989094 - DNA, 25 bp, Mus musculus
ttggtaccaaacgcttcgacagtga

SEQ ID NO: 989095 - DNA, 25 bp, Mus musculus
ttggtagactctggctggaggcgtg

SEQ ID NO: 989096 - DNA, 25 bp, Mus musculus
ttggtagactgtggctggaggcgtg

SEQ ID NO: 989097 - DNA, 25 bp, Mus musculus
ttggtatttttacgctgttcattta

SEQ ID NO: 989098 - DNA, 25 bp, Mus musculus
ttggtatttttaggctgttcattta

SEQ ID NO: 989099 - DNA, 25 bp, Mus musculus
ttggtcatgaagaagcagaattcta

SEQ ID NO: 989100 - DNA, 25 bp, Mus musculus
ttggtcatgaagacatgtttaaaaa

SEQ ID NO: 989101 - DNA, 25 bp, Mus musculus
ttggtcatgaagtagcagaattcta

SEQ ID NO: 989102 - DNA, 25 bp, Mus musculus
ttggtcatgaagtcatgtttaaaaa

SEQ ID NO: 989103 - DNA, 25 bp, Mus musculus
ttggtcctgtcacgacttctgggga

SEQ ID NO: 989104 - DNA, 25 bp, Mus musculus
ttggtcctgtcaggacttctgggga

SEQ ID NO: 989105 - DNA, 25 bp, Mus musculus
ttggtccttgaggatttcaaacaaa

SEQ ID NO: 989106 - DNA, 25 bp, Mus musculus
ttggtccttgatccaccctccaagc

SEQ ID NO: 989107 - DNA, 25 bp, Mus musculus
ttggtccttgtggatttcaaacaaa

SEQ ID NO: 989108 - DNA, 25 bp, Mus musculus
ttggtccttgttccaccctccaagc

SEQ ID NO: 989109 - DNA, 25 bp, Mus musculus
ttggtctgctggacgcctttagaac

SEQ ID NO: 989110 - DNA, 25 bp, Mus musculus
ttggtctgctggcaagcggaacagg

SEQ ID NO: 989111 - DNA, 25 bp, Mus musculus
ttggtctgctgggaagcggaacagg

SEQ ID NO: 989112 - DNA, 25 bp, Mus musculus
ttggtctgctggtcgcctttagaac

SEQ ID NO: 989113 - DNA, 25 bp, Mus musculus
ttggtcttaacgcactgaagccaga

SEQ ID NO: 989114 - DNA, 25 bp, Mus musculus
ttggtcttaaggcactgaagccaga

SEQ ID NO: 989115 - DNA, 25 bp, Mus musculus
ttggtgaaaaagcagtctttgttgc

SEQ ID NO: 989116 - DNA, 25 bp, Mus musculus
ttggtgaaaaaggagtctttgttgc

SEQ ID NO: 989117 - DNA, 25 bp, Mus musculus
ttggtgaaaaccgctgtatgtgtcc

SEQ ID NO: 989118 - DNA, 25 bp, Mus musculus
ttggtgaaaagcgctgtatgtgtcc

SEQ ID NO: 989119 - DNA, 25 bp, Mus musculus
ttggtgaatacaccgacagtgatga

SEQ ID NO: 989120 - DNA, 25 bp, Mus musculus
ttggtgaatacagcgacagtgatga

SEQ ID NO: 989121 - DNA, 25 bp, Mus musculus
ttggtgagcacacctccgtcttcca

SEQ ID NO: 989122 - DNA, 25 bp, Mus musculus
ttggtgagcacagctccgtcttcca

SEQ ID NO: 989123 - DNA, 25 bp, Mus musculus
ttggtgatgagacgaagctttgtct

SEQ ID NO: 989124 - DNA, 25 bp, Mus musculus
ttggtgatgagaggaagctttgtct

SEQ ID NO: 989125 - DNA, 25 bp, Mus musculus
ttggtgcaggctttgtggtagtgat

SEQ ID NO: 989126 - DNA, 25 bp, Mus musculus
ttggtgcagggtttgtggtagtgat

SEQ ID NO: 989127 - DNA, 25 bp, Mus musculus
ttggtgcagtacaaagagtactttt

SEQ ID NO: 989128 - DNA, 25 bp, Mus musculus
ttggtgcagtacaatgagtactttt

SEQ ID NO: 989129 - DNA, 25 bp, Mus musculus
ttggtgctagcaccccctgtcattg

SEQ ID NO: 989130 - DNA, 25 bp, Mus musculus
ttggtgctaggaccccctgtcattg

SEQ ID NO: 989131 - DNA, 25 bp, Mus musculus
ttggtgctcattcgtattgctaata

SEQ ID NO: 989132 - DNA, 25 bp, Mus musculus
ttggtgctcattggtattgctaata

SEQ ID NO: 989133 - DNA, 25 bp, Mus musculus
ttggtgcttcagcactttgtgaaga

SEQ ID NO: 989134 - DNA, 25 bp, Mus musculus
ttggtgcttcagcagtttgtgaaga

SEQ ID NO: 989135 - DNA, 25 bp, Mus musculus
ttggtggaaatttgcgagcttggat

SEQ ID NO: 989136 - DNA, 25 bp, Mus musculus
ttggtggaaatttgggagcttggat

SEQ ID NO: 989137 - DNA, 25 bp, Mus musculus
ttggtggatgcatgagtttcatcct

SEQ ID NO: 989138 - DNA, 25 bp, Mus musculus
ttggtggatggatgagtttcatcct

SEQ ID NO: 989139 - DNA, 25 bp, Mus musculus
ttggtggccacgatgctgtatactg

SEQ ID NO: 989140 - DNA, 25 bp, Mus musculus
ttggtggccacgttgctgtatactg

SEQ ID NO: 989141 - DNA, 25 bp, Mus musculus
ttggtgtcagagaacgaagcagcgg

SEQ ID NO: 989142 - DNA, 25 bp, Mus musculus
ttggtgtcagagaactatccctggg

SEQ ID NO: 989143 - DNA, 25 bp, Mus musculus
ttggtgtcagagaaggaagcagcgg

SEQ ID NO: 989144 - DNA, 25 bp, Mus musculus
ttggtgtcagagaagtatccctggg

SEQ ID NO: 989145 - DNA, 25 bp, Mus musculus
ttggtgtcgcggagcacggagacgg

SEQ ID NO: 989146 - DNA, 25 bp, Mus musculus
ttggtgtcgcggtgcacggagacgg

SEQ ID NO: 989147 - DNA, 25 bp, Mus musculus
ttggtgtctctgcgggccacatcaa

SEQ ID NO: 989148 - DNA, 25 bp, Mus musculus
ttggtgtctctgggggccacatcaa

SEQ ID NO: 989149 - DNA, 25 bp, Mus musculus
ttggtgtgagcttccatgtgggcag

SEQ ID NO: 989150 - DNA, 25 bp, Mus musculus
ttggtgtgaggttccatgtgggcag

SEQ ID NO: 989151 - DNA, 25 bp, Mus musculus
ttggttaaagatcggaccaaatgaa

SEQ ID NO: 989152 - DNA, 25 bp, Mus musculus
ttggttaaagttcggaccaaatgaa

SEQ ID NO: 989153 - DNA, 25 bp, Mus musculus
ttggttatgtcacaaacataaacca

SEQ ID NO: 989154 - DNA, 25 bp, Mus musculus
ttggttatgtcgcagcagaagaagc

SEQ ID NO: 989155 - DNA, 25 bp, Mus musculus
ttggttatgtgacaaacataaacca

SEQ ID NO: 989156 - DNA, 25 bp, Mus musculus
ttggttatgtggcagcagaagaagc

SEQ ID NO: 989157 - DNA, 25 bp, Mus musculus
ttggttcaaaacagaagcaaagggt

SEQ ID NO: 989158 - DNA, 25 bp, Mus musculus
ttggttcaaatcagaagcaaagggt

SEQ ID NO: 989159 - DNA, 25 bp, Mus musculus
ttggttccaacatatagctgacttg

SEQ ID NO: 989160 - DNA, 25 bp, Mus musculus
ttggttccaagatatagctgacttg

SEQ ID NO: 989161 - DNA, 25 bp, Mus musculus
ttggttccagatgggtgtgttttac

SEQ ID NO: 989162 - DNA, 25 bp, Mus musculus
ttggttccagcgtgactgactgagt

SEQ ID NO: 989163 - DNA, 25 bp, Mus musculus
ttggttccagggtgactgactgagt

SEQ ID NO: 989164 - DNA, 25 bp, Mus musculus
ttggttccagttgggtgtgttttac

SEQ ID NO: 989165 - DNA, 25 bp, Mus musculus
ttggttcccgctgacacgtaggcaa

SEQ ID NO: 989166 - DNA, 25 bp, Mus musculus
ttggttcccgctgacctcccgccat

SEQ ID NO: 989167 - DNA, 25 bp, Mus musculus
ttggttcccgctgagacgtaggcaa

SEQ ID NO: 989168 - DNA, 25 bp, Mus musculus
ttggttcccgctgagctcccgccat

SEQ ID NO: 989169 - DNA, 25 bp, Mus musculus
ttggttcctacattcttttgtctgt

SEQ ID NO: 989170 - DNA, 25 bp, Mus musculus
ttggttcctacattgttttgtctgt

SEQ ID NO: 989171 - DNA, 25 bp, Mus musculus
ttggttgaaatgcgcttcaatgttg

SEQ ID NO: 989172 - DNA, 25 bp, Mus musculus
ttggttgaaatgggcttcaatgttg

SEQ ID NO: 989173 - DNA, 25 bp, Mus musculus
ttggttgcagatttgcaatacatat

SEQ ID NO: 989174 - DNA, 25 bp, Mus musculus
ttggttgcagctttgcaatacattt

SEQ ID NO: 989175 - DNA, 25 bp, Mus musculus
ttggttgcaggtttgcaatacattt

SEQ ID NO: 989176 - DNA, 25 bp, Mus musculus
ttggttgcagttttgcaatacatat

SEQ ID NO: 989177 - DNA, 25 bp, Mus musculus
ttggttgggataaactcgcatgtgt

SEQ ID NO: 989178 - DNA, 25 bp, Mus musculus
ttggttgggatatactcgcatgtgt

SEQ ID NO: 989179 - DNA, 25 bp, Mus musculus
ttgtaaaaagctatatcatgtataa

SEQ ID NO: 989180 - DNA, 25 bp, Mus musculus
ttgtaaaaaggtatatcatgtataa

SEQ ID NO: 989181 - DNA, 25 bp, Mus musculus
ttgtaatctcggattgtaagggcca

SEQ ID NO: 989182 - DNA, 25 bp, Mus musculus
ttgtaatctcggtttgtaagggcca

SEQ ID NO: 989183 - DNA, 25 bp, Mus musculus
ttgtacacgaccgtcggtggtatga

SEQ ID NO: 989184 - DNA, 25 bp, Mus musculus
ttgtacacgaccgtgggtggtatga

SEQ ID NO: 989185 - DNA, 25 bp, Mus musculus
ttgtacatctggcacggccgccacg

SEQ ID NO: 989186 - DNA, 25 bp, Mus musculus
ttgtacatctggcagggccgccacg

SEQ ID NO: 989187 - DNA, 25 bp, Mus musculus
ttgtacatgcagcacattcaagtca

SEQ ID NO: 989188 - DNA, 25 bp, Mus musculus
ttgtacatgcagcagattcaagtca

SEQ ID NO: 989189 - DNA, 25 bp, Mus musculus
ttgtactctgccctagtccgtgggg

SEQ ID NO: 989190 - DNA, 25 bp, Mus musculus
ttgtactctgcccttgtccgtgggg

SEQ ID NO: 989191 - DNA, 25 bp, Mus musculus
ttgtacttcactcaattttcacctc

SEQ ID NO: 989192 - DNA, 25 bp, Mus musculus
ttgtacttcactgaattttcacctc

SEQ ID NO: 989193 - DNA, 25 bp, Mus musculus
ttgtagaagctgctgggatgcaggc

SEQ ID NO: 989194 - DNA, 25 bp, Mus musculus
ttgtagaagctggtgggatgcaggc

SEQ ID NO: 989195 - DNA, 25 bp, Mus musculus
ttgtagacagctactggcatagcac

SEQ ID NO: 989196 - DNA, 25 bp, Mus musculus
ttgtagacaggtactggcatagcac

SEQ ID NO: 989197 - DNA, 25 bp, Mus musculus
ttgtagacttaacacatgaagagat

SEQ ID NO: 989198 - DNA, 25 bp, Mus musculus
ttgtagactttacacatgaagagat

SEQ ID NO: 989199 - DNA, 25 bp, Mus musculus
ttgtagagagatacattggcttcat

SEQ ID NO: 989200 - DNA, 25 bp, Mus musculus
ttgtagagagttacattggcttcat

SEQ ID NO: 989201 - DNA, 25 bp, Mus musculus
ttgtaggacaaacgtatggctttgt

SEQ ID NO: 989202 - DNA, 25 bp, Mus musculus
ttgtaggacaaaggtatggctttgt

SEQ ID NO: 989203 - DNA, 25 bp, Mus musculus
ttgtagtaagccaattaccttgaaa

SEQ ID NO: 989204 - DNA, 25 bp, Mus musculus
ttgtagtaaggcaattaccttgaaa

SEQ ID NO: 989205 - DNA, 25 bp, Mus musculus
ttgtagtgaaggcagaggtacagaa

SEQ ID NO: 989206 - DNA, 25 bp, Mus musculus
ttgtagtgaagggagaggtacagaa

SEQ ID NO: 989207 - DNA, 25 bp, Mus musculus
ttgtatacacagctgtgttgttcgc

SEQ ID NO: 989208 - DNA, 25 bp, Mus musculus
ttgtatacacaggtgtgttgttcgc

SEQ ID NO: 989209 - DNA, 25 bp, Mus musculus
ttgtatacagagcagcattccggct

SEQ ID NO: 989210 - DNA, 25 bp, Mus musculus
ttgtatacagaggagcattccggct

SEQ ID NO: 989211 - DNA, 25 bp, Mus musculus
ttgtatcgacagatctgtaagcatc

SEQ ID NO: 989212 - DNA, 25 bp, Mus musculus
ttgtatcgacagttctgtaagcatc

SEQ ID NO: 989213 - DNA, 25 bp, Mus musculus
ttgtatgcatctgacagatcggtcg

SEQ ID NO: 989214 - DNA, 25 bp, Mus musculus
ttgtatgcatctgacgaagagatcg

SEQ ID NO: 989215 - DNA, 25 bp, Mus musculus
ttgtatgcatctgagagatcggtcg

SEQ ID NO: 989216 - DNA, 25 bp, Mus musculus
ttgtatgcatctgaggaagagatcg

SEQ ID NO: 989217 - DNA, 25 bp, Mus musculus
ttgtatgctctggacgtgatggagt

SEQ ID NO: 989218 - DNA, 25 bp, Mus musculus
ttgtatgctctggaggtgatggagt

SEQ ID NO: 989219 - DNA, 25 bp, Mus musculus
ttgtatgtataggctgttatgttta

SEQ ID NO: 989220 - DNA, 25 bp, Mus musculus
ttgtatgtattggctgttatgttta

SEQ ID NO: 989221 - DNA, 25 bp, Mus musculus
ttgtattaacagctgctaaagttag

SEQ ID NO: 989222 - DNA, 25 bp, Mus musculus
ttgtattaacaggtgctaaagttag

SEQ ID NO: 989223 - DNA, 25 bp, Mus musculus
ttgtattcaaccccttctttgagat

SEQ ID NO: 989224 - DNA, 25 bp, Mus musculus
ttgtattcaaccgcttctttgagat

SEQ ID NO: 989225 - DNA, 25 bp, Mus musculus
ttgtcaaagactcccttactaaaga

SEQ ID NO: 989226 - DNA, 25 bp, Mus musculus
ttgtcaaagactgccttactaaaga

SEQ ID NO: 989227 - DNA, 25 bp, Mus musculus
ttgtcaacagcaggagccatgggag

SEQ ID NO: 989228 - DNA, 25 bp, Mus musculus
ttgtcaacagcgtccaggtgcacgt

SEQ ID NO: 989229 - DNA, 25 bp, Mus musculus
ttgtcaacaggaggagccatgggag

SEQ ID NO: 989230 - DNA, 25 bp, Mus musculus
ttgtcaacagggtccaggtgcacgt

SEQ ID NO: 989231 - DNA, 25 bp, Mus musculus
ttgtcaagaacacctggggaagtga

SEQ ID NO: 989232 - DNA, 25 bp, Mus musculus
ttgtcaagaacagctggggaagtga

SEQ ID NO: 989233 - DNA, 25 bp, Mus musculus
ttgtcaagctctggctgaaaccgga

SEQ ID NO: 989234 - DNA, 25 bp, Mus musculus
ttgtcaagctgtggctgaaaccgga

SEQ ID NO: 989235 - DNA, 25 bp, Mus musculus
ttgtcaagtacaaacagcttgtagc

SEQ ID NO: 989236 - DNA, 25 bp, Mus musculus
ttgtcaagtacaaagagcttgtagc

SEQ ID NO: 989237 - DNA, 25 bp, Mus musculus
ttgtcacaagcactcatgaaagtcc

SEQ ID NO: 989238 - DNA, 25 bp, Mus musculus
ttgtcacaagcactctgaccaagga

SEQ ID NO: 989239 - DNA, 25 bp, Mus musculus
ttgtcacaagcagtcatgaaagtcc

SEQ ID NO: 989240 - DNA, 25 bp, Mus musculus
ttgtcacaagcagtctgaccaagga

SEQ ID NO: 989241 - DNA, 25 bp, Mus musculus
ttgtcacaggagcatcagcagcagg

SEQ ID NO: 989242 - DNA, 25 bp, Mus musculus
ttgtcacaggaggatcagcagcagg

SEQ ID NO: 989243 - DNA, 25 bp, Mus musculus
ttgtcaccgctgcaccctgtaaatg

SEQ ID NO: 989244 - DNA, 25 bp, Mus musculus
ttgtcaccgctgcagcctgtaaatg

SEQ ID NO: 989245 - DNA, 25 bp, Mus musculus
ttgtcactgtgctccgaatcccaca

SEQ ID NO: 989246 - DNA, 25 bp, Mus musculus
ttgtcactgtgctcggaatcccaca

SEQ ID NO: 989247 - DNA, 25 bp, Mus musculus
ttgtcagtctaatggggcccagaca

SEQ ID NO: 989248 - DNA, 25 bp, Mus musculus
ttgtcagtcttatggggcccagaca

SEQ ID NO: 989249 - DNA, 25 bp, Mus musculus
ttgtcatagccacgtttagtcccta

SEQ ID NO: 989250 - DNA, 25 bp, Mus musculus
ttgtcatagccaggtttagtcccta

SEQ ID NO: 989251 - DNA, 25 bp, Mus musculus
ttgtcatcacagcttagcgctctgt

SEQ ID NO: 989252 - DNA, 25 bp, Mus musculus
ttgtcatcacaggttagcgctctgt

SEQ ID NO: 989253 - DNA, 25 bp, Mus musculus
ttgtcatcaccacaccgcctgcgac

SEQ ID NO: 989254 - DNA, 25 bp, Mus musculus
ttgtcatcaccacagcgcctgcgac

SEQ ID NO: 989255 - DNA, 25 bp, Mus musculus
ttgtccaaggcccacgtggtgacca

SEQ ID NO: 989256 - DNA, 25 bp, Mus musculus
ttgtccaaggcccaggtggtgacca

SEQ ID NO: 989257 - DNA, 25 bp, Mus musculus
ttgtccatgcagaatgctgcctggc

SEQ ID NO: 989258 - DNA, 25 bp, Mus musculus
ttgtccatgcagacccccagcctgc

SEQ ID NO: 989259 - DNA, 25 bp, Mus musculus
ttgtccatgcagtatgctgcctggc

SEQ ID NO: 989260 - DNA, 25 bp, Mus musculus
ttgtccatgcagtcccccagcctgc

SEQ ID NO: 989261 - DNA, 25 bp, Mus musculus
ttgtcccccatgagcaagcagagtt

SEQ ID NO: 989262 - DNA, 25 bp, Mus musculus
ttgtcccccatgtgcaagcagagtt

SEQ ID NO: 989263 - DNA, 25 bp, Mus musculus
ttgtccgcagaaatctgtctttcag

SEQ ID NO: 989264 - DNA, 25 bp, Mus musculus
ttgtccgcagcaacctgaatgaacc

SEQ ID NO: 989265 - DNA, 25 bp, Mus musculus
ttgtccgcaggaacctgaatgaacc

SEQ ID NO: 989266 - DNA, 25 bp, Mus musculus
ttgtccgcagtaatctgtctttcag

SEQ ID NO: 989267 - DNA, 25 bp, Mus musculus
ttgtcctaagattagcctcacagtt

SEQ ID NO: 989268 - DNA, 25 bp, Mus musculus
ttgtcctaagtttagcctcacagtt

SEQ ID NO: 989269 - DNA, 25 bp, Mus musculus
ttgtcctcatggaacgcgcccctcg

SEQ ID NO: 989270 - DNA, 25 bp, Mus musculus
ttgtcctcatggaaggcgcccctcg

SEQ ID NO: 989271 - DNA, 25 bp, Mus musculus
ttgtcctgtaagctggtctgtgatg

SEQ ID NO: 989272 - DNA, 25 bp, Mus musculus
ttgtcctgtaaggtggtctgtgatg

SEQ ID NO: 989273 - DNA, 25 bp, Mus musculus
ttgtcctgtcagctttggccacagt

SEQ ID NO: 989274 - DNA, 25 bp, Mus musculus
ttgtcctgtcaggtttggccacagt

SEQ ID NO: 989275 - DNA, 25 bp, Mus musculus
ttgtcgagggagctctccctactct

SEQ ID NO: 989276 - DNA, 25 bp, Mus musculus
ttgtcgagggaggtctccctactct

SEQ ID NO: 989277 - DNA, 25 bp, Mus musculus
ttgtcgtcgtcaccttgacaaaagt

SEQ ID NO: 989278 - DNA, 25 bp, Mus musculus
ttgtcgtcgtcagcttgacaaaagt

SEQ ID NO: 989279 - DNA, 25 bp, Mus musculus
ttgtctagttcacgccagctgctgc

SEQ ID NO: 989280 - DNA, 25 bp, Mus musculus
ttgtctagttcaggccagctgctgc

SEQ ID NO: 989281 - DNA, 25 bp, Mus musculus
ttgtctcaagattgccagcgagcct

SEQ ID NO: 989282 - DNA, 25 bp, Mus musculus
ttgtctcaagtttgccagcgagcct

SEQ ID NO: 989283 - DNA, 25 bp, Mus musculus
ttgtctccaacctgagcccctacag

SEQ ID NO: 989284 - DNA, 25 bp, Mus musculus
ttgtctccaagctgagcccctacag

SEQ ID NO: 989285 - DNA, 25 bp, Mus musculus
ttgtctccagatcatctgacaaaag

SEQ ID NO: 989286 - DNA, 25 bp, Mus musculus
ttgtctccagcgtcctgattcgtga

SEQ ID NO: 989287 - DNA, 25 bp, Mus musculus
ttgtctccagggtcctgattcgtga

SEQ ID NO: 989288 - DNA, 25 bp, Mus musculus
ttgtctccagttcatctgacaaaag

SEQ ID NO: 989289 - DNA, 25 bp, Mus musculus
ttgtctgacttccgtcagccatgtc

SEQ ID NO: 989290 - DNA, 25 bp, Mus musculus
ttgtctgacttcggtcagccatgtc

SEQ ID NO: 989291 - DNA, 25 bp, Mus musculus
ttgtctgaggaagacagttcccata

SEQ ID NO: 989292 - DNA, 25 bp, Mus musculus
ttgtctgaggaagagagttcccata

SEQ ID NO: 989293 - DNA, 25 bp, Mus musculus
ttgtctggaggacctgccggggagc

SEQ ID NO: 989294 - DNA, 25 bp, Mus musculus
ttgtctggaggagctgccggggagc

SEQ ID NO: 989295 - DNA, 25 bp, Mus musculus
ttgtctgtagtgatcctgcatgcca

SEQ ID NO: 989296 - DNA, 25 bp, Mus musculus
ttgtctgtagtgatgctgcatgcca

SEQ ID NO: 989297 - DNA, 25 bp, Mus musculus
ttgtctgtcgcgtgctccagcttat

SEQ ID NO: 989298 - DNA, 25 bp, Mus musculus
ttgtctgtcgggtgctccagcttat

SEQ ID NO: 989299 - DNA, 25 bp, Mus musculus
ttgtctgttatgacctcactgacag

SEQ ID NO: 989300 - DNA, 25 bp, Mus musculus
ttgtctgttatgtcctcactgacag

SEQ ID NO: 989301 - DNA, 25 bp, Mus musculus
ttgtcttccaaaaggctcaaagact

SEQ ID NO: 989302 - DNA, 25 bp, Mus musculus
ttgtcttccaaatggctcaaagact

SEQ ID NO: 989303 - DNA, 25 bp, Mus musculus
ttgtcttccgtacacgatggacgtg

SEQ ID NO: 989304 - DNA, 25 bp, Mus musculus
ttgtcttccgtacaggatggacgtg

SEQ ID NO: 989305 - DNA, 25 bp, Mus musculus
ttgtctttaaggactctaatagatg

SEQ ID NO: 989306 - DNA, 25 bp, Mus musculus
ttgtctttaaggaggtgctgatcgg

SEQ ID NO: 989307 - DNA, 25 bp, Mus musculus
ttgtctttaaggtctctaatagatg

SEQ ID NO: 989308 - DNA, 25 bp, Mus musculus
ttgtctttaaggtggtgctgatcgg

SEQ ID NO: 989309 - DNA, 25 bp, Mus musculus
ttgtgaaactcttacgtgtgtgtgc

SEQ ID NO: 989310 - DNA, 25 bp, Mus musculus
ttgtgaaactcttaggtgtgtgtgc

SEQ ID NO: 989311 - DNA, 25 bp, Mus musculus
ttgtgaacctgaaacgcaaaggaca

SEQ ID NO: 989312 - DNA, 25 bp, Mus musculus
ttgtgaacctgaaaggcaaaggaca

SEQ ID NO: 989313 - DNA, 25 bp, Mus musculus
ttgtgaactgttcacacgcctcctt

SEQ ID NO: 989314 - DNA, 25 bp, Mus musculus
ttgtgaactgttcagacgcctcctt

SEQ ID NO: 989315 - DNA, 25 bp, Mus musculus
ttgtgaagcagaaatatctggaata

SEQ ID NO: 989316 - DNA, 25 bp, Mus musculus
ttgtgaagcagatatatctggaata

SEQ ID NO: 989317 - DNA, 25 bp, Mus musculus
ttgtgacaccagcacacatagactg

SEQ ID NO: 989318 - DNA, 25 bp, Mus musculus
ttgtgacaccagcagacatagactg

SEQ ID NO: 989319 - DNA, 25 bp, Mus musculus
ttgtgactgtttcactaatgctgca

SEQ ID NO: 989320 - DNA, 25 bp, Mus musculus
ttgtgactgtttcagtaatgctgca

SEQ ID NO: 989321 - DNA, 25 bp, Mus musculus
ttgtgagcagaacatgttactaaga

SEQ ID NO: 989322 - DNA, 25 bp, Mus musculus
ttgtgagcagctgtccacaaagtgc

SEQ ID NO: 989323 - DNA, 25 bp, Mus musculus
ttgtgagcaggtgtccacaaagtgc

SEQ ID NO: 989324 - DNA, 25 bp, Mus musculus
ttgtgagcagtacatgttactaaga

SEQ ID NO: 989325 - DNA, 25 bp, Mus musculus
ttgtgagcatgacgttgtctattac

SEQ ID NO: 989326 - DNA, 25 bp, Mus musculus
ttgtgagcatgacttggatatacaa

SEQ ID NO: 989327 - DNA, 25 bp, Mus musculus
ttgtgagcatgaggttgtctattac

SEQ ID NO: 989328 - DNA, 25 bp, Mus musculus
ttgtgagcatgagttggatatacaa

SEQ ID NO: 989329 - DNA, 25 bp, Mus musculus
ttgtgaggactgctcctgagcctgt

SEQ ID NO: 989330 - DNA, 25 bp, Mus musculus
ttgtgaggactggtcctgagcctgt

SEQ ID NO: 989331 - DNA, 25 bp, Mus musculus
ttgtgaggggagctgttgtggaaaa

SEQ ID NO: 989332 - DNA, 25 bp, Mus musculus
ttgtgaggggagttctgtagtggcc

SEQ ID NO: 989333 - DNA, 25 bp, Mus musculus
ttgtgaggggtgctgttgtggaaaa

SEQ ID NO: 989334 - DNA, 25 bp, Mus musculus
ttgtgaggggtgttctgtagtggcc

SEQ ID NO: 989335 - DNA, 25 bp, Mus musculus
ttgtgagtttcatgcagcctaccac

SEQ ID NO: 989336 - DNA, 25 bp, Mus musculus
ttgtgagtttctctttggaggcctg

SEQ ID NO: 989337 - DNA, 25 bp, Mus musculus
ttgtgagtttgatgcagcctaccac

SEQ ID NO: 989338 - DNA, 25 bp, Mus musculus
ttgtgagtttgtctttggaggcctg

SEQ ID NO: 989339 - DNA, 25 bp, Mus musculus
ttgtgatcagactgaactcagcacc

SEQ ID NO: 989340 - DNA, 25 bp, Mus musculus
ttgtgatcagtctgaactcagcacc

SEQ ID NO: 989341 - DNA, 25 bp, Mus musculus
ttgtgatcttggaggctggtccagg

SEQ ID NO: 989342 - DNA, 25 bp, Mus musculus
ttgtgatcttggtggctggtccagg

SEQ ID NO: 989343 - DNA, 25 bp, Mus musculus
ttgtgcaagaacccctggtgcaagc

SEQ ID NO: 989344 - DNA, 25 bp, Mus musculus
ttgtgcaagaacgcctggtgcaagc

SEQ ID NO: 989345 - DNA, 25 bp, Mus musculus
ttgtgcagagattaagcacatgatg

SEQ ID NO: 989346 - DNA, 25 bp, Mus musculus
ttgtgcagagtttaagcacatgatg

SEQ ID NO: 989347 - DNA, 25 bp, Mus musculus
ttgtgcagtggttacggtgtcgtag

SEQ ID NO: 989348 - DNA, 25 bp, Mus musculus
ttgtgcagtggttagggtgtcgtag

SEQ ID NO: 989349 - DNA, 25 bp, Mus musculus
ttgtgcccctagagatgtcatgtgt

SEQ ID NO: 989350 - DNA, 25 bp, Mus musculus
ttgtgcccctagtgatgtcatgtgt

SEQ ID NO: 989351 - DNA, 25 bp, Mus musculus
ttgtgcggcggagacttgagcctac

SEQ ID NO: 989352 - DNA, 25 bp, Mus musculus
ttgtgcggcggagagttgagcctac

SEQ ID NO: 989353 - DNA, 25 bp, Mus musculus
ttgtgctcaaaaagtgctgcaagat

SEQ ID NO: 989354 - DNA, 25 bp, Mus musculus
ttgtgctcaaaatgtgctgcaagat

SEQ ID NO: 989355 - DNA, 25 bp, Mus musculus
ttgtgctcatcaatacatttggtgc

SEQ ID NO: 989356 - DNA, 25 bp, Mus musculus
ttgtgctcatcaattcatttggtgc

SEQ ID NO: 989357 - DNA, 25 bp, Mus musculus
ttgtgctcccagatcgtgtcataag

SEQ ID NO: 989358 - DNA, 25 bp, Mus musculus
ttgtgctcccagatggtgtcataag

SEQ ID NO: 989359 - DNA, 25 bp, Mus musculus
ttgtgctgagcatgaacaaggcacc

SEQ ID NO: 989360 - DNA, 25 bp, Mus musculus
ttgtgctgaggatgaacaaggcacc

SEQ ID NO: 989361 - DNA, 25 bp, Mus musculus
ttgtggaaagaatgtacagacggac

SEQ ID NO: 989362 - DNA, 25 bp, Mus musculus
ttgtggaaagtatgtacagacggac

SEQ ID NO: 989363 - DNA, 25 bp, Mus musculus
ttgtggaagacaaagaacgacagtg

SEQ ID NO: 989364 - DNA, 25 bp, Mus musculus
ttgtggaagacatagaacgacagtg

SEQ ID NO: 989365 - DNA, 25 bp, Mus musculus
ttgtggaagcgaaggtgaatgagaa

SEQ ID NO: 989366 - DNA, 25 bp, Mus musculus
ttgtggaagcgatggtgaatgagaa

SEQ ID NO: 989367 - DNA, 25 bp, Mus musculus
ttgtggaatgagattcatgaagctt

SEQ ID NO: 989368 - DNA, 25 bp, Mus musculus
ttgtggaatgagtttcatgaagctt

SEQ ID NO: 989369 - DNA, 25 bp, Mus musculus
ttgtggacagaatttttgaacaatg

SEQ ID NO: 989370 - DNA, 25 bp, Mus musculus
ttgtggacagcttggtttaatgaag

SEQ ID NO: 989371 - DNA, 25 bp, Mus musculus
ttgtggacaggttggtttaatgaag

SEQ ID NO: 989372 - DNA, 25 bp, Mus musculus
ttgtggacagtatttttgaacaatg

SEQ ID NO: 989373 - DNA, 25 bp, Mus musculus
ttgtggagctggaacgtcttgttgc

SEQ ID NO: 989374 - DNA, 25 bp, Mus musculus
ttgtggagctggaaggtcttgttgc

SEQ ID NO: 989375 - DNA, 25 bp, Mus musculus
ttgtggagttcgctgcgtgcttccc

SEQ ID NO: 989376 - DNA, 25 bp, Mus musculus
ttgtggagttcggtgcgtgcttccc

SEQ ID NO: 989377 - DNA, 25 bp, Mus musculus
ttgtggatcacacctgcgaccgagg

SEQ ID NO: 989378 - DNA, 25 bp, Mus musculus
ttgtggatcacagctgcgaccgagg

SEQ ID NO: 989379 - DNA, 25 bp, Mus musculus
ttgtggatccttcatcttagaatct

SEQ ID NO: 989380 - DNA, 25 bp, Mus musculus
ttgtggatccttcggggcaggtcct

SEQ ID NO: 989381 - DNA, 25 bp, Mus musculus
ttgtggatccttgatcttagaatct

SEQ ID NO: 989382 - DNA, 25 bp, Mus musculus
ttgtggatccttgggggcaggtcct

SEQ ID NO: 989383 - DNA, 25 bp, Mus musculus
ttgtggatggccgacgcaaagcaac

SEQ ID NO: 989384 - DNA, 25 bp, Mus musculus
ttgtggatggccgaggcaaagcaac

SEQ ID NO: 989385 - DNA, 25 bp, Mus musculus
ttgtggccagaggggctgaagatcg

SEQ ID NO: 989386 - DNA, 25 bp, Mus musculus
ttgtggccagtggggctgaagatcg

SEQ ID NO: 989387 - DNA, 25 bp, Mus musculus
ttgtggcccaggatgacaacgagtg

SEQ ID NO: 989388 - DNA, 25 bp, Mus musculus
ttgtggcccaggttgacaacgagtg

SEQ ID NO: 989389 - DNA, 25 bp, Mus musculus
ttgtgggcaaagctattgacttcat

SEQ ID NO: 989390 - DNA, 25 bp, Mus musculus
ttgtgggcaaaggtattgacttcat

SEQ ID NO: 989391 - DNA, 25 bp, Mus musculus
ttgtgggcccagatggctttggccc

SEQ ID NO: 989392 - DNA, 25 bp, Mus musculus
ttgtgggcccagttggctttggccc

SEQ ID NO: 989393 - DNA, 25 bp, Mus musculus
ttgtggggctctcctgtgtagatgc

SEQ ID NO: 989394 - DNA, 25 bp, Mus musculus
ttgtggggctctgctgtgtagatgc

SEQ ID NO: 989395 - DNA, 25 bp, Mus musculus
ttgtgggttgtgcacgtggagcaga

SEQ ID NO: 989396 - DNA, 25 bp, Mus musculus
ttgtgggttgtgcaggtggagcaga

SEQ ID NO: 989397 - DNA, 25 bp, Mus musculus
ttgtgtacagccctgaccaggtgtc

SEQ ID NO: 989398 - DNA, 25 bp, Mus musculus
ttgtgtacaggcctgaccaggtgtc

SEQ ID NO: 989399 - DNA, 25 bp, Mus musculus
ttgtgtcaaaagcctatgtccccac

SEQ ID NO: 989400 - DNA, 25 bp, Mus musculus
ttgtgtcaaaagcgaagatggaaga

SEQ ID NO: 989401 - DNA, 25 bp, Mus musculus
ttgtgtcaaaaggctatgtccccac

SEQ ID NO: 989402 - DNA, 25 bp, Mus musculus
ttgtgtcaaaagggaagatggaaga

SEQ ID NO: 989403 - DNA, 25 bp, Mus musculus
ttgtgtcttcagaaatgcagctctt

SEQ ID NO: 989404 - DNA, 25 bp, Mus musculus
ttgtgtcttcagtaatgcagctctt

SEQ ID NO: 989405 - DNA, 25 bp, Mus musculus
ttgtgtgagtcactggggtcatgat

SEQ ID NO: 989406 - DNA, 25 bp, Mus musculus
ttgtgtgagtcagtggggtcatgat

SEQ ID NO: 989407 - DNA, 25 bp, Mus musculus
ttgtgtgatggtcacgaagcctgct

SEQ ID NO: 989408 - DNA, 25 bp, Mus musculus
ttgtgtgatggtcaggaagcctgct

SEQ ID NO: 989409 - DNA, 25 bp, Mus musculus
ttgtgtgcgacaccttggatgacta

SEQ ID NO: 989410 - DNA, 25 bp, Mus musculus
ttgtgtgcgacagcttggatgacta

SEQ ID NO: 989411 - DNA, 25 bp, Mus musculus
ttgtgtgctgctcaaagaggtcctc

SEQ ID NO: 989412 - DNA, 25 bp, Mus musculus
ttgtgtgctgctcatagaggtcctc

SEQ ID NO: 989413 - DNA, 25 bp, Mus musculus
ttgtgtggccaaagccaaacttgcc

SEQ ID NO: 989414 - DNA, 25 bp, Mus musculus
ttgtgtggccaaagggacagtactt

SEQ ID NO: 989415 - DNA, 25 bp, Mus musculus
ttgtgtggccaatgccaaacttgcc

SEQ ID NO: 989416 - DNA, 25 bp, Mus musculus
ttgtgtggccaatgggacagtactt

SEQ ID NO: 989417 - DNA, 25 bp, Mus musculus
ttgtgtgtgacacccccacagagca

SEQ ID NO: 989418 - DNA, 25 bp, Mus musculus
ttgtgtgtgacagccccacagagca

SEQ ID NO: 989419 - DNA, 25 bp, Mus musculus
ttgtgttatcagaacccccaacttg

SEQ ID NO: 989420 - DNA, 25 bp, Mus musculus
ttgtgttatcagaagccccaacttg

SEQ ID NO: 989421 - DNA, 25 bp, Mus musculus
ttgtgttcagcccacacacagctgt

SEQ ID NO: 989422 - DNA, 25 bp, Mus musculus
ttgtgttcagcccagacacagctgt

SEQ ID NO: 989423 - DNA, 25 bp, Mus musculus
ttgtgttcctggctcttgctttctc

SEQ ID NO: 989424 - DNA, 25 bp, Mus musculus
ttgtgttcctgggtcttgctttctc

SEQ ID NO: 989425 - DNA, 25 bp, Mus musculus
ttgtgttggcaacagagatgaagat

SEQ ID NO: 989426 - DNA, 25 bp, Mus musculus
ttgtgttggcaacaggccacagcac

SEQ ID NO: 989427 - DNA, 25 bp, Mus musculus
ttgtgttggcaagagagatgaagat

SEQ ID NO: 989428 - DNA, 25 bp, Mus musculus
ttgtgttggcaagaggccacagcac

SEQ ID NO: 989429 - DNA, 25 bp, Mus musculus
ttgtgtttgtagacccatccctgac

SEQ ID NO: 989430 - DNA, 25 bp, Mus musculus
ttgtgtttgtagtcccatccctgac

SEQ ID NO: 989431 - DNA, 25 bp, Mus musculus
ttgtgttttcagatgtccctggtag

SEQ ID NO: 989432 - DNA, 25 bp, Mus musculus
ttgtgttttcagttgtccctggtag

SEQ ID NO: 989433 - DNA, 25 bp, Mus musculus
ttgttaacagctcaaaatgcagatc

SEQ ID NO: 989434 - DNA, 25 bp, Mus musculus
ttgttaacaggtcaaaatgcagatc

SEQ ID NO: 989435 - DNA, 25 bp, Mus musculus
ttgttactaacaccaagttcaatgt

SEQ ID NO: 989436 - DNA, 25 bp, Mus musculus
ttgttactaacagcaagttcaatgt

SEQ ID NO: 989437 - DNA, 25 bp, Mus musculus
ttgttagatcagcctgctttctccc

SEQ ID NO: 989438 - DNA, 25 bp, Mus musculus
ttgttagatcagcggggctttgccc

SEQ ID NO: 989439 - DNA, 25 bp, Mus musculus
ttgttagatcaggctgctttctccc

SEQ ID NO: 989440 - DNA, 25 bp, Mus musculus
ttgttagatcaggggggctttgccc

SEQ ID NO: 989441 - DNA, 25 bp, Mus musculus
ttgttatgccagacaggatttgcac

SEQ ID NO: 989442 - DNA, 25 bp, Mus musculus
ttgttatgccagtcaggatttgcac

SEQ ID NO: 989443 - DNA, 25 bp, Mus musculus
ttgttccataagcgtcctgtgatca

SEQ ID NO: 989444 - DNA, 25 bp, Mus musculus
ttgttccataagggtcctgtgatca

SEQ ID NO: 989445 - DNA, 25 bp, Mus musculus
ttgttccctgggcacgtttcagtcg

SEQ ID NO: 989446 - DNA, 25 bp, Mus musculus
ttgttccctgggcaggtttcagtcg

SEQ ID NO: 989447 - DNA, 25 bp, Mus musculus
ttgttcctgcattacgggaaagctg

SEQ ID NO: 989448 - DNA, 25 bp, Mus musculus
ttgttcctgcattaggggaaagctg

SEQ ID NO: 989449 - DNA, 25 bp, Mus musculus
ttgttcctggcgctatatgtgcagg

SEQ ID NO: 989450 - DNA, 25 bp, Mus musculus
ttgttcctggcggtatatgtgcagg

SEQ ID NO: 989451 - DNA, 25 bp, Mus musculus
ttgttcgaataaatgctgctcatgg

SEQ ID NO: 989452 - DNA, 25 bp, Mus musculus
ttgttcgaattaatgctgctcatgg

SEQ ID NO: 989453 - DNA, 25 bp, Mus musculus
ttgttcgacgatccatcctcagttc

SEQ ID NO: 989454 - DNA, 25 bp, Mus musculus
ttgttcgacgttccatcctcagttc

SEQ ID NO: 989455 - DNA, 25 bp, Mus musculus
ttgttcgtggagctggagcctacta

SEQ ID NO: 989456 - DNA, 25 bp, Mus musculus
ttgttcgtggaggtggagcctacta

SEQ ID NO: 989457 - DNA, 25 bp, Mus musculus
ttgttctctgccattggctacgcat

SEQ ID NO: 989458 - DNA, 25 bp, Mus musculus
ttgttctctggcattggctacgcat

SEQ ID NO: 989459 - DNA, 25 bp, Mus musculus
ttgttctgaagctgctcactttaac

SEQ ID NO: 989460 - DNA, 25 bp, Mus musculus
ttgttctgaagctggtcactttaac

SEQ ID NO: 989461 - DNA, 25 bp, Mus musculus
ttgttctgtgtggacgtactacaag

SEQ ID NO: 989462 - DNA, 25 bp, Mus musculus
ttgttctgtgtggaggtactacaag

SEQ ID NO: 989463 - DNA, 25 bp, Mus musculus
ttgttgaaaacatccaagcaaagct

SEQ ID NO: 989464 - DNA, 25 bp, Mus musculus
ttgttgaaaagatccaagcaaagct

SEQ ID NO: 989465 - DNA, 25 bp, Mus musculus
ttgttgcctgctacgacaacgaata

SEQ ID NO: 989466 - DNA, 25 bp, Mus musculus
ttgttgcctggtacgacaacgaata

SEQ ID NO: 989467 - DNA, 25 bp, Mus musculus
ttgttgcgtgccagtaacggagcca

SEQ ID NO: 989468 - DNA, 25 bp, Mus musculus
ttgttgcgtggcagtaacggagcca

SEQ ID NO: 989469 - DNA, 25 bp, Mus musculus
ttgttgctgctgcggtctgcgagct

SEQ ID NO: 989470 - DNA, 25 bp, Mus musculus
ttgttgctgctggggtctgcgagct

SEQ ID NO: 989471 - DNA, 25 bp, Mus musculus
ttgttgctttcccagcactatggtg

SEQ ID NO: 989472 - DNA, 25 bp, Mus musculus
ttgttgctttgccagcactatggtg

SEQ ID NO: 989473 - DNA, 25 bp, Mus musculus
ttgttggaggagcgaacctagctca

SEQ ID NO: 989474 - DNA, 25 bp, Mus musculus
ttgttggaggagggaacctagctca

SEQ ID NO: 989475 - DNA, 25 bp, Mus musculus
ttgttggcagagagaacctgatgga

SEQ ID NO: 989476 - DNA, 25 bp, Mus musculus
ttgttggcagagtgaacctgatgga

SEQ ID NO: 989477 - DNA, 25 bp, Mus musculus
ttgttggccaagcatgaacatggaa

SEQ ID NO: 989478 - DNA, 25 bp, Mus musculus
ttgttggccaaggatgaacatggaa

SEQ ID NO: 989479 - DNA, 25 bp, Mus musculus
ttgttggctgctcgtgctaatgtgc

SEQ ID NO: 989480 - DNA, 25 bp, Mus musculus
ttgttggctgctggtgctaatgtgc

SEQ ID NO: 989481 - DNA, 25 bp, Mus musculus
ttgtttacagcaaagatgtagcgtc

SEQ ID NO: 989482 - DNA, 25 bp, Mus musculus
ttgtttacagctgatgttgccaagt

SEQ ID NO: 989483 - DNA, 25 bp, Mus musculus
ttgtttacaggaaagatgtagcgtc

SEQ ID NO: 989484 - DNA, 25 bp, Mus musculus
ttgtttacaggtgatgttgccaagt

SEQ ID NO: 989485 - DNA, 25 bp, Mus musculus
ttgtttatggagcaaaacacagaaa

SEQ ID NO: 989486 - DNA, 25 bp, Mus musculus
ttgtttatggaggaaaacacagaaa

SEQ ID NO: 989487 - DNA, 25 bp, Mus musculus
ttgtttccccagatcctgtcttcca

SEQ ID NO: 989488 - DNA, 25 bp, Mus musculus
ttgtttccccagttcctgtcttcca

SEQ ID NO: 989489 - DNA, 25 bp, Mus musculus
ttgtttctgtccgacgtcgctcatc

SEQ ID NO: 989490 - DNA, 25 bp, Mus musculus
ttgtttctgtccgaggtcgctcatc

SEQ ID NO: 989491 - DNA, 25 bp, Mus musculus
ttgtttgcaattagtctcttcattt

SEQ ID NO: 989492 - DNA, 25 bp, Mus musculus
ttgtttgcaatttgtctcttcattt

SEQ ID NO: 989493 - DNA, 25 bp, Mus musculus
ttgtttgcactgatctgtttacccg

SEQ ID NO: 989494 - DNA, 25 bp, Mus musculus
ttgtttgcactgttctgtttacccg

SEQ ID NO: 989495 - DNA, 25 bp, Mus musculus
ttgtttgctatgatctctttcattg

SEQ ID NO: 989496 - DNA, 25 bp, Mus musculus
ttgtttgctatgttctctttcattg

SEQ ID NO: 989497 - DNA, 25 bp, Mus musculus
ttgtttggaaagccaagcaggccaa

SEQ ID NO: 989498 - DNA, 25 bp, Mus musculus
ttgtttggaaaggcaagcaggccaa

SEQ ID NO: 989499 - DNA, 25 bp, Mus musculus
ttgtttgtgcagatgctttattctc

SEQ ID NO: 989500 - DNA, 25 bp, Mus musculus
ttgtttgtgcagttgctttattctc

SEQ ID NO: 989501 - DNA, 25 bp, Mus musculus
ttgttttcggggcgctgctgaattt

SEQ ID NO: 989502 - DNA, 25 bp, Mus musculus
ttgttttcggggggctgctgaattt

SEQ ID NO: 989503 - DNA, 25 bp, Mus musculus
ttgttttctgtcaagacaccatgat

SEQ ID NO: 989504 - DNA, 25 bp, Mus musculus
ttgttttctgtctagacaccatgat

SEQ ID NO: 989505 - DNA, 25 bp, Mus musculus
ttgtttttaagcatcaaaaagaaga

SEQ ID NO: 989506 - DNA, 25 bp, Mus musculus
ttgtttttaagcatgaaaaagaaga

SEQ ID NO: 989507 - DNA, 25 bp, Mus musculus
ttgtttttcatacacataaaaatta

SEQ ID NO: 989508 - DNA, 25 bp, Mus musculus
ttgtttttcatacagataaaaatta

SEQ ID NO: 989509 - DNA, 25 bp, Mus musculus
ttgtttttgctgatgggaacttttg

SEQ ID NO: 989510 - DNA, 25 bp, Mus musculus
ttgtttttgctgatttctaagttat

SEQ ID NO: 989511 - DNA, 25 bp, Mus musculus
ttgtttttgctgttgggaacttttg

SEQ ID NO: 989512 - DNA, 25 bp, Mus musculus
ttgtttttgctgttttctaagttat

SEQ ID NO: 989513 - DNA, 25 bp, Mus musculus
tttaaaatacagcgtatgcatgcac

SEQ ID NO: 989514 - DNA, 25 bp, Mus musculus
tttaaaatacagggtatgcatgcac

SEQ ID NO: 989515 - DNA, 25 bp, Mus musculus
tttaaacattttcaaatctggaggc

SEQ ID NO: 989516 - DNA, 25 bp, Mus musculus
tttaaacattttcatatctggaggc

SEQ ID NO: 989517 - DNA, 25 bp, Mus musculus
tttaaacgccacaactctgatgctc

SEQ ID NO: 989518 - DNA, 25 bp, Mus musculus
tttaaacgccactactctgatgctc

SEQ ID NO: 989519 - DNA, 25 bp, Mus musculus
tttaaagaccagcagtcttgccaga

SEQ ID NO: 989520 - DNA, 25 bp, Mus musculus
tttaaagaccaggagtcttgccaga

SEQ ID NO: 989521 - DNA, 25 bp, Mus musculus
tttaaagcagccattagctatggga

SEQ ID NO: 989522 - DNA, 25 bp, Mus musculus
tttaaagcaggcattagctatggga

SEQ ID NO: 989523 - DNA, 25 bp, Mus musculus
tttaaaggcacacgaagcggaacag

SEQ ID NO: 989524 - DNA, 25 bp, Mus musculus
tttaaaggcacaggaagcggaacag

SEQ ID NO: 989525 - DNA, 25 bp, Mus musculus
tttaaagtttgacgtgggatgtgtg

SEQ ID NO: 989526 - DNA, 25 bp, Mus musculus
tttaaagtttgaggtgggatgtgtg

SEQ ID NO: 989527 - DNA, 25 bp, Mus musculus
tttaaatatgactagagtggatgtg

SEQ ID NO: 989528 - DNA, 25 bp, Mus musculus
tttaaatatgtctagagtggatgtg

SEQ ID NO: 989529 - DNA, 25 bp, Mus musculus
tttaaatcccagattggtgccttgc

SEQ ID NO: 989530 - DNA, 25 bp, Mus musculus
tttaaatcccagtttggtgccttgc

SEQ ID NO: 989531 - DNA, 25 bp, Mus musculus
tttaaatgtacactctaaatccagt

SEQ ID NO: 989532 - DNA, 25 bp, Mus musculus
tttaaatgtacagtctaaatccagt

SEQ ID NO: 989533 - DNA, 25 bp, Mus musculus
tttaaattctgatgaattaaaaatc

SEQ ID NO: 989534 - DNA, 25 bp, Mus musculus
tttaaattctgatgtattaaaaatc

SEQ ID NO: 989535 - DNA, 25 bp, Mus musculus
tttaaccagaaacgtgatctgtaaa

SEQ ID NO: 989536 - DNA, 25 bp, Mus musculus
tttaaccagaaaggtgatctgtaaa

SEQ ID NO: 989537 - DNA, 25 bp, Mus musculus
tttaacccagctgactcatattctc

SEQ ID NO: 989538 - DNA, 25 bp, Mus musculus
tttaacccaggtgactcatattctc

SEQ ID NO: 989539 - DNA, 25 bp, Mus musculus
tttaacccccctaacggcagcagca

SEQ ID NO: 989540 - DNA, 25 bp, Mus musculus
tttaacccccctaagggcagcagca

SEQ ID NO: 989541 - DNA, 25 bp, Mus musculus
tttaaccgaactcacggattgcttt

SEQ ID NO: 989542 - DNA, 25 bp, Mus musculus
tttaaccgaactcagggattgcttt

SEQ ID NO: 989543 - DNA, 25 bp, Mus musculus
tttaactaccaaccatctatatttg

SEQ ID NO: 989544 - DNA, 25 bp, Mus musculus
tttaactaccaagcatctatatttg

SEQ ID NO: 989545 - DNA, 25 bp, Mus musculus
tttaactggaaacaatgtcttgatt

SEQ ID NO: 989546 - DNA, 25 bp, Mus musculus
tttaactggaaacgatataattgac

SEQ ID NO: 989547 - DNA, 25 bp, Mus musculus
tttaactggaaagaatgtcttgatt

SEQ ID NO: 989548 - DNA, 25 bp, Mus musculus
tttaactggaaaggatataattgac

SEQ ID NO: 989549 - DNA, 25 bp, Mus musculus
tttaagaacaagaactgaaagtgct

SEQ ID NO: 989550 - DNA, 25 bp, Mus musculus
tttaagaacaagcacaacatccacg

SEQ ID NO: 989551 - DNA, 25 bp, Mus musculus
tttaagaacaaggacaacatccacg

SEQ ID NO: 989552 - DNA, 25 bp, Mus musculus
tttaagaacaagtactgaaagtgct

SEQ ID NO: 989553 - DNA, 25 bp, Mus musculus
tttaagacaagtcgttgctatggga

SEQ ID NO: 989554 - DNA, 25 bp, Mus musculus
tttaagacaagtggttgctatggga

SEQ ID NO: 989555 - DNA, 25 bp, Mus musculus
tttaagactgagagtgaagggcatt

SEQ ID NO: 989556 - DNA, 25 bp, Mus musculus
tttaagactgtgagtgaagggcatt

SEQ ID NO: 989557 - DNA, 25 bp, Mus musculus
tttaagagagcatttaacagtgcgt

SEQ ID NO: 989558 - DNA, 25 bp, Mus musculus
tttaagagagctggctttgcagctg

SEQ ID NO: 989559 - DNA, 25 bp, Mus musculus
tttaagagaggatttaacagtgcgt

SEQ ID NO: 989560 - DNA, 25 bp, Mus musculus
tttaagagaggtggctttgcagctg

SEQ ID NO: 989561 - DNA, 25 bp, Mus musculus
tttaagataggaggctccctgctat

SEQ ID NO: 989562 - DNA, 25 bp, Mus musculus
tttaagataggagggtccctgctat

SEQ ID NO: 989563 - DNA, 25 bp, Mus musculus
tttaagcatgaaaaagaagatggtg

SEQ ID NO: 989564 - DNA, 25 bp, Mus musculus
tttaagcatgtaaaagaagatggtg

SEQ ID NO: 989565 - DNA, 25 bp, Mus musculus
tttaagccagagttgtaagcttgat

SEQ ID NO: 989566 - DNA, 25 bp, Mus musculus
tttaagccagtgttgtaagcttgat

SEQ ID NO: 989567 - DNA, 25 bp, Mus musculus
tttaagctcagatgaaaagaagaaa

SEQ ID NO: 989568 - DNA, 25 bp, Mus musculus
tttaagctcagatgtaaagaagaaa

SEQ ID NO: 989569 - DNA, 25 bp, Mus musculus
tttaaggggagacctcctgctttct

SEQ ID NO: 989570 - DNA, 25 bp, Mus musculus
tttaaggggagagctcctgctttct

SEQ ID NO: 989571 - DNA, 25 bp, Mus musculus
tttaagtcccagccagagtggcggg

SEQ ID NO: 989572 - DNA, 25 bp, Mus musculus
tttaagtcccaggcagagtggcggg

SEQ ID NO: 989573 - DNA, 25 bp, Mus musculus
tttaagtgataatacgttaaagaat

SEQ ID NO: 989574 - DNA, 25 bp, Mus musculus
tttaagtgataataggttaaagaat

SEQ ID NO: 989575 - DNA, 25 bp, Mus musculus
tttaatacccagcatgtattttatg

SEQ ID NO: 989576 - DNA, 25 bp, Mus musculus
tttaatacccaggatgtattttatg

SEQ ID NO: 989577 - DNA, 25 bp, Mus musculus
tttaatgactctctttggtttgttt

SEQ ID NO: 989578 - DNA, 25 bp, Mus musculus
tttaatgactgtctttggtttgttt

SEQ ID NO: 989579 - DNA, 25 bp, Mus musculus
tttaatgatgaggtccttctgtagc

SEQ ID NO: 989580 - DNA, 25 bp, Mus musculus
tttaatgatgtggtccttctgtagc

SEQ ID NO: 989581 - DNA, 25 bp, Mus musculus
tttaatgcaagacagatgctgagga

SEQ ID NO: 989582 - DNA, 25 bp, Mus musculus
tttaatgcaagagagatgctgagga

SEQ ID NO: 989583 - DNA, 25 bp, Mus musculus
tttaatggttgacaggtgtggcgaa

SEQ ID NO: 989584 - DNA, 25 bp, Mus musculus
tttaatggttgagaggtgtggcgaa

SEQ ID NO: 989585 - DNA, 25 bp, Mus musculus
tttaattgacagattagctttattt

SEQ ID NO: 989586 - DNA, 25 bp, Mus musculus
tttaattgacagtttagctttattt

SEQ ID NO: 989587 - DNA, 25 bp, Mus musculus
tttaattgcgcaaggcatcaacgtc

SEQ ID NO: 989588 - DNA, 25 bp, Mus musculus
tttaattgcgcatggcatcaacgtc

SEQ ID NO: 989589 - DNA, 25 bp, Mus musculus
tttacacgaccactgcagcccctgg

SEQ ID NO: 989590 - DNA, 25 bp, Mus musculus
tttacacgaccagtgcagcccctgg

SEQ ID NO: 989591 - DNA, 25 bp, Mus musculus
tttacagctagtacatcactatttc

SEQ ID NO: 989592 - DNA, 25 bp, Mus musculus
tttacagctagttcatcactatttc

SEQ ID NO: 989593 - DNA, 25 bp, Mus musculus
tttacagctcttcatgtctcgcctg

SEQ ID NO: 989594 - DNA, 25 bp, Mus musculus
tttacagctcttgatgtctcgcctg

SEQ ID NO: 989595 - DNA, 25 bp, Mus musculus
tttacaggcgagatgatttttgatc

SEQ ID NO: 989596 - DNA, 25 bp, Mus musculus
tttacaggcgagttgatttttgatc

SEQ ID NO: 989597 - DNA, 25 bp, Mus musculus
tttacatatgcacacatcaagccct

SEQ ID NO: 989598 - DNA, 25 bp, Mus musculus
tttacatatgcacgaatctccacac

SEQ ID NO: 989599 - DNA, 25 bp, Mus musculus
tttacatatgcagacatcaagccct

SEQ ID NO: 989600 - DNA, 25 bp, Mus musculus
tttacatatgcaggaatctccacac

SEQ ID NO: 989601 - DNA, 25 bp, Mus musculus
tttacatcaaagccaagaaattctt

SEQ ID NO: 989602 - DNA, 25 bp, Mus musculus
tttacatcaaaggcaagaaattctt

SEQ ID NO: 989603 - DNA, 25 bp, Mus musculus
tttacatccatctcatggacgacga

SEQ ID NO: 989604 - DNA, 25 bp, Mus musculus
tttacatccatctcttggacgacga

SEQ ID NO: 989605 - DNA, 25 bp, Mus musculus
tttacatgtgatctgagttctactg

SEQ ID NO: 989606 - DNA, 25 bp, Mus musculus
tttacatgtgatgtgagttctactg

SEQ ID NO: 989607 - DNA, 25 bp, Mus musculus
tttaccagagcaagcactataatga

SEQ ID NO: 989608 - DNA, 25 bp, Mus musculus
tttaccagagcaaggactataatga

SEQ ID NO: 989609 - DNA, 25 bp, Mus musculus
tttaccagcgccactcagtcccaga

SEQ ID NO: 989610 - DNA, 25 bp, Mus musculus
tttaccagcggcactcagtcccaga

SEQ ID NO: 989611 - DNA, 25 bp, Mus musculus
tttaccctactcatcacaggcaaac

SEQ ID NO: 989612 - DNA, 25 bp, Mus musculus
tttaccctactcatgacaggcaaac

SEQ ID NO: 989613 - DNA, 25 bp, Mus musculus
tttacctttgcacaaagaagaatcc

SEQ ID NO: 989614 - DNA, 25 bp, Mus musculus
tttacctttgcagaaagaagaatcc

SEQ ID NO: 989615 - DNA, 25 bp, Mus musculus
tttacgactctgcacctcttcgctc

SEQ ID NO: 989616 - DNA, 25 bp, Mus musculus
tttacgactctggacctcttcgctc

SEQ ID NO: 989617 - DNA, 25 bp, Mus musculus
tttacgatatcacaaatgttaactc

SEQ ID NO: 989618 - DNA, 25 bp, Mus musculus
tttacgatatcacatatgttaactc

SEQ ID NO: 989619 - DNA, 25 bp, Mus musculus
tttacgcttcctgaagggatgggct

SEQ ID NO: 989620 - DNA, 25 bp, Mus musculus
tttacgcttcctgatgggatgggct

SEQ ID NO: 989621 - DNA, 25 bp, Mus musculus
tttacggagccacccatgagaagtt

SEQ ID NO: 989622 - DNA, 25 bp, Mus musculus
tttacggagccagccatgagaagtt

SEQ ID NO: 989623 - DNA, 25 bp, Mus musculus
tttactaaaacacgcatcaggaaag

SEQ ID NO: 989624 - DNA, 25 bp, Mus musculus
tttactaaaacaggcatcaggaaag

SEQ ID NO: 989625 - DNA, 25 bp, Mus musculus
tttactacagactgcttgggaactt

SEQ ID NO: 989626 - DNA, 25 bp, Mus musculus
tttactacagactggttgggaactt

SEQ ID NO: 989627 - DNA, 25 bp, Mus musculus
tttactccagacaaatcgccatcaa

SEQ ID NO: 989628 - DNA, 25 bp, Mus musculus
tttactccagagcctatgactcccc

SEQ ID NO: 989629 - DNA, 25 bp, Mus musculus
tttactccagatggcagactttctg

SEQ ID NO: 989630 - DNA, 25 bp, Mus musculus
tttactccagccctggctgtcctag

SEQ ID NO: 989631 - DNA, 25 bp, Mus musculus
tttactccaggcctggctgtcctag

SEQ ID NO: 989632 - DNA, 25 bp, Mus musculus
tttactccagtcaaatcgccatcaa

SEQ ID NO: 989633 - DNA, 25 bp, Mus musculus
tttactccagtgcctatgactcccc

SEQ ID NO: 989634 - DNA, 25 bp, Mus musculus
tttactccagttggcagactttctg

SEQ ID NO: 989635 - DNA, 25 bp, Mus musculus
tttactcccaatatgaagactcttc

SEQ ID NO: 989636 - DNA, 25 bp, Mus musculus
tttactcccaatttgaagactcttc

SEQ ID NO: 989637 - DNA, 25 bp, Mus musculus
tttactctcacaatcctctgtcaga

SEQ ID NO: 989638 - DNA, 25 bp, Mus musculus
tttactctcacaatctgtcctactg

SEQ ID NO: 989639 - DNA, 25 bp, Mus musculus
tttactctcacaatgctctgtcaga

SEQ ID NO: 989640 - DNA, 25 bp, Mus musculus
tttactctcacaatgtgtcctactg

SEQ ID NO: 989641 - DNA, 25 bp, Mus musculus
tttactgaagaacactgccttttta

SEQ ID NO: 989642 - DNA, 25 bp, Mus musculus
tttactgaagaacagtgccttttta

SEQ ID NO: 989643 - DNA, 25 bp, Mus musculus
tttactgaatataagtaccatatta

SEQ ID NO: 989644 - DNA, 25 bp, Mus musculus
tttactgaatttaagtaccatatta

SEQ ID NO: 989645 - DNA, 25 bp, Mus musculus
tttactgagtcttaagtatgttcaa

SEQ ID NO: 989646 - DNA, 25 bp, Mus musculus
tttactgagtcttatgtatgttcaa

SEQ ID NO: 989647 - DNA, 25 bp, Mus musculus
tttactgccatgacattctacggag

SEQ ID NO: 989648 - DNA, 25 bp, Mus musculus
tttactgccatgactttctacggag

SEQ ID NO: 989649 - DNA, 25 bp, Mus musculus
tttactggctgtctcaccaagtaac

SEQ ID NO: 989650 - DNA, 25 bp, Mus musculus
tttactggctgtctcgtttaacttg

SEQ ID NO: 989651 - DNA, 25 bp, Mus musculus
tttactggctgtctgaccaagtaac

SEQ ID NO: 989652 - DNA, 25 bp, Mus musculus
tttactggctgtctggtttaacttg

SEQ ID NO: 989653 - DNA, 25 bp, Mus musculus
tttactttcaagctgccatactcgg

SEQ ID NO: 989654 - DNA, 25 bp, Mus musculus
tttactttcaaggtgccatactcgg

SEQ ID NO: 989655 - DNA, 25 bp, Mus musculus
tttacttttataaggctgtgtgcaa

SEQ ID NO: 989656 - DNA, 25 bp, Mus musculus
tttacttttatatggctgtgtgcaa

SEQ ID NO: 989657 - DNA, 25 bp, Mus musculus
tttacttttgctatatcatgtataa

SEQ ID NO: 989658 - DNA, 25 bp, Mus musculus
tttacttttggtatatcatgtataa

SEQ ID NO: 989659 - DNA, 25 bp, Mus musculus
tttagaaagaagcatgtctgctgtg

SEQ ID NO: 989660 - DNA, 25 bp, Mus musculus
tttagaaagaaggatgtctgctgtg

SEQ ID NO: 989661 - DNA, 25 bp, Mus musculus
tttagaaaggctctggaactgatcg

SEQ ID NO: 989662 - DNA, 25 bp, Mus musculus
tttagaaaggctgtggaactgatcg

SEQ ID NO: 989663 - DNA, 25 bp, Mus musculus
tttagaagacacagcttgctgggac

SEQ ID NO: 989664 - DNA, 25 bp, Mus musculus
tttagaagacacaggttgctgggac

SEQ ID NO: 989665 - DNA, 25 bp, Mus musculus
tttagaagagcgctgtcaaatctac

SEQ ID NO: 989666 - DNA, 25 bp, Mus musculus
tttagaagagggctgtcaaatctac

SEQ ID NO: 989667 - DNA, 25 bp, Mus musculus
tttagaatatatcacaccacgacgg

SEQ ID NO: 989668 - DNA, 25 bp, Mus musculus
tttagaatatatcagaccacgacgg

SEQ ID NO: 989669 - DNA, 25 bp, Mus musculus
tttagactacaagacggttatgatc

SEQ ID NO: 989670 - DNA, 25 bp, Mus musculus
tttagactacaagagggttatgatc

SEQ ID NO: 989671 - DNA, 25 bp, Mus musculus
tttagagatgagcctggaggggtag

SEQ ID NO: 989672 - DNA, 25 bp, Mus musculus
tttagagatgaggctggaggggtag

SEQ ID NO: 989673 - DNA, 25 bp, Mus musculus
tttagagcctatcgatctgactgta

SEQ ID NO: 989674 - DNA, 25 bp, Mus musculus
tttagagcctatggatctgactgta

SEQ ID NO: 989675 - DNA, 25 bp, Mus musculus
tttagagcctgctgccaatcatctg

SEQ ID NO: 989676 - DNA, 25 bp, Mus musculus
tttagagcctgctggcaatcatctg

SEQ ID NO: 989677 - DNA, 25 bp, Mus musculus
tttagagggaagcattcgagcagtt

SEQ ID NO: 989678 - DNA, 25 bp, Mus musculus
tttagagggaaggattcgagcagtt

SEQ ID NO: 989679 - DNA, 25 bp, Mus musculus
tttagatctcttcacgttcctagat

SEQ ID NO: 989680 - DNA, 25 bp, Mus musculus
tttagatctcttcaggttcctagat

SEQ ID NO: 989681 - DNA, 25 bp, Mus musculus
tttagatctgcctcactagtagcca

SEQ ID NO: 989682 - DNA, 25 bp, Mus musculus
tttagatctggctcactagtagcca

SEQ ID NO: 989683 - DNA, 25 bp, Mus musculus
tttagatgatcacagtggtaagaaa

SEQ ID NO: 989684 - DNA, 25 bp, Mus musculus
tttagatgatcagagtggtaagaaa

SEQ ID NO: 989685 - DNA, 25 bp, Mus musculus
tttagcataaagcacacaatagtat

SEQ ID NO: 989686 - DNA, 25 bp, Mus musculus
tttagcataaagcagacaatagtat

SEQ ID NO: 989687 - DNA, 25 bp, Mus musculus
tttagccaccagcacacagaatgtt

SEQ ID NO: 989688 - DNA, 25 bp, Mus musculus
tttagccaccaggacacagaatgtt

SEQ ID NO: 989689 - DNA, 25 bp, Mus musculus
tttagcccagatagtcgccacatcc

SEQ ID NO: 989690 - DNA, 25 bp, Mus musculus
tttagcccagttagtcgccacatcc

SEQ ID NO: 989691 - DNA, 25 bp, Mus musculus
tttagccccactggatctaaaggaa

SEQ ID NO: 989692 - DNA, 25 bp, Mus musculus
tttagccccagtggatctaaaggaa

SEQ ID NO: 989693 - DNA, 25 bp, Mus musculus
tttagctatgaaaagtgggagatag

SEQ ID NO: 989694 - DNA, 25 bp, Mus musculus
tttagctatgtaaagtgggagatag

SEQ ID NO: 989695 - DNA, 25 bp, Mus musculus
tttagcttggaggacgttagctatt

SEQ ID NO: 989696 - DNA, 25 bp, Mus musculus
tttagcttggaggaggttagctatt

SEQ ID NO: 989697 - DNA, 25 bp, Mus musculus
tttaggcctgttcacgccaaatttg

SEQ ID NO: 989698 - DNA, 25 bp, Mus musculus
tttaggcctgttcaggccaaatttg

SEQ ID NO: 989699 - DNA, 25 bp, Mus musculus
tttagtatcaaaacttctctattct

SEQ ID NO: 989700 - DNA, 25 bp, Mus musculus
tttagtatcaaatcttctctattct

SEQ ID NO: 989701 - DNA, 25 bp, Mus musculus
tttagtgacttgactccagaagaat

SEQ ID NO: 989702 - DNA, 25 bp, Mus musculus
tttagtgacttgtctccagaagaat

SEQ ID NO: 989703 - DNA, 25 bp, Mus musculus
tttagttaagcgagtggatgagtca

SEQ ID NO: 989704 - DNA, 25 bp, Mus musculus
tttagttaagggagtggatgagtca

SEQ ID NO: 989705 - DNA, 25 bp, Mus musculus
tttagtttcacagacatccttggtg

SEQ ID NO: 989706 - DNA, 25 bp, Mus musculus
tttagtttcacagagatccttggtg

SEQ ID NO: 989707 - DNA, 25 bp, Mus musculus
tttataatgattcccatggagggac

SEQ ID NO: 989708 - DNA, 25 bp, Mus musculus
tttataatgattccgatggagggac

SEQ ID NO: 989709 - DNA, 25 bp, Mus musculus
tttataatgattctccttggatgtg

SEQ ID NO: 989710 - DNA, 25 bp, Mus musculus
tttataatgattgtccttggatgtg

SEQ ID NO: 989711 - DNA, 25 bp, Mus musculus
tttataccctctgtctgcagtgctg

SEQ ID NO: 989712 - DNA, 25 bp, Mus musculus
tttataccctgtgtctgcagtgctg

SEQ ID NO: 989713 - DNA, 25 bp, Mus musculus
tttatacggctcccagacaccaaat

SEQ ID NO: 989714 - DNA, 25 bp, Mus musculus
tttatacggctcgcagacaccaaat

SEQ ID NO: 989715 - DNA, 25 bp, Mus musculus
tttatactgtgacacgagggctggc

SEQ ID NO: 989716 - DNA, 25 bp, Mus musculus
tttatactgtgacaggagggctggc

SEQ ID NO: 989717 - DNA, 25 bp, Mus musculus
tttatatatgagcgttaccaaggct

SEQ ID NO: 989718 - DNA, 25 bp, Mus musculus
tttatatatgagggttaccaaggct

SEQ ID NO: 989719 - DNA, 25 bp, Mus musculus
tttatatccttctactgttgggcaa

SEQ ID NO: 989720 - DNA, 25 bp, Mus musculus
tttatatccttctagtgttgggcaa

SEQ ID NO: 989721 - DNA, 25 bp, Mus musculus
tttatcaaagatttcacaaaggaga

SEQ ID NO: 989722 - DNA, 25 bp, Mus musculus
tttatcaaagttttcacaaaggaga

SEQ ID NO: 989723 - DNA, 25 bp, Mus musculus
tttatcaacaagcctcttattgttg

SEQ ID NO: 989724 - DNA, 25 bp, Mus musculus
tttatcaacaaggctcttattgttg

SEQ ID NO: 989725 - DNA, 25 bp, Mus musculus
tttatcacacagcaactgaagagga

SEQ ID NO: 989726 - DNA, 25 bp, Mus musculus
tttatcacacaggaactgaagagga

SEQ ID NO: 989727 - DNA, 25 bp, Mus musculus
tttatcacccaacgttcagacaatg

SEQ ID NO: 989728 - DNA, 25 bp, Mus musculus
tttatcacccaaggttcagacaatg

SEQ ID NO: 989729 - DNA, 25 bp, Mus musculus
tttatcaccttccacaactctgcag

SEQ ID NO: 989730 - DNA, 25 bp, Mus musculus
tttatcaccttccacactcagaact

SEQ ID NO: 989731 - DNA, 25 bp, Mus musculus
tttatcaccttccacgctcaaacta

SEQ ID NO: 989732 - DNA, 25 bp, Mus musculus
tttatcaccttccagaactctgcag

SEQ ID NO: 989733 - DNA, 25 bp, Mus musculus
tttatcaccttccagactcagaact

SEQ ID NO: 989734 - DNA, 25 bp, Mus musculus
tttatcaccttccaggctcaaacta

SEQ ID NO: 989735 - DNA, 25 bp, Mus musculus
tttatcagaaagctgttcctggtgc

SEQ ID NO: 989736 - DNA, 25 bp, Mus musculus
tttatcagaaaggtgttcctggtgc

SEQ ID NO: 989737 - DNA, 25 bp, Mus musculus
tttatcatttaacaaaacatataac

SEQ ID NO: 989738 - DNA, 25 bp, Mus musculus
tttatcatttaagaaaacatataac

SEQ ID NO: 989739 - DNA, 25 bp, Mus musculus
tttatccaagtaatcagaggaagac

SEQ ID NO: 989740 - DNA, 25 bp, Mus musculus
tttatccaagtaatgagaggaagac

SEQ ID NO: 989741 - DNA, 25 bp, Mus musculus
tttatccagtcgcccctcccagaga

SEQ ID NO: 989742 - DNA, 25 bp, Mus musculus
tttatccagtcgccttctccttgca

SEQ ID NO: 989743 - DNA, 25 bp, Mus musculus
tttatccagtcggccctcccagaga

SEQ ID NO: 989744 - DNA, 25 bp, Mus musculus
tttatccagtcggcttctccttgca

SEQ ID NO: 989745 - DNA, 25 bp, Mus musculus
tttatcccagcatctgcagctaaag

SEQ ID NO: 989746 - DNA, 25 bp, Mus musculus
tttatcccaggatctgcagctaaag

SEQ ID NO: 989747 - DNA, 25 bp, Mus musculus
tttatcgaggagccagcgggccgtg

SEQ ID NO: 989748 - DNA, 25 bp, Mus musculus
tttatcgaggaggcagcgggccgtg

SEQ ID NO: 989749 - DNA, 25 bp, Mus musculus
tttatcgttatgttcattcacaatg

SEQ ID NO: 989750 - DNA, 25 bp, Mus musculus
tttatcgttatgttgattcacaatg

SEQ ID NO: 989751 - DNA, 25 bp, Mus musculus
tttatctccactcgattaaaatatc

SEQ ID NO: 989752 - DNA, 25 bp, Mus musculus
tttatctccactggattaaaatatc

SEQ ID NO: 989753 - DNA, 25 bp, Mus musculus
tttatctgtaacagcgtggaagatg

SEQ ID NO: 989754 - DNA, 25 bp, Mus musculus
tttatctgtatcagcgtggaagatg

SEQ ID NO: 989755 - DNA, 25 bp, Mus musculus
tttatcttcatatacggttccttta

SEQ ID NO: 989756 - DNA, 25 bp, Mus musculus
tttatcttcatatagggttccttta

SEQ ID NO: 989757 - DNA, 25 bp, Mus musculus
tttatctttgctgtcaaaaatgaaa

SEQ ID NO: 989758 - DNA, 25 bp, Mus musculus
tttatctttgctgtgaaaaatgaaa

SEQ ID NO: 989759 - DNA, 25 bp, Mus musculus
tttatgaaagcacggcttacatacc

SEQ ID NO: 989760 - DNA, 25 bp, Mus musculus
tttatgaaagcagggcttacatacc

SEQ ID NO: 989761 - DNA, 25 bp, Mus musculus
tttatgacagcttttggaatgacct

SEQ ID NO: 989762 - DNA, 25 bp, Mus musculus
tttatgacaggttttggaatgacct

SEQ ID NO: 989763 - DNA, 25 bp, Mus musculus
tttatgataccggacgaacagggag

SEQ ID NO: 989764 - DNA, 25 bp, Mus musculus
tttatgatacgggacgaacagggag

SEQ ID NO: 989765 - DNA, 25 bp, Mus musculus
tttatgatatcacaaatgttaactc

SEQ ID NO: 989766 - DNA, 25 bp, Mus musculus
tttatgatatcacatatgttaactc

SEQ ID NO: 989767 - DNA, 25 bp, Mus musculus
tttatgcttcagatcgccttgaagt

SEQ ID NO: 989768 - DNA, 25 bp, Mus musculus
tttatgcttcagttcgccttgaagt

SEQ ID NO: 989769 - DNA, 25 bp, Mus musculus
tttatgctttagctgaaggcgataa

SEQ ID NO: 989770 - DNA, 25 bp, Mus musculus
tttatgctttaggtgaaggcgataa

SEQ ID NO: 989771 - DNA, 25 bp, Mus musculus
tttatggaaatacacgaaccaaagt

SEQ ID NO: 989772 - DNA, 25 bp, Mus musculus
tttatggaaatacaggaaccaaagt

SEQ ID NO: 989773 - DNA, 25 bp, Mus musculus
tttatggcctttaactcatttggag

SEQ ID NO: 989774 - DNA, 25 bp, Mus musculus
tttatggcctttaagtcatttggag

SEQ ID NO: 989775 - DNA, 25 bp, Mus musculus
tttatgtcaacgatgcccccaagga

SEQ ID NO: 989776 - DNA, 25 bp, Mus musculus
tttatgtcaacgttgcccccaagga

SEQ ID NO: 989777 - DNA, 25 bp, Mus musculus
tttatgtcccagccattttctctat

SEQ ID NO: 989778 - DNA, 25 bp, Mus musculus
tttatgtcccaggcattttctctat

SEQ ID NO: 989779 - DNA, 25 bp, Mus musculus
tttatgtttgaacacgcccacgaag

SEQ ID NO: 989780 - DNA, 25 bp, Mus musculus
tttatgtttgaacaggcccacgaag

SEQ ID NO: 989781 - DNA, 25 bp, Mus musculus
tttatgtttggacgccatgacacca

SEQ ID NO: 989782 - DNA, 25 bp, Mus musculus
tttatgtttggaggccatgacacca

SEQ ID NO: 989783 - DNA, 25 bp, Mus musculus
tttattactgctgatcaagcgagga

SEQ ID NO: 989784 - DNA, 25 bp, Mus musculus
tttattactggtgatcaagcgagga

SEQ ID NO: 989785 - DNA, 25 bp, Mus musculus
tttattatacagcacacagtgatga

SEQ ID NO: 989786 - DNA, 25 bp, Mus musculus
tttattatacaggacacagtgatga

SEQ ID NO: 989787 - DNA, 25 bp, Mus musculus
tttattattgaaaaagagtccaagg

SEQ ID NO: 989788 - DNA, 25 bp, Mus musculus
tttattattgaaaacgcagtgagga

SEQ ID NO: 989789 - DNA, 25 bp, Mus musculus
tttattattgaaaaggcagtgagga

SEQ ID NO: 989790 - DNA, 25 bp, Mus musculus
tttattattgaaaatgagtccaagg

SEQ ID NO: 989791 - DNA, 25 bp, Mus musculus
tttattcaggcatgtgaaatgatct

SEQ ID NO: 989792 - DNA, 25 bp, Mus musculus
tttattcaggccacgcaacgggaag

SEQ ID NO: 989793 - DNA, 25 bp, Mus musculus
tttattcagggatgtgaaatgatct

SEQ ID NO: 989794 - DNA, 25 bp, Mus musculus
tttattcagggcacgcaacgggaag

SEQ ID NO: 989795 - DNA, 25 bp, Mus musculus
tttattggacgtaacatcgaacaac

SEQ ID NO: 989796 - DNA, 25 bp, Mus musculus
tttattggacgtaagatcgaacaac

SEQ ID NO: 989797 - DNA, 25 bp, Mus musculus
tttattgtgacacgtacctgtgtga

SEQ ID NO: 989798 - DNA, 25 bp, Mus musculus
tttattgtgacaggtacctgtgtga

SEQ ID NO: 989799 - DNA, 25 bp, Mus musculus
tttattttggagcttgtccagacaa

SEQ ID NO: 989800 - DNA, 25 bp, Mus musculus
tttattttggaggttgtccagacaa

SEQ ID NO: 989801 - DNA, 25 bp, Mus musculus
tttcaaaaacaacgaggaccagtat

SEQ ID NO: 989802 - DNA, 25 bp, Mus musculus
tttcaaaaacaaggaggaccagtat

SEQ ID NO: 989803 - DNA, 25 bp, Mus musculus
tttcaaaccaaacatagcagagatt

SEQ ID NO: 989804 - DNA, 25 bp, Mus musculus
tttcaaaccaaagatagcagagatt

SEQ ID NO: 989805 - DNA, 25 bp, Mus musculus
tttcaaaggacaagtatttgtgctt

SEQ ID NO: 989806 - DNA, 25 bp, Mus musculus
tttcaaaggacatgtatttgtgctt

SEQ ID NO: 989807 - DNA, 25 bp, Mus musculus
tttcaacaaatgcgatgcagaaaat

SEQ ID NO: 989808 - DNA, 25 bp, Mus musculus
tttcaacaaatgggatgcagaaaat

SEQ ID NO: 989809 - DNA, 25 bp, Mus musculus
tttcaacagctgctttccttctccg

SEQ ID NO: 989810 - DNA, 25 bp, Mus musculus
tttcaacagctggtttccttctccg

SEQ ID NO: 989811 - DNA, 25 bp, Mus musculus
tttcaaccatatctatttcaagaag

SEQ ID NO: 989812 - DNA, 25 bp, Mus musculus
tttcaaccatatgtatttcaagaag

SEQ ID NO: 989813 - DNA, 25 bp, Mus musculus
tttcaactcccacctgacacccctc

SEQ ID NO: 989814 - DNA, 25 bp, Mus musculus
tttcaactcccagctgacacccctc

SEQ ID NO: 989815 - DNA, 25 bp, Mus musculus
tttcaagaataagtagaggagatca

SEQ ID NO: 989816 - DNA, 25 bp, Mus musculus
tttcaagaataagttgaggagatca

SEQ ID NO: 989817 - DNA, 25 bp, Mus musculus
tttcaaggaatcagccgccagatcc

SEQ ID NO: 989818 - DNA, 25 bp, Mus musculus
tttcaaggaatctgccgccagatcc

SEQ ID NO: 989819 - DNA, 25 bp, Mus musculus
tttcaagtcaagaccttgtcgctcc

SEQ ID NO: 989820 - DNA, 25 bp, Mus musculus
tttcaagtcaagtccttgtcgctcc

SEQ ID NO: 989821 - DNA, 25 bp, Mus musculus
tttcaatctaatgaacaaacgctga

SEQ ID NO: 989822 - DNA, 25 bp, Mus musculus
tttcaatctaatgatcaaacgctga

SEQ ID NO: 989823 - DNA, 25 bp, Mus musculus
tttcacagagatccttggtgtttgg

SEQ ID NO: 989824 - DNA, 25 bp, Mus musculus
tttcacagagttccttggtgtttgg

SEQ ID NO: 989825 - DNA, 25 bp, Mus musculus
tttcaccaacctccatgtgtcctac

SEQ ID NO: 989826 - DNA, 25 bp, Mus musculus
tttcaccaacgtccatgtgtcctac

SEQ ID NO: 989827 - DNA, 25 bp, Mus musculus
tttcaccagccaatcggcctgccga

SEQ ID NO: 989828 - DNA, 25 bp, Mus musculus
tttcaccagccaatgggcctgccga

SEQ ID NO: 989829 - DNA, 25 bp, Mus musculus
tttcaccaggcaagacagtgaccct

SEQ ID NO: 989830 - DNA, 25 bp, Mus musculus
tttcaccagggaagacagtgaccct

SEQ ID NO: 989831 - DNA, 25 bp, Mus musculus
tttcacccatggaacacaaagtctg

SEQ ID NO: 989832 - DNA, 25 bp, Mus musculus
tttcacccatggaaccaccccccat

SEQ ID NO: 989833 - DNA, 25 bp, Mus musculus
tttcacccatggaagacaaagtctg

SEQ ID NO: 989834 - DNA, 25 bp, Mus musculus
tttcacccatggaagcaccccccat

SEQ ID NO: 989835 - DNA, 25 bp, Mus musculus
tttcaccgagcaatctggagatgat

SEQ ID NO: 989836 - DNA, 25 bp, Mus musculus
tttcaccgaggaatctggagatgat

SEQ ID NO: 989837 - DNA, 25 bp, Mus musculus
tttcacctctatcaagtaaatggtg

SEQ ID NO: 989838 - DNA, 25 bp, Mus musculus
tttcacctctatgaagtaaatggtg

SEQ ID NO: 989839 - DNA, 25 bp, Mus musculus
tttcacgtctctcgacaagccctca

SEQ ID NO: 989840 - DNA, 25 bp, Mus musculus
tttcacgtctctggacaagccctca

SEQ ID NO: 989841 - DNA, 25 bp, Mus musculus
tttcacgtggagcctgacagcagcc

SEQ ID NO: 989842 - DNA, 25 bp, Mus musculus
tttcacgtggccgggccaggctgtg

SEQ ID NO: 989843 - DNA, 25 bp, Mus musculus
tttcacgtgggcgggccaggctgtg

SEQ ID NO: 989844 - DNA, 25 bp, Mus musculus
tttcacgtggtgcctgacagcagcc

SEQ ID NO: 989845 - DNA, 25 bp, Mus musculus
tttcactaccgatccggatatcgtg

SEQ ID NO: 989846 - DNA, 25 bp, Mus musculus
tttcactaccgatcgggatatcgtg

SEQ ID NO: 989847 - DNA, 25 bp, Mus musculus
tttcactgtgctggaagggactcag

SEQ ID NO: 989848 - DNA, 25 bp, Mus musculus
tttcactgtggtaacgtggaaggga

SEQ ID NO: 989849 - DNA, 25 bp, Mus musculus
tttcactgtggtaaggtggaaggga

SEQ ID NO: 989850 - DNA, 25 bp, Mus musculus
tttcactgtggtggaagggactcag

SEQ ID NO: 989851 - DNA, 25 bp, Mus musculus
tttcagaaaaatctctgctccagct

SEQ ID NO: 989852 - DNA, 25 bp, Mus musculus
tttcagaaaaatgtctgctccagct

SEQ ID NO: 989853 - DNA, 25 bp, Mus musculus
tttcagaaagcaaaaccacattgag

SEQ ID NO: 989854 - DNA, 25 bp, Mus musculus
tttcagaaagcttcgattttcattt

SEQ ID NO: 989855 - DNA, 25 bp, Mus musculus
tttcagaaaggaaaaccacattgag

SEQ ID NO: 989856 - DNA, 25 bp, Mus musculus
tttcagaaaggttcgattttcattt

SEQ ID NO: 989857 - DNA, 25 bp, Mus musculus
tttcagaatgaaaacgaaagtgctt

SEQ ID NO: 989858 - DNA, 25 bp, Mus musculus
tttcagaatgaaaaggaaagtgctt

SEQ ID NO: 989859 - DNA, 25 bp, Mus musculus
tttcagaccacccacagggttctcc

SEQ ID NO: 989860 - DNA, 25 bp, Mus musculus
tttcagaccagccacagggttctcc

SEQ ID NO: 989861 - DNA, 25 bp, Mus musculus
tttcagagctctttcatgacttggg

SEQ ID NO: 989862 - DNA, 25 bp, Mus musculus
tttcagagctctttgatgacttggg

SEQ ID NO: 989863 - DNA, 25 bp, Mus musculus
tttcagataaaaaccggaatccact

SEQ ID NO: 989864 - DNA, 25 bp, Mus musculus
tttcagataaaaacgggaatccact

SEQ ID NO: 989865 - DNA, 25 bp, Mus musculus
tttcagatcacacctcagggattta

SEQ ID NO: 989866 - DNA, 25 bp, Mus musculus
tttcagatcacagctcagggattta

SEQ ID NO: 989867 - DNA, 25 bp, Mus musculus
tttcagcaactgctcaatttttcag

SEQ ID NO: 989868 - DNA, 25 bp, Mus musculus
tttcagcaactggtcaatttttcag

SEQ ID NO: 989869 - DNA, 25 bp, Mus musculus
tttcagccagcaagagctttctgga

SEQ ID NO: 989870 - DNA, 25 bp, Mus musculus
tttcagccaggaagagctttctgga

SEQ ID NO: 989871 - DNA, 25 bp, Mus musculus
tttcaggccaggcaccgagaacacg

SEQ ID NO: 989872 - DNA, 25 bp, Mus musculus
tttcaggccagggaccgagaacacg

SEQ ID NO: 989873 - DNA, 25 bp, Mus musculus
tttcagggagactgctgggctgatc

SEQ ID NO: 989874 - DNA, 25 bp, Mus musculus
tttcagggagtctgctgggctgatc

SEQ ID NO: 989875 - DNA, 25 bp, Mus musculus
tttcagtcagatatactttattaag

SEQ ID NO: 989876 - DNA, 25 bp, Mus musculus
tttcagtcagttatactttattaag

SEQ ID NO: 989877 - DNA, 25 bp, Mus musculus
tttcagttgacacgagccgtctacc

SEQ ID NO: 989878 - DNA, 25 bp, Mus musculus
tttcagttgacacggaacagtccaa

SEQ ID NO: 989879 - DNA, 25 bp, Mus musculus
tttcagttgacaggagccgtctacc

SEQ ID NO: 989880 - DNA, 25 bp, Mus musculus
tttcagttgacagggaacagtccaa

SEQ ID NO: 989881 - DNA, 25 bp, Mus musculus
tttcataaatgatgaatgtcgcact

SEQ ID NO: 989882 - DNA, 25 bp, Mus musculus
tttcataaatgatgtatgtcgcact

SEQ ID NO: 989883 - DNA, 25 bp, Mus musculus
tttcataatgaatggtagccgaaga

SEQ ID NO: 989884 - DNA, 25 bp, Mus musculus
tttcataatgtatggtagccgaaga

SEQ ID NO: 989885 - DNA, 25 bp, Mus musculus
tttcatacagataaaaattattctc

SEQ ID NO: 989886 - DNA, 25 bp, Mus musculus
tttcatacagttaaaaattattctc

SEQ ID NO: 989887 - DNA, 25 bp, Mus musculus
tttcatagttgaagttatcaatgtg

SEQ ID NO: 989888 - DNA, 25 bp, Mus musculus
tttcatagttgatgttatcaatgtg

SEQ ID NO: 989889 - DNA, 25 bp, Mus musculus
tttcatcaactaacatgcttcggat

SEQ ID NO: 989890 - DNA, 25 bp, Mus musculus
tttcatcaactatcatgcttcggat

SEQ ID NO: 989891 - DNA, 25 bp, Mus musculus
tttcatcaagcgtgacacttccgga

SEQ ID NO: 989892 - DNA, 25 bp, Mus musculus
tttcatcaagggtgacacttccgga

SEQ ID NO: 989893 - DNA, 25 bp, Mus musculus
tttcatcagccacgagccagtcctg

SEQ ID NO: 989894 - DNA, 25 bp, Mus musculus
tttcatcagccaggagccagtcctg

SEQ ID NO: 989895 - DNA, 25 bp, Mus musculus
tttcatccttcagaagtacatgatg

SEQ ID NO: 989896 - DNA, 25 bp, Mus musculus
tttcatccttcagatgtacatgatg

SEQ ID NO: 989897 - DNA, 25 bp, Mus musculus
tttcatgctcatgacggattcatga

SEQ ID NO: 989898 - DNA, 25 bp, Mus musculus
tttcatgctcatgagggattcatga

SEQ ID NO: 989899 - DNA, 25 bp, Mus musculus
tttcatggagaatcaaaagcctacc

SEQ ID NO: 989900 - DNA, 25 bp, Mus musculus
tttcatggagagacgtgacactcac

SEQ ID NO: 989901 - DNA, 25 bp, Mus musculus
tttcatggagagcgaggggcggaag

SEQ ID NO: 989902 - DNA, 25 bp, Mus musculus
tttcatggagagggaggggcggaag

SEQ ID NO: 989903 - DNA, 25 bp, Mus musculus
tttcatggagagtcgtgacactcac

SEQ ID NO: 989904 - DNA, 25 bp, Mus musculus
tttcatggagtatcaaaagcctacc

SEQ ID NO: 989905 - DNA, 25 bp, Mus musculus
tttcattacaaccacagggcatgaa

SEQ ID NO: 989906 - DNA, 25 bp, Mus musculus
tttcattacaaccacagttttcctc

SEQ ID NO: 989907 - DNA, 25 bp, Mus musculus
tttcattacaaccagagggcatgaa

SEQ ID NO: 989908 - DNA, 25 bp, Mus musculus
tttcattacaaccagagttttcctc

SEQ ID NO: 989909 - DNA, 25 bp, Mus musculus
tttccaaaagcaactgctttgctct

SEQ ID NO: 989910 - DNA, 25 bp, Mus musculus
tttccaaaagctcctgggacctgag

SEQ ID NO: 989911 - DNA, 25 bp, Mus musculus
tttccaaaaggaactgctttgctct

SEQ ID NO: 989912 - DNA, 25 bp, Mus musculus
tttccaaaaggtcctgggacctgag

SEQ ID NO: 989913 - DNA, 25 bp, Mus musculus
tttccaacaacatcaaagaaaaatt

SEQ ID NO: 989914 - DNA, 25 bp, Mus musculus
tttccaacaacatctaagaaaaatt

SEQ ID NO: 989915 - DNA, 25 bp, Mus musculus
tttccaacccaacctcttttgtgac

SEQ ID NO: 989916 - DNA, 25 bp, Mus musculus
tttccaacccaagctcttttgtgac

SEQ ID NO: 989917 - DNA, 25 bp, Mus musculus
tttccaagcaatctggtacacggat

SEQ ID NO: 989918 - DNA, 25 bp, Mus musculus
tttccaagcaatgtggtacacggat

SEQ ID NO: 989919 - DNA, 25 bp, Mus musculus
tttccaatctgtcttgtcaaaacgc

SEQ ID NO: 989920 - DNA, 25 bp, Mus musculus
tttccaatctgtgttgtcaaaacgc

SEQ ID NO: 989921 - DNA, 25 bp, Mus musculus
tttccacagaccgtgtaccagatgt

SEQ ID NO: 989922 - DNA, 25 bp, Mus musculus
tttccacagagcgtgtaccagatgt

SEQ ID NO: 989923 - DNA, 25 bp, Mus musculus
tttccacagggacactccaccacat

SEQ ID NO: 989924 - DNA, 25 bp, Mus musculus
tttccacagggagactccaccacat

SEQ ID NO: 989925 - DNA, 25 bp, Mus musculus
tttccaccagactcctaggctccat

SEQ ID NO: 989926 - DNA, 25 bp, Mus musculus
tttccaccagtctcctaggctccat

SEQ ID NO: 989927 - DNA, 25 bp, Mus musculus
tttccagaagcacgtgtccccagaa

SEQ ID NO: 989928 - DNA, 25 bp, Mus musculus
tttccagaagcaggtgtccccagaa

SEQ ID NO: 989929 - DNA, 25 bp, Mus musculus
tttccagaagcgaagcaaaagtgca

SEQ ID NO: 989930 - DNA, 25 bp, Mus musculus
tttccagaagggaagcaaaagtgca

SEQ ID NO: 989931 - DNA, 25 bp, Mus musculus
tttccagaggcgcccagcaggtggc

SEQ ID NO: 989932 - DNA, 25 bp, Mus musculus
tttccagaggcggccagcaggtggc

SEQ ID NO: 989933 - DNA, 25 bp, Mus musculus
tttccagagtatatcgagctgtgtg

SEQ ID NO: 989934 - DNA, 25 bp, Mus musculus
tttccagagtatatggagctgtgtg

SEQ ID NO: 989935 - DNA, 25 bp, Mus musculus
tttccagatcaacgaggtagatatg

SEQ ID NO: 989936 - DNA, 25 bp, Mus musculus
tttccagatcaaggaggtagatatg

SEQ ID NO: 989937 - DNA, 25 bp, Mus musculus
tttccagcaacatgtgagcttatgg

SEQ ID NO: 989938 - DNA, 25 bp, Mus musculus
tttccagcaagatgtgagcttatgg

SEQ ID NO: 989939 - DNA, 25 bp, Mus musculus
tttccagcctgaaaagttcctagac

SEQ ID NO: 989940 - DNA, 25 bp, Mus musculus
tttccagcctgaaatgttcctagac

SEQ ID NO: 989941 - DNA, 25 bp, Mus musculus
tttccaggcacgctcatggcagata

SEQ ID NO: 989942 - DNA, 25 bp, Mus musculus
tttccaggcaggctcatggcagata

SEQ ID NO: 989943 - DNA, 25 bp, Mus musculus
tttccagtctggccagcatgtgatg

SEQ ID NO: 989944 - DNA, 25 bp, Mus musculus
tttccagtctggcctgcatgtgatg

SEQ ID NO: 989945 - DNA, 25 bp, Mus musculus
tttccagtgaagcaattgacttgat

SEQ ID NO: 989946 - DNA, 25 bp, Mus musculus
tttccagtgaaggaattgacttgat

SEQ ID NO: 989947 - DNA, 25 bp, Mus musculus
tttcccacagacctggatttggatt

SEQ ID NO: 989948 - DNA, 25 bp, Mus musculus
tttcccacagccctatatgaacttc

SEQ ID NO: 989949 - DNA, 25 bp, Mus musculus
tttcccacaggcctatatgaacttc

SEQ ID NO: 989950 - DNA, 25 bp, Mus musculus
tttcccacagtcctggatttggatt

SEQ ID NO: 989951 - DNA, 25 bp, Mus musculus
tttcccactgagcccaatgtgcttt

SEQ ID NO: 989952 - DNA, 25 bp, Mus musculus
tttcccactgaggccaatgtgcttt

SEQ ID NO: 989953 - DNA, 25 bp, Mus musculus
tttcccagaaggcgtgtgctgaaat

SEQ ID NO: 989954 - DNA, 25 bp, Mus musculus
tttcccagaaggggtgtgctgaaat

SEQ ID NO: 989955 - DNA, 25 bp, Mus musculus
tttcccaggacgatagccagccctg

SEQ ID NO: 989956 - DNA, 25 bp, Mus musculus
tttcccaggacgcctactggcagga

SEQ ID NO: 989957 - DNA, 25 bp, Mus musculus
tttcccaggacggctactggcagga

SEQ ID NO: 989958 - DNA, 25 bp, Mus musculus
tttcccaggacgttagccagccctg

SEQ ID NO: 989959 - DNA, 25 bp, Mus musculus
tttcccatccagctggtgaagacac

SEQ ID NO: 989960 - DNA, 25 bp, Mus musculus
tttcccatccaggtggtgaagacac

SEQ ID NO: 989961 - DNA, 25 bp, Mus musculus
tttccccaagaaaggggatcctggt

SEQ ID NO: 989962 - DNA, 25 bp, Mus musculus
tttccccaagaatggggatcctggt

SEQ ID NO: 989963 - DNA, 25 bp, Mus musculus
tttccccatacactcaggtccaaga

SEQ ID NO: 989964 - DNA, 25 bp, Mus musculus
tttccccatacactgaggtccaaga

SEQ ID NO: 989965 - DNA, 25 bp, Mus musculus
tttcccctgaagcattgaaaaaggc

SEQ ID NO: 989966 - DNA, 25 bp, Mus musculus
tttcccctgaagccaatcatctggg

SEQ ID NO: 989967 - DNA, 25 bp, Mus musculus
tttcccctgaaggattgaaaaaggc

SEQ ID NO: 989968 - DNA, 25 bp, Mus musculus
tttcccctgaaggcaatcatctggg

SEQ ID NO: 989969 - DNA, 25 bp, Mus musculus
tttcccgcggccaaggcacgagtgg

SEQ ID NO: 989970 - DNA, 25 bp, Mus musculus
tttcccgcggctgtcctggctgtat

SEQ ID NO: 989971 - DNA, 25 bp, Mus musculus
tttcccgcgggcaaggcacgagtgg

SEQ ID NO: 989972 - DNA, 25 bp, Mus musculus
tttcccgcgggtgtcctggctgtat

SEQ ID NO: 989973 - DNA, 25 bp, Mus musculus
tttcccggaaggatattgaccagtg

SEQ ID NO: 989974 - DNA, 25 bp, Mus musculus
tttcccggaaggttattgaccagtg

SEQ ID NO: 989975 - DNA, 25 bp, Mus musculus
tttccctcagcaaccatcacttcta

SEQ ID NO: 989976 - DNA, 25 bp, Mus musculus
tttccctcagcatccatcacttcta

SEQ ID NO: 989977 - DNA, 25 bp, Mus musculus
tttccctggacacgtattacgccat

SEQ ID NO: 989978 - DNA, 25 bp, Mus musculus
tttccctggacaggtattacgccat

SEQ ID NO: 989979 - DNA, 25 bp, Mus musculus
tttccctgttaacaatgtgattgat

SEQ ID NO: 989980 - DNA, 25 bp, Mus musculus
tttccctgttaagaatgtgattgat

SEQ ID NO: 989981 - DNA, 25 bp, Mus musculus
tttccgaaatgacctggaattttgg

SEQ ID NO: 989982 - DNA, 25 bp, Mus musculus
tttccgaaatgagctggaattttgg

SEQ ID NO: 989983 - DNA, 25 bp, Mus musculus
tttccgactgctgaccaaccgcggg

SEQ ID NO: 989984 - DNA, 25 bp, Mus musculus
tttccgactggtgaccaaccgcggg

SEQ ID NO: 989985 - DNA, 25 bp, Mus musculus
tttccgatgacttcctggtacagtt

SEQ ID NO: 989986 - DNA, 25 bp, Mus musculus
tttccgatgagttcctggtacagtt

SEQ ID NO: 989987 - DNA, 25 bp, Mus musculus
tttccgcaagcccctttatgggact

SEQ ID NO: 989988 - DNA, 25 bp, Mus musculus
tttccgcaaggccctttatgggact

SEQ ID NO: 989989 - DNA, 25 bp, Mus musculus
tttccgctgacaaaattgaagatgc

SEQ ID NO: 989990 - DNA, 25 bp, Mus musculus
tttccgctgacataattgaagatgc

SEQ ID NO: 989991 - DNA, 25 bp, Mus musculus
tttccgtcctacaaacctcatccag

SEQ ID NO: 989992 - DNA, 25 bp, Mus musculus
tttccgtcctactaacctcatccag

SEQ ID NO: 989993 - DNA, 25 bp, Mus musculus
tttcctaacgctgctgcattttttc

SEQ ID NO: 989994 - DNA, 25 bp, Mus musculus
tttcctaacggtgctgcattttttc

SEQ ID NO: 989995 - DNA, 25 bp, Mus musculus
tttcctacattacctttgctttggt

SEQ ID NO: 989996 - DNA, 25 bp, Mus musculus
tttcctacattagctttgctttggt

SEQ ID NO: 989997 - DNA, 25 bp, Mus musculus
tttcctacctcatgcgggtatcagt

SEQ ID NO: 989998 - DNA, 25 bp, Mus musculus
tttcctacctcatgggggtatcagt

SEQ ID NO: 989999 - DNA, 25 bp, Mus musculus
tttcctccaacaaatgcagaacccc

SEQ ID NO: 990000 - DNA, 25 bp, Mus musculus
tttcctccaacatatgcagaacccc

SEQ ID NO: 990001 - DNA, 25 bp, Mus musculus
tttcctccagattgttggtgtctgc

SEQ ID NO: 990002 - DNA, 25 bp, Mus musculus
tttcctccagtttgttggtgtctgc

SEQ ID NO: 990003 - DNA, 25 bp, Mus musculus
tttcctcctacaacacggtagagga

SEQ ID NO: 990004 - DNA, 25 bp, Mus musculus
tttcctcctacaatgagcagacacg

SEQ ID NO: 990005 - DNA, 25 bp, Mus musculus
tttcctcctacatcacggtagagga

SEQ ID NO: 990006 - DNA, 25 bp, Mus musculus
tttcctcctacattgagcagacacg

SEQ ID NO: 990007 - DNA, 25 bp, Mus musculus
tttcctcctgaccacctcaccagct

SEQ ID NO: 990008 - DNA, 25 bp, Mus musculus
tttcctcctgaccagctcaccagct

SEQ ID NO: 990009 - DNA, 25 bp, Mus musculus
tttcctgaagatgatccatgccaaa

SEQ ID NO: 990010 - DNA, 25 bp, Mus musculus
tttcctgaagttgatccatgccaaa

SEQ ID NO: 990011 - DNA, 25 bp, Mus musculus
tttcctgactgacgtgaaagtgatg

SEQ ID NO: 990012 - DNA, 25 bp, Mus musculus
tttcctgactgaggtgaaagtgatg

SEQ ID NO: 990013 - DNA, 25 bp, Mus musculus
tttcctggaacacgtgacatgtatg

SEQ ID NO: 990014 - DNA, 25 bp, Mus musculus
tttcctggaacaggtgacatgtatg

SEQ ID NO: 990015 - DNA, 25 bp, Mus musculus
tttcctggcacacaaacatcatcca

SEQ ID NO: 990016 - DNA, 25 bp, Mus musculus
tttcctggcacaccaagcttccctg

SEQ ID NO: 990017 - DNA, 25 bp, Mus musculus
tttcctggcacagaaacatcatcca

SEQ ID NO: 990018 - DNA, 25 bp, Mus musculus
tttcctggcacagcaagcttccctg

SEQ ID NO: 990019 - DNA, 25 bp, Mus musculus
tttcctggggacccagtcctccatc

SEQ ID NO: 990020 - DNA, 25 bp, Mus musculus
tttcctggggaccctgtcctccatc

SEQ ID NO: 990021 - DNA, 25 bp, Mus musculus
tttccttaacctcggatcgcttaca

SEQ ID NO: 990022 - DNA, 25 bp, Mus musculus
tttccttaacctgggatcgcttaca

SEQ ID NO: 990023 - DNA, 25 bp, Mus musculus
tttccttattcacgggatgtttgtg

SEQ ID NO: 990024 - DNA, 25 bp, Mus musculus
tttccttattcaggggatgtttgtg

SEQ ID NO: 990025 - DNA, 25 bp, Mus musculus
tttccttcaacacatccagtctgac

SEQ ID NO: 990026 - DNA, 25 bp, Mus musculus
tttccttcaacagatccagtctgac

SEQ ID NO: 990027 - DNA, 25 bp, Mus musculus
tttccttccactaacgttcatgtct

SEQ ID NO: 990028 - DNA, 25 bp, Mus musculus
tttccttccagtaacgttcatgtct

SEQ ID NO: 990029 - DNA, 25 bp, Mus musculus
tttccttgataactattctctgaaa

SEQ ID NO: 990030 - DNA, 25 bp, Mus musculus
tttccttgataagtattctctgaaa

SEQ ID NO: 990031 - DNA, 25 bp, Mus musculus
tttccttgtggacgtcttccaagtt

SEQ ID NO: 990032 - DNA, 25 bp, Mus musculus
tttccttgtggaggtcttccaagtt

SEQ ID NO: 990033 - DNA, 25 bp, Mus musculus
tttcctttgactctggcagccacag

SEQ ID NO: 990034 - DNA, 25 bp, Mus musculus
tttcctttgactgtggcagccacag

SEQ ID NO: 990035 - DNA, 25 bp, Mus musculus
tttcctttgagtccatcagcagtgt

SEQ ID NO: 990036 - DNA, 25 bp, Mus musculus
tttcctttgagtgcatcagcagtgt

SEQ ID NO: 990037 - DNA, 25 bp, Mus musculus
tttcgaacatagcactgttgagctg

SEQ ID NO: 990038 - DNA, 25 bp, Mus musculus
tttcgaacatagcagtgttgagctg

SEQ ID NO: 990039 - DNA, 25 bp, Mus musculus
tttcgacccgaggactatctccagt

SEQ ID NO: 990040 - DNA, 25 bp, Mus musculus
tttcgacccgtggactatctccagt

SEQ ID NO: 990041 - DNA, 25 bp, Mus musculus
tttcgacctcacaacgtgactggac

SEQ ID NO: 990042 - DNA, 25 bp, Mus musculus
tttcgacctcacaactgcacgatct

SEQ ID NO: 990043 - DNA, 25 bp, Mus musculus
tttcgacctcacaaggtgactggac

SEQ ID NO: 990044 - DNA, 25 bp, Mus musculus
tttcgacctcacaagtgcacgatct

SEQ ID NO: 990045 - DNA, 25 bp, Mus musculus
tttcgatgagatggcggatccagac

SEQ ID NO: 990046 - DNA, 25 bp, Mus musculus
tttcgatgagcctgaattgcatcat

SEQ ID NO: 990047 - DNA, 25 bp, Mus musculus
tttcgatgaggctgaattgcatcat

SEQ ID NO: 990048 - DNA, 25 bp, Mus musculus
tttcgatgagttggcggatccagac

SEQ ID NO: 990049 - DNA, 25 bp, Mus musculus
tttcgatgtgaacagttgttggatg

SEQ ID NO: 990050 - DNA, 25 bp, Mus musculus
tttcgatgtgaagagttgttggatg

SEQ ID NO: 990051 - DNA, 25 bp, Mus musculus
tttcgccatccacatagtgatcgtg

SEQ ID NO: 990052 - DNA, 25 bp, Mus musculus
tttcgccatccagatagtgatcgtg

SEQ ID NO: 990053 - DNA, 25 bp, Mus musculus
tttcgccgccatggagtcctccacc

SEQ ID NO: 990054 - DNA, 25 bp, Mus musculus
tttcgccgccatggtgtcctccacc

SEQ ID NO: 990055 - DNA, 25 bp, Mus musculus
tttcggaaggagctcactggccaat

SEQ ID NO: 990056 - DNA, 25 bp, Mus musculus
tttcggaaggagctgactggccaat

SEQ ID NO: 990057 - DNA, 25 bp, Mus musculus
tttcggcaagcatgagccccaagaa

SEQ ID NO: 990058 - DNA, 25 bp, Mus musculus
tttcggcaagcgcgtctactgggct

SEQ ID NO: 990059 - DNA, 25 bp, Mus musculus
tttcggcaaggatgagccccaagaa

SEQ ID NO: 990060 - DNA, 25 bp, Mus musculus
tttcggcaagggcgtctactgggct

SEQ ID NO: 990061 - DNA, 25 bp, Mus musculus
tttcgggagcagaacttccgcctga

SEQ ID NO: 990062 - DNA, 25 bp, Mus musculus
tttcgggagcagaagttccgcctga

SEQ ID NO: 990063 - DNA, 25 bp, Mus musculus
tttcgtatacaacttccctctagga

SEQ ID NO: 990064 - DNA, 25 bp, Mus musculus
tttcgtatacaagttccctctagga

SEQ ID NO: 990065 - DNA, 25 bp, Mus musculus
tttcgtcatgagatcaaggacacct

SEQ ID NO: 990066 - DNA, 25 bp, Mus musculus
tttcgtcatgagttcaaggacacct

SEQ ID NO: 990067 - DNA, 25 bp, Mus musculus
tttcgtctatctcaccggccctgga

SEQ ID NO: 990068 - DNA, 25 bp, Mus musculus
tttcgtctatctcagcggccctgga

SEQ ID NO: 990069 - DNA, 25 bp, Mus musculus
tttcgtcttctgcctggctggaggc

SEQ ID NO: 990070 - DNA, 25 bp, Mus musculus
tttcgtcttctggctggctggaggc

SEQ ID NO: 990071 - DNA, 25 bp, Mus musculus
tttctaactgcccacctttgacaca

SEQ ID NO: 990072 - DNA, 25 bp, Mus musculus
tttctaactggccacctttgacaca

SEQ ID NO: 990073 - DNA, 25 bp, Mus musculus
tttctaaggattcacgctaaaaccg

SEQ ID NO: 990074 - DNA, 25 bp, Mus musculus
tttctaaggattcaggctaaaaccg

SEQ ID NO: 990075 - DNA, 25 bp, Mus musculus
tttctacaagcctcctgagccgatt

SEQ ID NO: 990076 - DNA, 25 bp, Mus musculus
tttctacaagcgatttatcaaagat

SEQ ID NO: 990077 - DNA, 25 bp, Mus musculus
tttctacaaggctcctgagccgatt

SEQ ID NO: 990078 - DNA, 25 bp, Mus musculus
tttctacaagggatttatcaaagat

SEQ ID NO: 990079 - DNA, 25 bp, Mus musculus
tttctactagccttttgggctctat

SEQ ID NO: 990080 - DNA, 25 bp, Mus musculus
tttctactaggcttttgggctctat

SEQ ID NO: 990081 - DNA, 25 bp, Mus musculus
tttctactccggccatggtgcgagc

SEQ ID NO: 990082 - DNA, 25 bp, Mus musculus
tttctactccgggcatggtgcgagc

SEQ ID NO: 990083 - DNA, 25 bp, Mus musculus
tttctatgtgcacgctgatagccct

SEQ ID NO: 990084 - DNA, 25 bp, Mus musculus
tttctatgtgcaggctgatagccct

SEQ ID NO: 990085 - DNA, 25 bp, Mus musculus
tttctattctggagaaagaacggtg

SEQ ID NO: 990086 - DNA, 25 bp, Mus musculus
tttctattctggtgaaagaacggtg

SEQ ID NO: 990087 - DNA, 25 bp, Mus musculus
tttctcaaagctgtgtgtgctgcca

SEQ ID NO: 990088 - DNA, 25 bp, Mus musculus
tttctcaaaggtgtgtgtgctgcca

SEQ ID NO: 990089 - DNA, 25 bp, Mus musculus
tttctcaatgagctcatcctgttcc

SEQ ID NO: 990090 - DNA, 25 bp, Mus musculus
tttctcaatgtgctcatcctgttcc

SEQ ID NO: 990091 - DNA, 25 bp, Mus musculus
tttctcatatctcggaactctcaga

SEQ ID NO: 990092 - DNA, 25 bp, Mus musculus
tttctcatatctgggaactctcaga

SEQ ID NO: 990093 - DNA, 25 bp, Mus musculus
tttctcatcacgcgccgcctaagga

SEQ ID NO: 990094 - DNA, 25 bp, Mus musculus
tttctcatcacgggccgcctaagga

SEQ ID NO: 990095 - DNA, 25 bp, Mus musculus
tttctcattaagctaaatgaccgtc

SEQ ID NO: 990096 - DNA, 25 bp, Mus musculus
tttctcattaaggtaaatgaccgtc

SEQ ID NO: 990097 - DNA, 25 bp, Mus musculus
tttctccaagcaggatgaagccttc

SEQ ID NO: 990098 - DNA, 25 bp, Mus musculus
tttctccaaggaggatgaagccttc

SEQ ID NO: 990099 - DNA, 25 bp, Mus musculus
tttctccaccagcacatggatttga

SEQ ID NO: 990100 - DNA, 25 bp, Mus musculus
tttctccaccaggacatggatttga

SEQ ID NO: 990101 - DNA, 25 bp, Mus musculus
tttctccagaagaggaggaggtgga

SEQ ID NO: 990102 - DNA, 25 bp, Mus musculus
tttctccagaagtggaggaggtgga

SEQ ID NO: 990103 - DNA, 25 bp, Mus musculus
tttctccagacctgcctgcccagac

SEQ ID NO: 990104 - DNA, 25 bp, Mus musculus
tttctccagacctggctgcccagac

SEQ ID NO: 990105 - DNA, 25 bp, Mus musculus
tttctccaggcttcagataaaccag

SEQ ID NO: 990106 - DNA, 25 bp, Mus musculus
tttctccagggttcagataaaccag

SEQ ID NO: 990107 - DNA, 25 bp, Mus musculus
tttctcccagctgctcaccattgct

SEQ ID NO: 990108 - DNA, 25 bp, Mus musculus
tttctcccaggtgctcaccattgct

SEQ ID NO: 990109 - DNA, 25 bp, Mus musculus
tttctcgcagagtgttcctgacttc

SEQ ID NO: 990110 - DNA, 25 bp, Mus musculus
tttctcgcagatatattaccaaaga

SEQ ID NO: 990111 - DNA, 25 bp, Mus musculus
tttctcgcagtgtgttcctgacttc

SEQ ID NO: 990112 - DNA, 25 bp, Mus musculus
tttctcgcagttatattaccaaaga

SEQ ID NO: 990113 - DNA, 25 bp, Mus musculus
tttctctacacacgaaatccacctt

SEQ ID NO: 990114 - DNA, 25 bp, Mus musculus
tttctctacacacgctgacaagaaa

SEQ ID NO: 990115 - DNA, 25 bp, Mus musculus
tttctctacacaggaaatccacctt

SEQ ID NO: 990116 - DNA, 25 bp, Mus musculus
tttctctacacaggctgacaagaaa

SEQ ID NO: 990117 - DNA, 25 bp, Mus musculus
tttctctaccagctctgtcacctaa

SEQ ID NO: 990118 - DNA, 25 bp, Mus musculus
tttctctaccaggtctgtcacctaa

SEQ ID NO: 990119 - DNA, 25 bp, Mus musculus
tttctctcagcacattccaaaggct

SEQ ID NO: 990120 - DNA, 25 bp, Mus musculus
tttctctcagcacgccttgagcctc

SEQ ID NO: 990121 - DNA, 25 bp, Mus musculus
tttctctcagcagattccaaaggct

SEQ ID NO: 990122 - DNA, 25 bp, Mus musculus
tttctctcagcaggccttgagcctc

SEQ ID NO: 990123 - DNA, 25 bp, Mus musculus
tttctctcagccaaagccttctact

SEQ ID NO: 990124 - DNA, 25 bp, Mus musculus
tttctctcaggcaaagccttctact

SEQ ID NO: 990125 - DNA, 25 bp, Mus musculus
tttctctctcagcacgccgctttgt

SEQ ID NO: 990126 - DNA, 25 bp, Mus musculus
tttctctctcagcaggccgctttgt

SEQ ID NO: 990127 - DNA, 25 bp, Mus musculus
tttctctgagctcctggcctacttc

SEQ ID NO: 990128 - DNA, 25 bp, Mus musculus
tttctctgaggtcctggcctacttc

SEQ ID NO: 990129 - DNA, 25 bp, Mus musculus
tttctctgcgccaggtatcagagca

SEQ ID NO: 990130 - DNA, 25 bp, Mus musculus
tttctctgcgcctggtatcagagca

SEQ ID NO: 990131 - DNA, 25 bp, Mus musculus
tttctctgggaatgtgattttcctg

SEQ ID NO: 990132 - DNA, 25 bp, Mus musculus
tttctctgggtatgtgattttcctg

SEQ ID NO: 990133 - DNA, 25 bp, Mus musculus
tttctctgtcaaaggtggaaagatc

SEQ ID NO: 990134 - DNA, 25 bp, Mus musculus
tttctctgtcaatggtggaaagatc

SEQ ID NO: 990135 - DNA, 25 bp, Mus musculus
tttctgaaagcgtgaaggctgcaca

SEQ ID NO: 990136 - DNA, 25 bp, Mus musculus
tttctgaaagggtgaaggctgcaca

SEQ ID NO: 990137 - DNA, 25 bp, Mus musculus
tttctgaagactcctcacgaggcat

SEQ ID NO: 990138 - DNA, 25 bp, Mus musculus
tttctgaagagtcctcacgaggcat

SEQ ID NO: 990139 - DNA, 25 bp, Mus musculus
tttctgaaggcgcttgtcaatgagg

SEQ ID NO: 990140 - DNA, 25 bp, Mus musculus
tttctgaaggggcttgtcaatgagg

SEQ ID NO: 990141 - DNA, 25 bp, Mus musculus
tttctgaatcaccgagtcaaagtgg

SEQ ID NO: 990142 - DNA, 25 bp, Mus musculus
tttctgaatcacctgtcgagtgtcc

SEQ ID NO: 990143 - DNA, 25 bp, Mus musculus
tttctgaatcacggagtcaaagtgg

SEQ ID NO: 990144 - DNA, 25 bp, Mus musculus
tttctgaatcacgtgtcgagtgtcc

SEQ ID NO: 990145 - DNA, 25 bp, Mus musculus
tttctgagagaaactgcaagaaaaa

SEQ ID NO: 990146 - DNA, 25 bp, Mus musculus
tttctgagagaatctgcaagaaaaa

SEQ ID NO: 990147 - DNA, 25 bp, Mus musculus
tttctgagatactactgaaggttaa

SEQ ID NO: 990148 - DNA, 25 bp, Mus musculus
tttctgagatactagtgaaggttaa

SEQ ID NO: 990149 - DNA, 25 bp, Mus musculus
tttctgatcaatcgtcctgaaatca

SEQ ID NO: 990150 - DNA, 25 bp, Mus musculus
tttctgatcaatggtcctgaaatca

SEQ ID NO: 990151 - DNA, 25 bp, Mus musculus
tttctgcaagactacagagcgggat

SEQ ID NO: 990152 - DNA, 25 bp, Mus musculus
tttctgcaagccgcctgtgtcatgg

SEQ ID NO: 990153 - DNA, 25 bp, Mus musculus
tttctgcaaggcgcctgtgtcatgg

SEQ ID NO: 990154 - DNA, 25 bp, Mus musculus
tttctgcaagtctacagagcgggat

SEQ ID NO: 990155 - DNA, 25 bp, Mus musculus
tttctgcacaagactccagtggaag

SEQ ID NO: 990156 - DNA, 25 bp, Mus musculus
tttctgcacaagtctccagtggaag

SEQ ID NO: 990157 - DNA, 25 bp, Mus musculus
tttctgcagacttgtactggtttcc

SEQ ID NO: 990158 - DNA, 25 bp, Mus musculus
tttctgcagagacaatagtgtgaac

SEQ ID NO: 990159 - DNA, 25 bp, Mus musculus
tttctgcagagagaatagtgtgaac

SEQ ID NO: 990160 - DNA, 25 bp, Mus musculus
tttctgcagagttgtactggtttcc

SEQ ID NO: 990161 - DNA, 25 bp, Mus musculus
tttctgccagagatttgagcaatgg

SEQ ID NO: 990162 - DNA, 25 bp, Mus musculus
tttctgccagattcaagaacctggc

SEQ ID NO: 990163 - DNA, 25 bp, Mus musculus
tttctgccagtgatttgagcaatgg

SEQ ID NO: 990164 - DNA, 25 bp, Mus musculus
tttctgccagtttcaagaacctggc

SEQ ID NO: 990165 - DNA, 25 bp, Mus musculus
tttctgcgggcacgtggtgctgatc

SEQ ID NO: 990166 - DNA, 25 bp, Mus musculus
tttctgcgggcaggtggtgctgatc

SEQ ID NO: 990167 - DNA, 25 bp, Mus musculus
tttctgctccagcaaggtgcagagc

SEQ ID NO: 990168 - DNA, 25 bp, Mus musculus
tttctgctccaggaaggtgcagagc

SEQ ID NO: 990169 - DNA, 25 bp, Mus musculus
tttctgctgtatatcccacaggttt

SEQ ID NO: 990170 - DNA, 25 bp, Mus musculus
tttctgctgtatatctcacagatct

SEQ ID NO: 990171 - DNA, 25 bp, Mus musculus
tttctgctgtatttcccacaggttt

SEQ ID NO: 990172 - DNA, 25 bp, Mus musculus
tttctgctgtatttctcacagatct

SEQ ID NO: 990173 - DNA, 25 bp, Mus musculus
tttctgcttgatctcctagaagacc

SEQ ID NO: 990174 - DNA, 25 bp, Mus musculus
tttctgcttgatgtcctagaagacc

SEQ ID NO: 990175 - DNA, 25 bp, Mus musculus
tttctggaaagtgacttacatgaac

SEQ ID NO: 990176 - DNA, 25 bp, Mus musculus
tttctggaaagtgagttacatgaac

SEQ ID NO: 990177 - DNA, 25 bp, Mus musculus
tttctggaattacacggatcgctta

SEQ ID NO: 990178 - DNA, 25 bp, Mus musculus
tttctggaattacagggatcgctta

SEQ ID NO: 990179 - DNA, 25 bp, Mus musculus
tttctggacctgcctgcaggtcctg

SEQ ID NO: 990180 - DNA, 25 bp, Mus musculus
tttctggacctggctgcaggtcctg

SEQ ID NO: 990181 - DNA, 25 bp, Mus musculus
tttctggactctcacaacctcagtg

SEQ ID NO: 990182 - DNA, 25 bp, Mus musculus
tttctggactctcagaacctcagtg

SEQ ID NO: 990183 - DNA, 25 bp, Mus musculus
tttctggataagagtgcctcgggcc

SEQ ID NO: 990184 - DNA, 25 bp, Mus musculus
tttctggataagcccacctggaagc

SEQ ID NO: 990185 - DNA, 25 bp, Mus musculus
tttctggataagctgcttctgtgtg

SEQ ID NO: 990186 - DNA, 25 bp, Mus musculus
tttctggataaggccacctggaagc

SEQ ID NO: 990187 - DNA, 25 bp, Mus musculus
tttctggataaggtgcttctgtgtg

SEQ ID NO: 990188 - DNA, 25 bp, Mus musculus
tttctggataagtgtgcctcgggcc

SEQ ID NO: 990189 - DNA, 25 bp, Mus musculus
tttctggtacagcaccctgacgagt

SEQ ID NO: 990190 - DNA, 25 bp, Mus musculus
tttctggtacaggaccctgacgagt

SEQ ID NO: 990191 - DNA, 25 bp, Mus musculus
tttctggtgaagattatgggacagt

SEQ ID NO: 990192 - DNA, 25 bp, Mus musculus
tttctggtgaagtttatgggacagt

SEQ ID NO: 990193 - DNA, 25 bp, Mus musculus
tttctgtccgagctcgctcatccga

SEQ ID NO: 990194 - DNA, 25 bp, Mus musculus
tttctgtccgaggtcgctcatccga

SEQ ID NO: 990195 - DNA, 25 bp, Mus musculus
tttctgttcctacgagccgttcagt

SEQ ID NO: 990196 - DNA, 25 bp, Mus musculus
tttctgttcctaggagccgttcagt

SEQ ID NO: 990197 - DNA, 25 bp, Mus musculus
tttcttaccaagcaatggagccaaa

SEQ ID NO: 990198 - DNA, 25 bp, Mus musculus
tttcttaccaaggaatggagccaaa

SEQ ID NO: 990199 - DNA, 25 bp, Mus musculus
tttcttcaaggacgcttggtactgg

SEQ ID NO: 990200 - DNA, 25 bp, Mus musculus
tttcttcaaggacggttggtactgg

SEQ ID NO: 990201 - DNA, 25 bp, Mus musculus
tttcttcacattatccatgccattg

SEQ ID NO: 990202 - DNA, 25 bp, Mus musculus
tttcttcacattttccatgccattg

SEQ ID NO: 990203 - DNA, 25 bp, Mus musculus
tttcttccacagagcctccggagcc

SEQ ID NO: 990204 - DNA, 25 bp, Mus musculus
tttcttccacagtgcctccggagcc

SEQ ID NO: 990205 - DNA, 25 bp, Mus musculus
tttcttcctgctctactcactggtg

SEQ ID NO: 990206 - DNA, 25 bp, Mus musculus
tttcttcctgggctgttgttcagcc

SEQ ID NO: 990207 - DNA, 25 bp, Mus musculus
tttcttcctggggtgttgttcagcc

SEQ ID NO: 990208 - DNA, 25 bp, Mus musculus
tttcttcctggtctactcactggtg

SEQ ID NO: 990209 - DNA, 25 bp, Mus musculus
tttcttgcaaagatcactggagatt

SEQ ID NO: 990210 - DNA, 25 bp, Mus musculus
tttcttgcaaagttcactggagatt

SEQ ID NO: 990211 - DNA, 25 bp, Mus musculus
tttcttgggagatgcgtatgctgcc

SEQ ID NO: 990212 - DNA, 25 bp, Mus musculus
tttcttgggagatgggtatgctgcc

SEQ ID NO: 990213 - DNA, 25 bp, Mus musculus
tttctttaaatgacaacaattgaca

SEQ ID NO: 990214 - DNA, 25 bp, Mus musculus
tttctttaaatgactacaattgaca

SEQ ID NO: 990215 - DNA, 25 bp, Mus musculus
tttctttactagcctgattgagtca

SEQ ID NO: 990216 - DNA, 25 bp, Mus musculus
tttctttactaggctgattgagtca

SEQ ID NO: 990217 - DNA, 25 bp, Mus musculus
tttctttagcacagggctaaagtat

SEQ ID NO: 990218 - DNA, 25 bp, Mus musculus
tttctttagcactgggctaaagtat

SEQ ID NO: 990219 - DNA, 25 bp, Mus musculus
tttctttatctacgagacgaccgaa

SEQ ID NO: 990220 - DNA, 25 bp, Mus musculus
tttctttatctaggagacgaccgaa

SEQ ID NO: 990221 - DNA, 25 bp, Mus musculus
tttctttcagcgcttcacatttggc

SEQ ID NO: 990222 - DNA, 25 bp, Mus musculus
tttctttcagggcttcacatttggc

SEQ ID NO: 990223 - DNA, 25 bp, Mus musculus
tttctttcatagatgaagcccgagg

SEQ ID NO: 990224 - DNA, 25 bp, Mus musculus
tttctttcatagttgaagcccgagg

SEQ ID NO: 990225 - DNA, 25 bp, Mus musculus
tttctttgtgagactcttcgtacca

SEQ ID NO: 990226 - DNA, 25 bp, Mus musculus
tttctttgtgagtctcttcgtacca

SEQ ID NO: 990227 - DNA, 25 bp, Mus musculus
tttgaaaaagaacacatttctcgaa

SEQ ID NO: 990228 - DNA, 25 bp, Mus musculus
tttgaaaaagaacagatttctcgaa

SEQ ID NO: 990229 - DNA, 25 bp, Mus musculus
tttgaaaaagagcccactaggtatg

SEQ ID NO: 990230 - DNA, 25 bp, Mus musculus
tttgaaaaagcagagcaacttctag

SEQ ID NO: 990231 - DNA, 25 bp, Mus musculus
tttgaaaaaggagagcaacttctag

SEQ ID NO: 990232 - DNA, 25 bp, Mus musculus
tttgaaaaagtgcccactaggtatg

SEQ ID NO: 990233 - DNA, 25 bp, Mus musculus
tttgaaaatgatgccagaatttcag

SEQ ID NO: 990234 - DNA, 25 bp, Mus musculus
tttgaaaatgttgccagaatttcag

SEQ ID NO: 990235 - DNA, 25 bp, Mus musculus
tttgaaaccaagccattctctgacg

SEQ ID NO: 990236 - DNA, 25 bp, Mus musculus
tttgaaaccaaggcattctctgacg

SEQ ID NO: 990237 - DNA, 25 bp, Mus musculus
tttgaaactaagcacaacaagccat

SEQ ID NO: 990238 - DNA, 25 bp, Mus musculus
tttgaaactaagcacgaagcagaac

SEQ ID NO: 990239 - DNA, 25 bp, Mus musculus
tttgaaactaagcagaacaagccat

SEQ ID NO: 990240 - DNA, 25 bp, Mus musculus
tttgaaactaagcaggaagcagaac

SEQ ID NO: 990241 - DNA, 25 bp, Mus musculus
tttgaaagggcccaagatctccatc

SEQ ID NO: 990242 - DNA, 25 bp, Mus musculus
tttgaaagggcccatgatctccatc

SEQ ID NO: 990243 - DNA, 25 bp, Mus musculus
tttgaaatatttgacgataacagct

SEQ ID NO: 990244 - DNA, 25 bp, Mus musculus
tttgaaatatttgaggataacagct

SEQ ID NO: 990245 - DNA, 25 bp, Mus musculus
tttgaacagaagattggacagccca

SEQ ID NO: 990246 - DNA, 25 bp, Mus musculus
tttgaacagaagtttggacagccca

SEQ ID NO: 990247 - DNA, 25 bp, Mus musculus
tttgaacctcctcactatccgtata

SEQ ID NO: 990248 - DNA, 25 bp, Mus musculus
tttgaacctcctcagtatccgtata

SEQ ID NO: 990249 - DNA, 25 bp, Mus musculus
tttgaactgaaacaggcaccgctcc

SEQ ID NO: 990250 - DNA, 25 bp, Mus musculus
tttgaactgaaaccaccgctcctct

SEQ ID NO: 990251 - DNA, 25 bp, Mus musculus
tttgaactgaaagaggcaccgctcc

SEQ ID NO: 990252 - DNA, 25 bp, Mus musculus
tttgaactgaaagcaccgctcctct

SEQ ID NO: 990253 - DNA, 25 bp, Mus musculus
tttgaagagcagatggcccagtgag

SEQ ID NO: 990254 - DNA, 25 bp, Mus musculus
tttgaagagcagcttgcttccataa

SEQ ID NO: 990255 - DNA, 25 bp, Mus musculus
tttgaagagcaggttgcttccataa

SEQ ID NO: 990256 - DNA, 25 bp, Mus musculus
tttgaagagcagttggcccagtgag

SEQ ID NO: 990257 - DNA, 25 bp, Mus musculus
tttgaagggttataccatgatgacc

SEQ ID NO: 990258 - DNA, 25 bp, Mus musculus
tttgaagggttatagcatgatgacc

SEQ ID NO: 990259 - DNA, 25 bp, Mus musculus
tttgaaggtcttgcatgtacctgtg

SEQ ID NO: 990260 - DNA, 25 bp, Mus musculus
tttgaaggtcttgcttgtacctgtg

SEQ ID NO: 990261 - DNA, 25 bp, Mus musculus
tttgaaggtgaattcttcaaagaac

SEQ ID NO: 990262 - DNA, 25 bp, Mus musculus
tttgaaggtgtattcttcaaagaac

SEQ ID NO: 990263 - DNA, 25 bp, Mus musculus
tttgaagttaaaaactggaatgcag

SEQ ID NO: 990264 - DNA, 25 bp, Mus musculus
tttgaagttaaaaagtggaatgcag

SEQ ID NO: 990265 - DNA, 25 bp, Mus musculus
tttgaatacaccaccgacaaagagc

SEQ ID NO: 990266 - DNA, 25 bp, Mus musculus
tttgaatacaccacggacaaagagc

SEQ ID NO: 990267 - DNA, 25 bp, Mus musculus
tttgaatacgtgcacactgatttat

SEQ ID NO: 990268 - DNA, 25 bp, Mus musculus
tttgaatacgtggacactgatttat

SEQ ID NO: 990269 - DNA, 25 bp, Mus musculus
tttgaatgagccaacgaccagagtg

SEQ ID NO: 990270 - DNA, 25 bp, Mus musculus
tttgaatgagccaaggaccagagtg

SEQ ID NO: 990271 - DNA, 25 bp, Mus musculus
tttgaatttcagcatgtttgatgtg

SEQ ID NO: 990272 - DNA, 25 bp, Mus musculus
tttgaatttcaggatgtttgatgtg

SEQ ID NO: 990273 - DNA, 25 bp, Mus musculus
tttgacaacatcagcgcctggctca

SEQ ID NO: 990274 - DNA, 25 bp, Mus musculus
tttgacaacatcagggcctggctca

SEQ ID NO: 990275 - DNA, 25 bp, Mus musculus
tttgacaattggctcattgaagaag

SEQ ID NO: 990276 - DNA, 25 bp, Mus musculus
tttgacaattgggtcattgaagaag

SEQ ID NO: 990277 - DNA, 25 bp, Mus musculus
tttgacacttaacggctacttgatt

SEQ ID NO: 990278 - DNA, 25 bp, Mus musculus
tttgacacttaagggctacttgatt

SEQ ID NO: 990279 - DNA, 25 bp, Mus musculus
tttgacagcaaacgctcccggattc

SEQ ID NO: 990280 - DNA, 25 bp, Mus musculus
tttgacagcaaaggctcccggattc

SEQ ID NO: 990281 - DNA, 25 bp, Mus musculus
tttgacaggattttcgccagccgta

SEQ ID NO: 990282 - DNA, 25 bp, Mus musculus
tttgacaggattttggccagccgta

SEQ ID NO: 990283 - DNA, 25 bp, Mus musculus
tttgacaggcacgacctgcaggtcc

SEQ ID NO: 990284 - DNA, 25 bp, Mus musculus
tttgacaggcacgagctgcaggtcc

SEQ ID NO: 990285 - DNA, 25 bp, Mus musculus
tttgacataaagcagattgaagtaa

SEQ ID NO: 990286 - DNA, 25 bp, Mus musculus
tttgacataaaggagattgaagtaa

SEQ ID NO: 990287 - DNA, 25 bp, Mus musculus
tttgacatcactgatgagagtagtg

SEQ ID NO: 990288 - DNA, 25 bp, Mus musculus
tttgacatcagtgatgagagtagtg

SEQ ID NO: 990289 - DNA, 25 bp, Mus musculus
tttgacatgaagccctttgaagatg

SEQ ID NO: 990290 - DNA, 25 bp, Mus musculus
tttgacatgacccagtggaggcact

SEQ ID NO: 990291 - DNA, 25 bp, Mus musculus
tttgacatgagccagtggaggcact

SEQ ID NO: 990292 - DNA, 25 bp, Mus musculus
tttgacatgatgccctttgaagatg

SEQ ID NO: 990293 - DNA, 25 bp, Mus musculus
tttgacatggcaacagaagttggtt

SEQ ID NO: 990294 - DNA, 25 bp, Mus musculus
tttgacatggcatcagaagttggtt

SEQ ID NO: 990295 - DNA, 25 bp, Mus musculus
tttgaccaacttcaggatgttttcc

SEQ ID NO: 990296 - DNA, 25 bp, Mus musculus
tttgaccaacttgaggatgttttcc

SEQ ID NO: 990297 - DNA, 25 bp, Mus musculus
tttgaccacatgaacgtctgctttg

SEQ ID NO: 990298 - DNA, 25 bp, Mus musculus
tttgaccacatgaaggtctgctttg

SEQ ID NO: 990299 - DNA, 25 bp, Mus musculus
tttgaccatgcgcatccttccattt

SEQ ID NO: 990300 - DNA, 25 bp, Mus musculus
tttgaccatgcggatccttccattt

SEQ ID NO: 990301 - DNA, 25 bp, Mus musculus
tttgaccgcacacgtactgagacag

SEQ ID NO: 990302 - DNA, 25 bp, Mus musculus
tttgaccgcacaggtactgagacag

SEQ ID NO: 990303 - DNA, 25 bp, Mus musculus
tttgacctgaagcccgagaacatca

SEQ ID NO: 990304 - DNA, 25 bp, Mus musculus
tttgacctgaaggccgagaacatca

SEQ ID NO: 990305 - DNA, 25 bp, Mus musculus
tttgacctgttccacatcgggcacg

SEQ ID NO: 990306 - DNA, 25 bp, Mus musculus
tttgacctgttcgacatcgggcacg

SEQ ID NO: 990307 - DNA, 25 bp, Mus musculus
tttgacgtgaaaaactatcttggaa

SEQ ID NO: 990308 - DNA, 25 bp, Mus musculus
tttgacgtgaaaaagtatcttggaa

SEQ ID NO: 990309 - DNA, 25 bp, Mus musculus
tttgactctcaggagagaatgtttt

SEQ ID NO: 990310 - DNA, 25 bp, Mus musculus
tttgactctctggagagaatgtttt

SEQ ID NO: 990311 - DNA, 25 bp, Mus musculus
tttgactgtcagcaacatgacattg

SEQ ID NO: 990312 - DNA, 25 bp, Mus musculus
tttgactgtcaggaacatgacattg

SEQ ID NO: 990313 - DNA, 25 bp, Mus musculus
tttgagaagatgatcgaagatatga

SEQ ID NO: 990314 - DNA, 25 bp, Mus musculus
tttgagaagatgatggaagatatga

SEQ ID NO: 990315 - DNA, 25 bp, Mus musculus
tttgagaagctgcacgccgacttta

SEQ ID NO: 990316 - DNA, 25 bp, Mus musculus
tttgagaagctgcaggccgacttta

SEQ ID NO: 990317 - DNA, 25 bp, Mus musculus
tttgagaagctgcgtatcagtacca

SEQ ID NO: 990318 - DNA, 25 bp, Mus musculus
tttgagaagctgggtatcagtacca

SEQ ID NO: 990319 - DNA, 25 bp, Mus musculus
tttgagacagatccgacgagatatc

SEQ ID NO: 990320 - DNA, 25 bp, Mus musculus
tttgagacagttccgacgagatatc

SEQ ID NO: 990321 - DNA, 25 bp, Mus musculus
tttgagacgagtgacgtggtggatg

SEQ ID NO: 990322 - DNA, 25 bp, Mus musculus
tttgagacgagtgaggtggtggatg

SEQ ID NO: 990323 - DNA, 25 bp, Mus musculus
tttgagagcgttcactgtgcagaga

SEQ ID NO: 990324 - DNA, 25 bp, Mus musculus
tttgagagcgttcagtgtgcagaga

SEQ ID NO: 990325 - DNA, 25 bp, Mus musculus
tttgagattaagaaatgtgaccttc

SEQ ID NO: 990326 - DNA, 25 bp, Mus musculus
tttgagattaagcaagcctgctgcg

SEQ ID NO: 990327 - DNA, 25 bp, Mus musculus
tttgagattaaggaagcctgctgcg

SEQ ID NO: 990328 - DNA, 25 bp, Mus musculus
tttgagattaagtaatgtgaccttc

SEQ ID NO: 990329 - DNA, 25 bp, Mus musculus
tttgagcagatccacaaagtccagg

SEQ ID NO: 990330 - DNA, 25 bp, Mus musculus
tttgagcagatccagaaagtccagg

SEQ ID NO: 990331 - DNA, 25 bp, Mus musculus
tttgagcagcagcaaaaagatggaa

SEQ ID NO: 990332 - DNA, 25 bp, Mus musculus
tttgagcagcaggaaaaagatggaa

SEQ ID NO: 990333 - DNA, 25 bp, Mus musculus
tttgagcgcttacgagacaagcaat

SEQ ID NO: 990334 - DNA, 25 bp, Mus musculus
tttgagcgcttaggagacaagcaat

SEQ ID NO: 990335 - DNA, 25 bp, Mus musculus
tttgagcgggccaacagcaaagccc

SEQ ID NO: 990336 - DNA, 25 bp, Mus musculus
tttgagcgggccaaccagagcaaag

SEQ ID NO: 990337 - DNA, 25 bp, Mus musculus
tttgagcgggccaagagcaaagccc

SEQ ID NO: 990338 - DNA, 25 bp, Mus musculus
tttgagcgggccaagcagagcaaag

SEQ ID NO: 990339 - DNA, 25 bp, Mus musculus
tttgagctaaaacaaatgctcaccg

SEQ ID NO: 990340 - DNA, 25 bp, Mus musculus
tttgagctaaaagaaatgctcaccg

SEQ ID NO: 990341 - DNA, 25 bp, Mus musculus
tttgagctaaagatcttgcgtcggg

SEQ ID NO: 990342 - DNA, 25 bp, Mus musculus
tttgagctaaagttcttgcgtcggg

SEQ ID NO: 990343 - DNA, 25 bp, Mus musculus
tttgagctgctccacgagcctgaag

SEQ ID NO: 990344 - DNA, 25 bp, Mus musculus
tttgagctgctccaggagcctgaag

SEQ ID NO: 990345 - DNA, 25 bp, Mus musculus
tttgaggagcatctgcagagtgtcg

SEQ ID NO: 990346 - DNA, 25 bp, Mus musculus
tttgaggagcatgtgcagagtgtcg

SEQ ID NO: 990347 - DNA, 25 bp, Mus musculus
tttgagtacaggactgtaccacaac

SEQ ID NO: 990348 - DNA, 25 bp, Mus musculus
tttgagtacaggtctgtaccacaac

SEQ ID NO: 990349 - DNA, 25 bp, Mus musculus
tttgagtctacacgtttgtacagcg

SEQ ID NO: 990350 - DNA, 25 bp, Mus musculus
tttgagtctacaggtttgtacagcg

SEQ ID NO: 990351 - DNA, 25 bp, Mus musculus
tttgagtggaatccgctcttcgtgg

SEQ ID NO: 990352 - DNA, 25 bp, Mus musculus
tttgagtggaatgcgctcttcgtgg

SEQ ID NO: 990353 - DNA, 25 bp, Mus musculus
tttgataaagttcacctcctggcta

SEQ ID NO: 990354 - DNA, 25 bp, Mus musculus
tttgataaagttcagctcctggcta

SEQ ID NO: 990355 - DNA, 25 bp, Mus musculus
tttgataaggacaagttaaccattt

SEQ ID NO: 990356 - DNA, 25 bp, Mus musculus
tttgataaggtcaagttaaccattt

SEQ ID NO: 990357 - DNA, 25 bp, Mus musculus
tttgatacgccttactgcaaagtgg

SEQ ID NO: 990358 - DNA, 25 bp, Mus musculus
tttgatacgcgttactgcaaagtgg

SEQ ID NO: 990359 - DNA, 25 bp, Mus musculus
tttgatactgcacggcaagaggatt

SEQ ID NO: 990360 - DNA, 25 bp, Mus musculus
tttgatactgcagggcaagaggatt

SEQ ID NO: 990361 - DNA, 25 bp, Mus musculus
tttgatataaaaacaatggcaggga

SEQ ID NO: 990362 - DNA, 25 bp, Mus musculus
tttgatataaaatcaatggcaggga

SEQ ID NO: 990363 - DNA, 25 bp, Mus musculus
tttgatataatgcacagccgatgca

SEQ ID NO: 990364 - DNA, 25 bp, Mus musculus
tttgatataatggacagccgatgca

SEQ ID NO: 990365 - DNA, 25 bp, Mus musculus
tttgatccagatgccaaggggctga

SEQ ID NO: 990366 - DNA, 25 bp, Mus musculus
tttgatccagttgccaaggggctga

SEQ ID NO: 990367 - DNA, 25 bp, Mus musculus
tttgatctgaccaacgtttggcctc

SEQ ID NO: 990368 - DNA, 25 bp, Mus musculus
tttgatctgaccaaggtttggcctc

SEQ ID NO: 990369 - DNA, 25 bp, Mus musculus
tttgatgaaaatcgagtgctgaaag

SEQ ID NO: 990370 - DNA, 25 bp, Mus musculus
tttgatgaaaatggagtgctgaaag

SEQ ID NO: 990371 - DNA, 25 bp, Mus musculus
tttgatgaatatgaaaatgaaacat

SEQ ID NO: 990372 - DNA, 25 bp, Mus musculus
tttgatgaatatgataatgaaacat

SEQ ID NO: 990373 - DNA, 25 bp, Mus musculus
tttgatgacaatcgaagaaatttca

SEQ ID NO: 990374 - DNA, 25 bp, Mus musculus
tttgatgacaatggaagaaatttca

SEQ ID NO: 990375 - DNA, 25 bp, Mus musculus
tttgatgaggaacagtatcagatgg

SEQ ID NO: 990376 - DNA, 25 bp, Mus musculus
tttgatgagggtaactatcagatgg

SEQ ID NO: 990377 - DNA, 25 bp, Mus musculus
tttgatgagggtaagtatcagatgg

SEQ ID NO: 990378 - DNA, 25 bp, Mus musculus
tttgatgaggtacagtatcagatgg

SEQ ID NO: 990379 - DNA, 25 bp, Mus musculus
tttgatgatctaatggatgatacat

SEQ ID NO: 990380 - DNA, 25 bp, Mus musculus
tttgatgatctattggatgatacat

SEQ ID NO: 990381 - DNA, 25 bp, Mus musculus
tttgatgcagatctgctttgtctac

SEQ ID NO: 990382 - DNA, 25 bp, Mus musculus
tttgatgcagatgtgctttgtctac

SEQ ID NO: 990383 - DNA, 25 bp, Mus musculus
tttgatgcccaacgcaacttaaggg

SEQ ID NO: 990384 - DNA, 25 bp, Mus musculus
tttgatgcccaaggcaacttaaggg

SEQ ID NO: 990385 - DNA, 25 bp, Mus musculus
tttgatgcccatcaaggtttctcgg

SEQ ID NO: 990386 - DNA, 25 bp, Mus musculus
tttgatgcccatgaaggtttctcgg

SEQ ID NO: 990387 - DNA, 25 bp, Mus musculus
tttgatggcaagcgtcatgtgggta

SEQ ID NO: 990388 - DNA, 25 bp, Mus musculus
tttgatggcaagctgctgtctgaaa

SEQ ID NO: 990389 - DNA, 25 bp, Mus musculus
tttgatggcaagggtcatgtgggta

SEQ ID NO: 990390 - DNA, 25 bp, Mus musculus
tttgatggcaaggtgctgtctgaaa

SEQ ID NO: 990391 - DNA, 25 bp, Mus musculus
tttgatgtggagagcaaagaaggcg

SEQ ID NO: 990392 - DNA, 25 bp, Mus musculus
tttgatgtggagtgcaaagaaggcg

SEQ ID NO: 990393 - DNA, 25 bp, Mus musculus
tttgatgttaacaaaacattgcatc

SEQ ID NO: 990394 - DNA, 25 bp, Mus musculus
tttgatgttaacaatacattgcatc

SEQ ID NO: 990395 - DNA, 25 bp, Mus musculus
tttgattagcagccattacagcgac

SEQ ID NO: 990396 - DNA, 25 bp, Mus musculus
tttgattagcaggcattacagcgac

SEQ ID NO: 990397 - DNA, 25 bp, Mus musculus
tttgattcacttcagtcttgcaaac

SEQ ID NO: 990398 - DNA, 25 bp, Mus musculus
tttgattcacttgagtcttgcaaac

SEQ ID NO: 990399 - DNA, 25 bp, Mus musculus
tttgattgcagacggagcaaagaag

SEQ ID NO: 990400 - DNA, 25 bp, Mus musculus
tttgattgcagagggagcaaagaag

SEQ ID NO: 990401 - DNA, 25 bp, Mus musculus
tttgatttttacatggacttgacat

SEQ ID NO: 990402 - DNA, 25 bp, Mus musculus
tttgatttttacttggacttgacat

SEQ ID NO: 990403 - DNA, 25 bp, Mus musculus
tttgcaaacaaacacgatttgccga

SEQ ID NO: 990404 - DNA, 25 bp, Mus musculus
tttgcaaacaaacaggatttgccga

SEQ ID NO: 990405 - DNA, 25 bp, Mus musculus
tttgcaagagcaaaatgtttcaaat

SEQ ID NO: 990406 - DNA, 25 bp, Mus musculus
tttgcaagagcaaattgtttcaaat

SEQ ID NO: 990407 - DNA, 25 bp, Mus musculus
tttgcaagtcagcccgtctactgtg

SEQ ID NO: 990408 - DNA, 25 bp, Mus musculus
tttgcaagtcaggccgtctactgtg

SEQ ID NO: 990409 - DNA, 25 bp, Mus musculus
tttgcaataatgactgaaccaatca

SEQ ID NO: 990410 - DNA, 25 bp, Mus musculus
tttgcaataatgtctgaaccaatca

SEQ ID NO: 990411 - DNA, 25 bp, Mus musculus
tttgcaatcgatggcagctcaacgg

SEQ ID NO: 990412 - DNA, 25 bp, Mus musculus
tttgcaatcgttggcagctcaacgg

SEQ ID NO: 990413 - DNA, 25 bp, Mus musculus
tttgcaatttctctcttcatttaat

SEQ ID NO: 990414 - DNA, 25 bp, Mus musculus
tttgcaatttgtctcttcatttaat

SEQ ID NO: 990415 - DNA, 25 bp, Mus musculus
tttgcacaaattcacactctccatg

SEQ ID NO: 990416 - DNA, 25 bp, Mus musculus
tttgcacaaattgacactctccatg

SEQ ID NO: 990417 - DNA, 25 bp, Mus musculus
tttgcacagcacagccagggggaag

SEQ ID NO: 990418 - DNA, 25 bp, Mus musculus
tttgcacagcactgccagggggaag

SEQ ID NO: 990419 - DNA, 25 bp, Mus musculus
tttgcactgaagaacataaagcgct

SEQ ID NO: 990420 - DNA, 25 bp, Mus musculus
tttgcactgaagaagataaagcgct

SEQ ID NO: 990421 - DNA, 25 bp, Mus musculus
tttgcagacttaggcgatggtggtt

SEQ ID NO: 990422 - DNA, 25 bp, Mus musculus
tttgcagacttaggggatggtggtt

SEQ ID NO: 990423 - DNA, 25 bp, Mus musculus
tttgcagagaagaatcttcctgcac

SEQ ID NO: 990424 - DNA, 25 bp, Mus musculus
tttgcagagaagtatcttcctgcac

SEQ ID NO: 990425 - DNA, 25 bp, Mus musculus
tttgcagagccacatcactatgttg

SEQ ID NO: 990426 - DNA, 25 bp, Mus musculus
tttgcagagccagatcactatgttg

SEQ ID NO: 990427 - DNA, 25 bp, Mus musculus
tttgcagagcctcgcagggtgccat

SEQ ID NO: 990428 - DNA, 25 bp, Mus musculus
tttgcagagcctggcagggtgccat

SEQ ID NO: 990429 - DNA, 25 bp, Mus musculus
tttgcagccaagcccacagaggatc

SEQ ID NO: 990430 - DNA, 25 bp, Mus musculus
tttgcagccaaggccacagaggatc

SEQ ID NO: 990431 - DNA, 25 bp, Mus musculus
tttgcagctattcacctgctgggca

SEQ ID NO: 990432 - DNA, 25 bp, Mus musculus
tttgcagctattcagctgctgggca

SEQ ID NO: 990433 - DNA, 25 bp, Mus musculus
tttgcaggaaactgcagtgtgggtt

SEQ ID NO: 990434 - DNA, 25 bp, Mus musculus
tttgcaggaaactggagtgtgggtt

SEQ ID NO: 990435 - DNA, 25 bp, Mus musculus
tttgcaggaaagcgcaaataagttg

SEQ ID NO: 990436 - DNA, 25 bp, Mus musculus
tttgcaggaaagggcaaataagttg

SEQ ID NO: 990437 - DNA, 25 bp, Mus musculus
tttgcaggaccacacaactacagct

SEQ ID NO: 990438 - DNA, 25 bp, Mus musculus
tttgcaggaccacacttatatatct

SEQ ID NO: 990439 - DNA, 25 bp, Mus musculus
tttgcaggaccacagaactacagct

SEQ ID NO: 990440 - DNA, 25 bp, Mus musculus
tttgcaggaccacagttatatatct

SEQ ID NO: 990441 - DNA, 25 bp, Mus musculus
tttgcaggggacaacatcacctttg

SEQ ID NO: 990442 - DNA, 25 bp, Mus musculus
tttgcaggggacaagatcacctttg

SEQ ID NO: 990443 - DNA, 25 bp, Mus musculus
tttgcagtctctcaagcttttaaaa

SEQ ID NO: 990444 - DNA, 25 bp, Mus musculus
tttgcagtctgtcaagcttttaaaa

SEQ ID NO: 990445 - DNA, 25 bp, Mus musculus
tttgcatcagacagcgcaacgtttc

SEQ ID NO: 990446 - DNA, 25 bp, Mus musculus
tttgcatcagacagggcaacgtttc

SEQ ID NO: 990447 - DNA, 25 bp, Mus musculus
tttgcatgcaagccttgttccccct

SEQ ID NO: 990448 - DNA, 25 bp, Mus musculus
tttgcatgcaagctacagaagaaag

SEQ ID NO: 990449 - DNA, 25 bp, Mus musculus
tttgcatgcaaggcttgttccccct

SEQ ID NO: 990450 - DNA, 25 bp, Mus musculus
tttgcatgcaaggtacagaagaaag

SEQ ID NO: 990451 - DNA, 25 bp, Mus musculus
tttgcatgctagcagatgtacgact

SEQ ID NO: 990452 - DNA, 25 bp, Mus musculus
tttgcatgctaggagatgtacgact

SEQ ID NO: 990453 - DNA, 25 bp, Mus musculus
tttgcatgtcatcggtgaagataaa

SEQ ID NO: 990454 - DNA, 25 bp, Mus musculus
tttgcatgtcatgggtgaagataaa

SEQ ID NO: 990455 - DNA, 25 bp, Mus musculus
tttgccaaagcccactgtggaatcc

SEQ ID NO: 990456 - DNA, 25 bp, Mus musculus
tttgccaaaggccactgtggaatcc

SEQ ID NO: 990457 - DNA, 25 bp, Mus musculus
tttgccaaagttcataccgatggca

SEQ ID NO: 990458 - DNA, 25 bp, Mus musculus
tttgccaaagttgataccgatggca

SEQ ID NO: 990459 - DNA, 25 bp, Mus musculus
tttgccaacaagcacgacctcccca

SEQ ID NO: 990460 - DNA, 25 bp, Mus musculus
tttgccaacaagcaggacctcccca

SEQ ID NO: 990461 - DNA, 25 bp, Mus musculus
tttgccaaccagaccgagaaagata

SEQ ID NO: 990462 - DNA, 25 bp, Mus musculus
tttgccaaccagtccgagaaagata

SEQ ID NO: 990463 - DNA, 25 bp, Mus musculus
tttgccaagatcaggtggatcgcac

SEQ ID NO: 990464 - DNA, 25 bp, Mus musculus
tttgccaagatcatgatccagtttt

SEQ ID NO: 990465 - DNA, 25 bp, Mus musculus
tttgccaagatctggtggatcgcac

SEQ ID NO: 990466 - DNA, 25 bp, Mus musculus
tttgccaagatcttgatccagtttt

SEQ ID NO: 990467 - DNA, 25 bp, Mus musculus
tttgccacatcacggcacttgattt

SEQ ID NO: 990468 - DNA, 25 bp, Mus musculus
tttgccacatcagggcacttgattt

SEQ ID NO: 990469 - DNA, 25 bp, Mus musculus
tttgccactgctttccctgtacccc

SEQ ID NO: 990470 - DNA, 25 bp, Mus musculus
tttgccactgctttgcctgtacccc

SEQ ID NO: 990471 - DNA, 25 bp, Mus musculus
tttgcccaattctgcgacactcact

SEQ ID NO: 990472 - DNA, 25 bp, Mus musculus
tttgcccaattctgggacactcact

SEQ ID NO: 990473 - DNA, 25 bp, Mus musculus
tttgccgcccagcaggtgcccaccc

SEQ ID NO: 990474 - DNA, 25 bp, Mus musculus
tttgccgcccaggaggtgcccaccc

SEQ ID NO: 990475 - DNA, 25 bp, Mus musculus
tttgcctatatgaacgcattatatg

SEQ ID NO: 990476 - DNA, 25 bp, Mus musculus
tttgcctatatgaaggcattatatg

SEQ ID NO: 990477 - DNA, 25 bp, Mus musculus
tttgccttccgacatgagacggcag

SEQ ID NO: 990478 - DNA, 25 bp, Mus musculus
tttgccttccgacggcagtactgct

SEQ ID NO: 990479 - DNA, 25 bp, Mus musculus
tttgccttccgagatgagacggcag

SEQ ID NO: 990480 - DNA, 25 bp, Mus musculus
tttgccttccgagggcagtactgct

SEQ ID NO: 990481 - DNA, 25 bp, Mus musculus
tttgcgcatcctccagccacattgc

SEQ ID NO: 990482 - DNA, 25 bp, Mus musculus
tttgcgcatcctgcagccacattgc

SEQ ID NO: 990483 - DNA, 25 bp, Mus musculus
tttgcgtgttgctgcatgagtattg

SEQ ID NO: 990484 - DNA, 25 bp, Mus musculus
tttgcgtgttgctgcctgccatgcc

SEQ ID NO: 990485 - DNA, 25 bp, Mus musculus
tttgcgtgttgctgcctggattgcc

SEQ ID NO: 990486 - DNA, 25 bp, Mus musculus
tttgcgtgttgctggatgagtattg

SEQ ID NO: 990487 - DNA, 25 bp, Mus musculus
tttgcgtgttgctggctgccatgcc

SEQ ID NO: 990488 - DNA, 25 bp, Mus musculus
tttgcgtgttgctggctggattgcc

SEQ ID NO: 990489 - DNA, 25 bp, Mus musculus
tttgcgtttttcaacgatgtcactg

SEQ ID NO: 990490 - DNA, 25 bp, Mus musculus
tttgcgtttttcaactatgaagtca

SEQ ID NO: 990491 - DNA, 25 bp, Mus musculus
tttgcgtttttcaaggatgtcactg

SEQ ID NO: 990492 - DNA, 25 bp, Mus musculus
tttgcgtttttcaagtatgaagtca

SEQ ID NO: 990493 - DNA, 25 bp, Mus musculus
tttgctaaagatggcagactgtgga

SEQ ID NO: 990494 - DNA, 25 bp, Mus musculus
tttgctaaagttggcagactgtgga

SEQ ID NO: 990495 - DNA, 25 bp, Mus musculus
tttgctacattcaacgatttactta

SEQ ID NO: 990496 - DNA, 25 bp, Mus musculus
tttgctacattcaaggatttactta

SEQ ID NO: 990497 - DNA, 25 bp, Mus musculus
tttgctatgcccagacttcatagta

SEQ ID NO: 990498 - DNA, 25 bp, Mus musculus
tttgctatgccctgacttcatagta

SEQ ID NO: 990499 - DNA, 25 bp, Mus musculus
tttgctcaagcacgtgggctctcta

SEQ ID NO: 990500 - DNA, 25 bp, Mus musculus
tttgctcaaggacgtgggctctcta

SEQ ID NO: 990501 - DNA, 25 bp, Mus musculus
tttgctctagagaatggacagcaat

SEQ ID NO: 990502 - DNA, 25 bp, Mus musculus
tttgctctagagtatggacagcaat

SEQ ID NO: 990503 - DNA, 25 bp, Mus musculus
tttgctgaagctacaacaggcagag

SEQ ID NO: 990504 - DNA, 25 bp, Mus musculus
tttgctgaagcttcaacaggcagag

SEQ ID NO: 990505 - DNA, 25 bp, Mus musculus
tttgctgacaagcggtttgctcggg

SEQ ID NO: 990506 - DNA, 25 bp, Mus musculus
tttgctgacaaggggtttgctcggg

SEQ ID NO: 990507 - DNA, 25 bp, Mus musculus
tttgctgactctaacaaaagagaag

SEQ ID NO: 990508 - DNA, 25 bp, Mus musculus
tttgctgactctaagaaaagagaag

SEQ ID NO: 990509 - DNA, 25 bp, Mus musculus
tttgctgagcaccggtactatggga

SEQ ID NO: 990510 - DNA, 25 bp, Mus musculus
tttgctgagcacgggtactatggga

SEQ ID NO: 990511 - DNA, 25 bp, Mus musculus
tttgctgcagcaatcctggagagta

SEQ ID NO: 990512 - DNA, 25 bp, Mus musculus
tttgctgcaggaatcctggagagta

SEQ ID NO: 990513 - DNA, 25 bp, Mus musculus
tttgctggaagacaaagaacgggac

SEQ ID NO: 990514 - DNA, 25 bp, Mus musculus
tttgctggaagagaaagaacgggac

SEQ ID NO: 990515 - DNA, 25 bp, Mus musculus
tttgctggtgaacgttcaattgtga

SEQ ID NO: 990516 - DNA, 25 bp, Mus musculus
tttgctggtgaacttatgtaatcca

SEQ ID NO: 990517 - DNA, 25 bp, Mus musculus
tttgctggtgaaggttcaattgtga

SEQ ID NO: 990518 - DNA, 25 bp, Mus musculus
tttgctggtgaagttatgtaatcca

SEQ ID NO: 990519 - DNA, 25 bp, Mus musculus
tttgctggtgctcccgcattgcagc

SEQ ID NO: 990520 - DNA, 25 bp, Mus musculus
tttgctggtgctccctggaccctaa

SEQ ID NO: 990521 - DNA, 25 bp, Mus musculus
tttgctggtgctccggcattgcagc

SEQ ID NO: 990522 - DNA, 25 bp, Mus musculus
tttgctggtgctccgtggaccctaa

SEQ ID NO: 990523 - DNA, 25 bp, Mus musculus
tttgctgtggagatcggcctggcct

SEQ ID NO: 990524 - DNA, 25 bp, Mus musculus
tttgctgtggagccagtggagcggc

SEQ ID NO: 990525 - DNA, 25 bp, Mus musculus
tttgctgtggagctccttcaaaaaa

SEQ ID NO: 990526 - DNA, 25 bp, Mus musculus
tttgctgtggaggcagtggagcggc

SEQ ID NO: 990527 - DNA, 25 bp, Mus musculus
tttgctgtggaggtccttcaaaaaa

SEQ ID NO: 990528 - DNA, 25 bp, Mus musculus
tttgctgtggagttcggcctggcct

SEQ ID NO: 990529 - DNA, 25 bp, Mus musculus
tttgctgtggcaatcaagaatgccg

SEQ ID NO: 990530 - DNA, 25 bp, Mus musculus
tttgctgtgggaatcaagaatgccg

SEQ ID NO: 990531 - DNA, 25 bp, Mus musculus
tttgcttaagcatggtgctgacgtc

SEQ ID NO: 990532 - DNA, 25 bp, Mus musculus
tttgcttaaggatggtgctgacgtc

SEQ ID NO: 990533 - DNA, 25 bp, Mus musculus
tttgcttaggacttgtctgtattcc

SEQ ID NO: 990534 - DNA, 25 bp, Mus musculus
tttgcttaggtcttgtctgtattcc

SEQ ID NO: 990535 - DNA, 25 bp, Mus musculus
tttgcttccaaaccaggaaaagcga

SEQ ID NO: 990536 - DNA, 25 bp, Mus musculus
tttgcttccaaacgaaaagcgacat

SEQ ID NO: 990537 - DNA, 25 bp, Mus musculus
tttgcttccaaagcaggaaaagcga

SEQ ID NO: 990538 - DNA, 25 bp, Mus musculus
tttgcttccaaaggaaaagcgacat

SEQ ID NO: 990539 - DNA, 25 bp, Mus musculus
tttgcttccatgacaggcataccag

SEQ ID NO: 990540 - DNA, 25 bp, Mus musculus
tttgcttccatgactggcataccag

SEQ ID NO: 990541 - DNA, 25 bp, Mus musculus
tttgcttcggacagcgcaacgtttc

SEQ ID NO: 990542 - DNA, 25 bp, Mus musculus
tttgcttcggacagggcaacgtttc

SEQ ID NO: 990543 - DNA, 25 bp, Mus musculus
tttgcttcttgttgcggatgtggct

SEQ ID NO: 990544 - DNA, 25 bp, Mus musculus
tttgcttcttgttggggatgtggct

SEQ ID NO: 990545 - DNA, 25 bp, Mus musculus
tttgcttgcaaacacgatgtctctc

SEQ ID NO: 990546 - DNA, 25 bp, Mus musculus
tttgcttgcaaacaggatgtctctc

SEQ ID NO: 990547 - DNA, 25 bp, Mus musculus
tttggaaactctccccccatcttca

SEQ ID NO: 990548 - DNA, 25 bp, Mus musculus
tttggaaactctccgcccatcttca

SEQ ID NO: 990549 - DNA, 25 bp, Mus musculus
tttggaaatgagaccgaagctgcca

SEQ ID NO: 990550 - DNA, 25 bp, Mus musculus
tttggaaatgagacctgctggagat

SEQ ID NO: 990551 - DNA, 25 bp, Mus musculus
tttggaaatgagacggaagctgcca

SEQ ID NO: 990552 - DNA, 25 bp, Mus musculus
tttggaaatgagacgtgctggagat

SEQ ID NO: 990553 - DNA, 25 bp, Mus musculus
tttggaacaaaaaagatcgtggctc

SEQ ID NO: 990554 - DNA, 25 bp, Mus musculus
tttggaacaaaatagatcgtggctc

SEQ ID NO: 990555 - DNA, 25 bp, Mus musculus
tttggaacagattcaagtcaatctg

SEQ ID NO: 990556 - DNA, 25 bp, Mus musculus
tttggaacagcacttgcaaactcca

SEQ ID NO: 990557 - DNA, 25 bp, Mus musculus
tttggaacagcagttgcaaactcca

SEQ ID NO: 990558 - DNA, 25 bp, Mus musculus
tttggaacagccaacaatatcacac

SEQ ID NO: 990559 - DNA, 25 bp, Mus musculus
tttggaacaggcaacaatatcacac

SEQ ID NO: 990560 - DNA, 25 bp, Mus musculus
tttggaacagtttcaagtcaatctg

SEQ ID NO: 990561 - DNA, 25 bp, Mus musculus
tttggaaccccagacggagagttcg

SEQ ID NO: 990562 - DNA, 25 bp, Mus musculus
tttggaaccccagagggagagttcg

SEQ ID NO: 990563 - DNA, 25 bp, Mus musculus
tttggaacttcctcctcccatctct

SEQ ID NO: 990564 - DNA, 25 bp, Mus musculus
tttggaacttcctcgtcccatctct

SEQ ID NO: 990565 - DNA, 25 bp, Mus musculus
tttggaagaaagccttgttggagct

SEQ ID NO: 990566 - DNA, 25 bp, Mus musculus
tttggaagaaaggcttgttggagct

SEQ ID NO: 990567 - DNA, 25 bp, Mus musculus
tttggaagccaggacattagagtgg

SEQ ID NO: 990568 - DNA, 25 bp, Mus musculus
tttggaagccaggactgggcctgag

SEQ ID NO: 990569 - DNA, 25 bp, Mus musculus
tttggaagccaggagattagagtgg

SEQ ID NO: 990570 - DNA, 25 bp, Mus musculus
tttggaagccaggagtgggcctgag

SEQ ID NO: 990571 - DNA, 25 bp, Mus musculus
tttggacagtcttgcaatgtttcta

SEQ ID NO: 990572 - DNA, 25 bp, Mus musculus
tttggacagtgacctggtgacccct

SEQ ID NO: 990573 - DNA, 25 bp, Mus musculus
tttggacagtgagctggtgacccct

SEQ ID NO: 990574 - DNA, 25 bp, Mus musculus
tttggacagtgttgcaatgtttcta

SEQ ID NO: 990575 - DNA, 25 bp, Mus musculus
tttggaccaaagacccagccattcg

SEQ ID NO: 990576 - DNA, 25 bp, Mus musculus
tttggaccaactgttctcagtttgg

SEQ ID NO: 990577 - DNA, 25 bp, Mus musculus
tttggaccaagtgttctcagtttgg

SEQ ID NO: 990578 - DNA, 25 bp, Mus musculus
tttggaccaatgacccagccattcg

SEQ ID NO: 990579 - DNA, 25 bp, Mus musculus
tttggaccacgacattctcgagttc

SEQ ID NO: 990580 - DNA, 25 bp, Mus musculus
tttggaccacgagattctcgagttc

SEQ ID NO: 990581 - DNA, 25 bp, Mus musculus
tttggaccgactcgttactgatgtc

SEQ ID NO: 990582 - DNA, 25 bp, Mus musculus
tttggaccgactggttactgatgtc

SEQ ID NO: 990583 - DNA, 25 bp, Mus musculus
tttggactggcagctgaagttggaa

SEQ ID NO: 990584 - DNA, 25 bp, Mus musculus
tttggactgggagctgaagttggaa

SEQ ID NO: 990585 - DNA, 25 bp, Mus musculus
tttggagaaaaatgtggaattggtt

SEQ ID NO: 990586 - DNA, 25 bp, Mus musculus
tttggagaaatatgtggaattggtt

SEQ ID NO: 990587 - DNA, 25 bp, Mus musculus
tttggagaagctacattattttgtt

SEQ ID NO: 990588 - DNA, 25 bp, Mus musculus
tttggagaaggtacattattttgtt

SEQ ID NO: 990589 - DNA, 25 bp, Mus musculus
tttggagaattacactactgtttat

SEQ ID NO: 990590 - DNA, 25 bp, Mus musculus
tttggagaattacagtactgtttat

SEQ ID NO: 990591 - DNA, 25 bp, Mus musculus
tttggagaccatagcacaaggatga

SEQ ID NO: 990592 - DNA, 25 bp, Mus musculus
tttggagaccataggacaaggatga

SEQ ID NO: 990593 - DNA, 25 bp, Mus musculus
tttggagacgtgaactttgtgtgtg

SEQ ID NO: 990594 - DNA, 25 bp, Mus musculus
tttggagacgtgaagtttgtgtgtg

SEQ ID NO: 990595 - DNA, 25 bp, Mus musculus
tttggagatgggcaagtccgttgat

SEQ ID NO: 990596 - DNA, 25 bp, Mus musculus
tttggagatggggaagtccgttgat

SEQ ID NO: 990597 - DNA, 25 bp, Mus musculus
tttggagctgcgtttgacacagtca

SEQ ID NO: 990598 - DNA, 25 bp, Mus musculus
tttggagctgggtttgacacagtca

SEQ ID NO: 990599 - DNA, 25 bp, Mus musculus
tttggagcttgtcacgacaggggac

SEQ ID NO: 990600 - DNA, 25 bp, Mus musculus
tttggagcttgtcaggacaggggac

SEQ ID NO: 990601 - DNA, 25 bp, Mus musculus
tttggaggtgtgcgtgccagtggaa

SEQ ID NO: 990602 - DNA, 25 bp, Mus musculus
tttggaggtgtgggtgccagtggaa

SEQ ID NO: 990603 - DNA, 25 bp, Mus musculus
tttggaggtgttgaacttcttgtag

SEQ ID NO: 990604 - DNA, 25 bp, Mus musculus
tttggaggtgttgatcttcttgtag

SEQ ID NO: 990605 - DNA, 25 bp, Mus musculus
tttggaggttctcggacagcaactg

SEQ ID NO: 990606 - DNA, 25 bp, Mus musculus
tttggaggttctgggacagcaactg

SEQ ID NO: 990607 - DNA, 25 bp, Mus musculus
tttggatgaccagacagtgatgtgg

SEQ ID NO: 990608 - DNA, 25 bp, Mus musculus
tttggatgaccagacccccgggcct

SEQ ID NO: 990609 - DNA, 25 bp, Mus musculus
tttggatgaccagagagtgatgtgg

SEQ ID NO: 990610 - DNA, 25 bp, Mus musculus
tttggatgaccagagccccgggcct

SEQ ID NO: 990611 - DNA, 25 bp, Mus musculus
tttggatgtccacacaactacaggg

SEQ ID NO: 990612 - DNA, 25 bp, Mus musculus
tttggatgtccagacaactacaggg

SEQ ID NO: 990613 - DNA, 25 bp, Mus musculus
tttggatgtctatgaacttgatcct

SEQ ID NO: 990614 - DNA, 25 bp, Mus musculus
tttggatgtctatgtacttgatcct

SEQ ID NO: 990615 - DNA, 25 bp, Mus musculus
tttggatgttcccgtatctgcccca

SEQ ID NO: 990616 - DNA, 25 bp, Mus musculus
tttggatgttccggtatctgcccca

SEQ ID NO: 990617 - DNA, 25 bp, Mus musculus
tttggattcaaacacgacctacatc

SEQ ID NO: 990618 - DNA, 25 bp, Mus musculus
tttggattcaaacaggacctacatc

SEQ ID NO: 990619 - DNA, 25 bp, Mus musculus
tttggcaacaaccctctggtgcaag

SEQ ID NO: 990620 - DNA, 25 bp, Mus musculus
tttggcaacaacgctctggtgcaag

SEQ ID NO: 990621 - DNA, 25 bp, Mus musculus
tttggcaactttcactgctgcttaa

SEQ ID NO: 990622 - DNA, 25 bp, Mus musculus
tttggcaactttcagtgctgcttaa

SEQ ID NO: 990623 - DNA, 25 bp, Mus musculus
tttggcaaggcttacaggagtaaac

SEQ ID NO: 990624 - DNA, 25 bp, Mus musculus
tttggcaagggttacaggagtaaac

SEQ ID NO: 990625 - DNA, 25 bp, Mus musculus
tttggcaagtttcggcctgccttaa

SEQ ID NO: 990626 - DNA, 25 bp, Mus musculus
tttggcaagtttgggcctgccttaa

SEQ ID NO: 990627 - DNA, 25 bp, Mus musculus
tttggcaatgatcgaagcaattttg

SEQ ID NO: 990628 - DNA, 25 bp, Mus musculus
tttggcaatgatcgtggctatggcg

SEQ ID NO: 990629 - DNA, 25 bp, Mus musculus
tttggcaatgatcgtggttatggag

SEQ ID NO: 990630 - DNA, 25 bp, Mus musculus
tttggcaatgatggaagcaattttg

SEQ ID NO: 990631 - DNA, 25 bp, Mus musculus
tttggcaatgatggtggctatggcg

SEQ ID NO: 990632 - DNA, 25 bp, Mus musculus
tttggcaatgatggtggttatggag

SEQ ID NO: 990633 - DNA, 25 bp, Mus musculus
tttggcagcgcatctccatctttcc

SEQ ID NO: 990634 - DNA, 25 bp, Mus musculus
tttggcagcggatctccatctttcc

SEQ ID NO: 990635 - DNA, 25 bp, Mus musculus
tttggcagggaattcacgcagcggg

SEQ ID NO: 990636 - DNA, 25 bp, Mus musculus
tttggcagggtattcacgcagcggg

SEQ ID NO: 990637 - DNA, 25 bp, Mus musculus
tttggcatcatgcaaatgacaatga

SEQ ID NO: 990638 - DNA, 25 bp, Mus musculus
tttggcatcatggaaatgacaatga

SEQ ID NO: 990639 - DNA, 25 bp, Mus musculus
tttggcatccacgacgagatgctga

SEQ ID NO: 990640 - DNA, 25 bp, Mus musculus
tttggcatccacgaggagatgctga

SEQ ID NO: 990641 - DNA, 25 bp, Mus musculus
tttggcatgaaacgaggaagcggct

SEQ ID NO: 990642 - DNA, 25 bp, Mus musculus
tttggcatgaaacgcccagcttcgg

SEQ ID NO: 990643 - DNA, 25 bp, Mus musculus
tttggcatgaaaggaggaagcggct

SEQ ID NO: 990644 - DNA, 25 bp, Mus musculus
tttggcatgaaaggcccagcttcgg

SEQ ID NO: 990645 - DNA, 25 bp, Mus musculus
tttggcatgaagattccctcaggtc

SEQ ID NO: 990646 - DNA, 25 bp, Mus musculus
tttggcatgaagtttccctcaggtc

SEQ ID NO: 990647 - DNA, 25 bp, Mus musculus
tttggcattgatcccatttggaaca

SEQ ID NO: 990648 - DNA, 25 bp, Mus musculus
tttggcattgatccgatttggaaca

SEQ ID NO: 990649 - DNA, 25 bp, Mus musculus
tttggcccgacacttctctttggag

SEQ ID NO: 990650 - DNA, 25 bp, Mus musculus
tttggcccgacagttctctttggag

SEQ ID NO: 990651 - DNA, 25 bp, Mus musculus
tttggccctcagctacaagcagctt

SEQ ID NO: 990652 - DNA, 25 bp, Mus musculus
tttggccctcagcttcaagcagctt

SEQ ID NO: 990653 - DNA, 25 bp, Mus musculus
tttggccttgacaaaatcaacatga

SEQ ID NO: 990654 - DNA, 25 bp, Mus musculus
tttggccttgacaatatcaacatga

SEQ ID NO: 990655 - DNA, 25 bp, Mus musculus
tttggcgtagccggacttggaggac

SEQ ID NO: 990656 - DNA, 25 bp, Mus musculus
tttggcgtaggcggacttggaggac

SEQ ID NO: 990657 - DNA, 25 bp, Mus musculus
tttggcgtgctgggcagctccaagg

SEQ ID NO: 990658 - DNA, 25 bp, Mus musculus
tttggcgtgctggggagctccaagg

SEQ ID NO: 990659 - DNA, 25 bp, Mus musculus
tttggcgttcatctgaacataggta

SEQ ID NO: 990660 - DNA, 25 bp, Mus musculus
tttggcgttcatgtgaacataggta

SEQ ID NO: 990661 - DNA, 25 bp, Mus musculus
tttggctcatcacgaggactgacaa

SEQ ID NO: 990662 - DNA, 25 bp, Mus musculus
tttggctcatcacttggcagttctg

SEQ ID NO: 990663 - DNA, 25 bp, Mus musculus
tttggctcatcaggaggactgacaa

SEQ ID NO: 990664 - DNA, 25 bp, Mus musculus
tttggctcatcagttggcagttctg

SEQ ID NO: 990665 - DNA, 25 bp, Mus musculus
tttggctgggctctgccggctgtct

SEQ ID NO: 990666 - DNA, 25 bp, Mus musculus
tttggctggggtctgccggctgtct

SEQ ID NO: 990667 - DNA, 25 bp, Mus musculus
tttggcttccaacaaactgcagggt

SEQ ID NO: 990668 - DNA, 25 bp, Mus musculus
tttggcttccaacatactgcagggt

SEQ ID NO: 990669 - DNA, 25 bp, Mus musculus
tttggcttgcggattattgcagcca

SEQ ID NO: 990670 - DNA, 25 bp, Mus musculus
tttggcttgcggtttattgcagcca

SEQ ID NO: 990671 - DNA, 25 bp, Mus musculus
tttggctttgctcaatgaagtaaac

SEQ ID NO: 990672 - DNA, 25 bp, Mus musculus
tttggctttgctgaatgaagtaaac

SEQ ID NO: 990673 - DNA, 25 bp, Mus musculus
tttgggaaagaacgttacccatgca

SEQ ID NO: 990674 - DNA, 25 bp, Mus musculus
tttgggaaagaaggttacccatgca

SEQ ID NO: 990675 - DNA, 25 bp, Mus musculus
tttgggaaagaccaccccatcattc

SEQ ID NO: 990676 - DNA, 25 bp, Mus musculus
tttgggaaagaccagcccatcattc

SEQ ID NO: 990677 - DNA, 25 bp, Mus musculus
tttgggagctatgcttatcctaaaa

SEQ ID NO: 990678 - DNA, 25 bp, Mus musculus
tttgggagctttgcttatcctaaaa

SEQ ID NO: 990679 - DNA, 25 bp, Mus musculus
tttgggcacgatgtataccaggtgg

SEQ ID NO: 990680 - DNA, 25 bp, Mus musculus
tttgggcacgcactgtcagggcagg

SEQ ID NO: 990681 - DNA, 25 bp, Mus musculus
tttgggcacggactgtcagggcagg

SEQ ID NO: 990682 - DNA, 25 bp, Mus musculus
tttgggcacgttgtataccaggtgg

SEQ ID NO: 990683 - DNA, 25 bp, Mus musculus
tttgggcggctcaacgtggcccagc

SEQ ID NO: 990684 - DNA, 25 bp, Mus musculus
tttgggcggctcaaggtggcccagc

SEQ ID NO: 990685 - DNA, 25 bp, Mus musculus
tttgggtacatgcaatatgcccaag

SEQ ID NO: 990686 - DNA, 25 bp, Mus musculus
tttgggtacatggaatatgcccaag

SEQ ID NO: 990687 - DNA, 25 bp, Mus musculus
tttgggtcagatgatccctattcaa

SEQ ID NO: 990688 - DNA, 25 bp, Mus musculus
tttgggtcagttgatccctattcaa

SEQ ID NO: 990689 - DNA, 25 bp, Mus musculus
tttgggttaccgagagcttttgctg

SEQ ID NO: 990690 - DNA, 25 bp, Mus musculus
tttgggttaccgtgagcttttgctg

SEQ ID NO: 990691 - DNA, 25 bp, Mus musculus
tttgggttgaggatttgggcagctg

SEQ ID NO: 990692 - DNA, 25 bp, Mus musculus
tttgggttgaggttttgggcagctg

SEQ ID NO: 990693 - DNA, 25 bp, Mus musculus
tttggtatcaagctcccgtcaggct

SEQ ID NO: 990694 - DNA, 25 bp, Mus musculus
tttggtatcaaggtcccgtcaggct

SEQ ID NO: 990695 - DNA, 25 bp, Mus musculus
tttggtcatgaacaagcagaattct

SEQ ID NO: 990696 - DNA, 25 bp, Mus musculus
tttggtcatgaacacatgtttaaaa

SEQ ID NO: 990697 - DNA, 25 bp, Mus musculus
tttggtcatgaagaagcagaattct

SEQ ID NO: 990698 - DNA, 25 bp, Mus musculus
tttggtcatgaagacatgtttaaaa

SEQ ID NO: 990699 - DNA, 25 bp, Mus musculus
tttggtcttacgctaccagccagaa

SEQ ID NO: 990700 - DNA, 25 bp, Mus musculus
tttggtcttacggtaccagccagaa

SEQ ID NO: 990701 - DNA, 25 bp, Mus musculus
tttggtgaagcccgcagtacaaaaa

SEQ ID NO: 990702 - DNA, 25 bp, Mus musculus
tttggtgaaggccgcagtacaaaaa

SEQ ID NO: 990703 - DNA, 25 bp, Mus musculus
tttggtgacatgacacttgaagaat

SEQ ID NO: 990704 - DNA, 25 bp, Mus musculus
tttggtgacatgtcacttgaagaat

SEQ ID NO: 990705 - DNA, 25 bp, Mus musculus
tttggtggaatgcatgcagatgtca

SEQ ID NO: 990706 - DNA, 25 bp, Mus musculus
tttggtggaatggatgcagatgtca

SEQ ID NO: 990707 - DNA, 25 bp, Mus musculus
tttggtgtcgcgcagcacggagacg

SEQ ID NO: 990708 - DNA, 25 bp, Mus musculus
tttggtgtcgcggagcacggagacg

SEQ ID NO: 990709 - DNA, 25 bp, Mus musculus
tttggtgtctctcggggccacatca

SEQ ID NO: 990710 - DNA, 25 bp, Mus musculus
tttggtgtctctgggggccacatca

SEQ ID NO: 990711 - DNA, 25 bp, Mus musculus
tttggtgtgctccacgctggacagt

SEQ ID NO: 990712 - DNA, 25 bp, Mus musculus
tttggtgtgctccaggctggacagt

SEQ ID NO: 990713 - DNA, 25 bp, Mus musculus
tttggttatgagctctggcgggaat

SEQ ID NO: 990714 - DNA, 25 bp, Mus musculus
tttggttatgaggtctggcgggaat

SEQ ID NO: 990715 - DNA, 25 bp, Mus musculus
tttggttcagagacttttacatgta

SEQ ID NO: 990716 - DNA, 25 bp, Mus musculus
tttggttcagagatgtcctggggaa

SEQ ID NO: 990717 - DNA, 25 bp, Mus musculus
tttggttcagagtcttttacatgta

SEQ ID NO: 990718 - DNA, 25 bp, Mus musculus
tttggttcagagttgtcctggggaa

SEQ ID NO: 990719 - DNA, 25 bp, Mus musculus
tttggttcttgtttcatactttatg

SEQ ID NO: 990720 - DNA, 25 bp, Mus musculus
tttggttcttgtttgatactttatg

SEQ ID NO: 990721 - DNA, 25 bp, Mus musculus
tttggttttcatccaggtggatcgc

SEQ ID NO: 990722 - DNA, 25 bp, Mus musculus
tttggttttcatcctggtggatcgc

SEQ ID NO: 990723 - DNA, 25 bp, Mus musculus
tttgtaaacaaacacgatcttccta

SEQ ID NO: 990724 - DNA, 25 bp, Mus musculus
tttgtaaacaaacaggatcttccta

SEQ ID NO: 990725 - DNA, 25 bp, Mus musculus
tttgtaaccatgaaaatcagaaaat

SEQ ID NO: 990726 - DNA, 25 bp, Mus musculus
tttgtaaccatgtaaatcagaaaat

SEQ ID NO: 990727 - DNA, 25 bp, Mus musculus
tttgtaatagtgaaccagagccatg

SEQ ID NO: 990728 - DNA, 25 bp, Mus musculus
tttgtaatagtgaagcagagccatg

SEQ ID NO: 990729 - DNA, 25 bp, Mus musculus
tttgtaatctcgcattgtaagggcc

SEQ ID NO: 990730 - DNA, 25 bp, Mus musculus
tttgtaatctcggattgtaagggcc

SEQ ID NO: 990731 - DNA, 25 bp, Mus musculus
tttgtactgaagcacgtatgtttgc

SEQ ID NO: 990732 - DNA, 25 bp, Mus musculus
tttgtactgaagcaggtatgtttgc

SEQ ID NO: 990733 - DNA, 25 bp, Mus musculus
tttgtagaccaaagcccatggccta

SEQ ID NO: 990734 - DNA, 25 bp, Mus musculus
tttgtagaccaactggtgtctacca

SEQ ID NO: 990735 - DNA, 25 bp, Mus musculus
tttgtagaccaagtggtgtctacca

SEQ ID NO: 990736 - DNA, 25 bp, Mus musculus
tttgtagaccaatgcccatggccta

SEQ ID NO: 990737 - DNA, 25 bp, Mus musculus
tttgtagcagtggtcattgatccaa

SEQ ID NO: 990738 - DNA, 25 bp, Mus musculus
tttgtagcagtggtgattgatccaa

SEQ ID NO: 990739 - DNA, 25 bp, Mus musculus
tttgtagtcagtaacctgtggtgta

SEQ ID NO: 990740 - DNA, 25 bp, Mus musculus
tttgtagtcagtaagctgtggtgta

SEQ ID NO: 990741 - DNA, 25 bp, Mus musculus
tttgtatcgacacttctgtaagcat

SEQ ID NO: 990742 - DNA, 25 bp, Mus musculus
tttgtatcgacagttctgtaagcat

SEQ ID NO: 990743 - DNA, 25 bp, Mus musculus
tttgtcaaagatcaattatcatgta

SEQ ID NO: 990744 - DNA, 25 bp, Mus musculus
tttgtcaaagatcatttatcatgta

SEQ ID NO: 990745 - DNA, 25 bp, Mus musculus
tttgtcacaggaccatcagcagcag

SEQ ID NO: 990746 - DNA, 25 bp, Mus musculus
tttgtcacaggagcatcagcagcag

SEQ ID NO: 990747 - DNA, 25 bp, Mus musculus
tttgtcagtcttcacgagatgaagc

SEQ ID NO: 990748 - DNA, 25 bp, Mus musculus
tttgtcagtcttcaggagatgaagc

SEQ ID NO: 990749 - DNA, 25 bp, Mus musculus
tttgtcagtgagctttctgtcaggc

SEQ ID NO: 990750 - DNA, 25 bp, Mus musculus
tttgtcagtgaggtttctgtcaggc

SEQ ID NO: 990751 - DNA, 25 bp, Mus musculus
tttgtcatgaagagcccctttaaca

SEQ ID NO: 990752 - DNA, 25 bp, Mus musculus
tttgtcatgaagtgcccctttaaca

SEQ ID NO: 990753 - DNA, 25 bp, Mus musculus
tttgtcggaggccacttctggtccg

SEQ ID NO: 990754 - DNA, 25 bp, Mus musculus
tttgtcggaggccagttctggtccg

SEQ ID NO: 990755 - DNA, 25 bp, Mus musculus
tttgtctacaagcacaagcgctgta

SEQ ID NO: 990756 - DNA, 25 bp, Mus musculus
tttgtctacaaggacaagcgctgta

SEQ ID NO: 990757 - DNA, 25 bp, Mus musculus
tttgtctgcaagcttcacttgagga

SEQ ID NO: 990758 - DNA, 25 bp, Mus musculus
tttgtctgcaaggttcacttgagga

SEQ ID NO: 990759 - DNA, 25 bp, Mus musculus
tttgtcttgaagaacacccagtgca

SEQ ID NO: 990760 - DNA, 25 bp, Mus musculus
tttgtcttgaagtacacccagtgca

SEQ ID NO: 990761 - DNA, 25 bp, Mus musculus
tttgtctttaagctctctaatagat

SEQ ID NO: 990762 - DNA, 25 bp, Mus musculus
tttgtctttaagctggtgctgatcg

SEQ ID NO: 990763 - DNA, 25 bp, Mus musculus
tttgtctttaaggtctctaatagat

SEQ ID NO: 990764 - DNA, 25 bp, Mus musculus
tttgtctttaaggtggtgctgatcg

SEQ ID NO: 990765 - DNA, 25 bp, Mus musculus
tttgtgaatcatagatgtgacccaa

SEQ ID NO: 990766 - DNA, 25 bp, Mus musculus
tttgtgaatcatagttgtgacccaa

SEQ ID NO: 990767 - DNA, 25 bp, Mus musculus
tttgtgagcctgattgtgggctgtc

SEQ ID NO: 990768 - DNA, 25 bp, Mus musculus
tttgtgagcctgccgctcatgctgt

SEQ ID NO: 990769 - DNA, 25 bp, Mus musculus
tttgtgagcctggcgctcatgctgt

SEQ ID NO: 990770 - DNA, 25 bp, Mus musculus
tttgtgagcctgtttgtgggctgtc

SEQ ID NO: 990771 - DNA, 25 bp, Mus musculus
tttgtgagtgaagaaagtttaggtc

SEQ ID NO: 990772 - DNA, 25 bp, Mus musculus
tttgtgagtgaagaagatcgtaata

SEQ ID NO: 990773 - DNA, 25 bp, Mus musculus
tttgtgagtgaagatagtttaggtc

SEQ ID NO: 990774 - DNA, 25 bp, Mus musculus
tttgtgagtgaagatgatcgtaata

SEQ ID NO: 990775 - DNA, 25 bp, Mus musculus
tttgtgcagttcaaccctccggcct

SEQ ID NO: 990776 - DNA, 25 bp, Mus musculus
tttgtgcagttcaagcctccggcct

SEQ ID NO: 990777 - DNA, 25 bp, Mus musculus
tttgtgccagagaaagagagagacc

SEQ ID NO: 990778 - DNA, 25 bp, Mus musculus
tttgtgccagatcccaccatgggct

SEQ ID NO: 990779 - DNA, 25 bp, Mus musculus
tttgtgccagtgaaagagagagacc

SEQ ID NO: 990780 - DNA, 25 bp, Mus musculus
tttgtgccagttcccaccatgggct

SEQ ID NO: 990781 - DNA, 25 bp, Mus musculus
tttgtgccgcagctcgagatttcag

SEQ ID NO: 990782 - DNA, 25 bp, Mus musculus
tttgtgccgcaggtcgagatttcag

SEQ ID NO: 990783 - DNA, 25 bp, Mus musculus
tttgtgcgagacggcccccttgaga

SEQ ID NO: 990784 - DNA, 25 bp, Mus musculus
tttgtgcgagtcggcccccttgaga

SEQ ID NO: 990785 - DNA, 25 bp, Mus musculus
tttgtgctctctaacggccatgcag

SEQ ID NO: 990786 - DNA, 25 bp, Mus musculus
tttgtgctctctaagggccatgcag

SEQ ID NO: 990787 - DNA, 25 bp, Mus musculus
tttgtgcttggtgacaaggaagagt

SEQ ID NO: 990788 - DNA, 25 bp, Mus musculus
tttgtgcttggtgagaaggaagagt

SEQ ID NO: 990789 - DNA, 25 bp, Mus musculus
tttgtggaaagattcagttcaggag

SEQ ID NO: 990790 - DNA, 25 bp, Mus musculus
tttgtggaaagattgagttcaggag

SEQ ID NO: 990791 - DNA, 25 bp, Mus musculus
tttgtggaagcgatggtgaatgaga

SEQ ID NO: 990792 - DNA, 25 bp, Mus musculus
tttgtggaagcgttggtgaatgaga

SEQ ID NO: 990793 - DNA, 25 bp, Mus musculus
tttgtggcagacttcccaggccaag

SEQ ID NO: 990794 - DNA, 25 bp, Mus musculus
tttgtggcagactttcagccaactc

SEQ ID NO: 990795 - DNA, 25 bp, Mus musculus
tttgtggcagtcttcccaggccaag

SEQ ID NO: 990796 - DNA, 25 bp, Mus musculus
tttgtggcagtctttcagccaactc

SEQ ID NO: 990797 - DNA, 25 bp, Mus musculus
tttgtggcccagcatgacaacgagt

SEQ ID NO: 990798 - DNA, 25 bp, Mus musculus
tttgtggcccaggatgacaacgagt

SEQ ID NO: 990799 - DNA, 25 bp, Mus musculus
tttgtgggcaaacgtattgacttca

SEQ ID NO: 990800 - DNA, 25 bp, Mus musculus
tttgtgggcaaaggtattgacttca

SEQ ID NO: 990801 - DNA, 25 bp, Mus musculus
tttgtgggcccacttggctttggcc

SEQ ID NO: 990802 - DNA, 25 bp, Mus musculus
tttgtgggcccagttggctttggcc

SEQ ID NO: 990803 - DNA, 25 bp, Mus musculus
tttgtggtggccggacctggctcag

SEQ ID NO: 990804 - DNA, 25 bp, Mus musculus
tttgtggtgggcggacctggctcag

SEQ ID NO: 990805 - DNA, 25 bp, Mus musculus
tttgtgtcagaggacgaaagggcat

SEQ ID NO: 990806 - DNA, 25 bp, Mus musculus
tttgtgtcagaggaggaaagggcat

SEQ ID NO: 990807 - DNA, 25 bp, Mus musculus
tttgtgtcttcacaaatgcagctct

SEQ ID NO: 990808 - DNA, 25 bp, Mus musculus
tttgtgtcttcagaaatgcagctct

SEQ ID NO: 990809 - DNA, 25 bp, Mus musculus
tttgtgttgaagctgcaggaccaga

SEQ ID NO: 990810 - DNA, 25 bp, Mus musculus
tttgtgttgaaggtgcaggaccaga

SEQ ID NO: 990811 - DNA, 25 bp, Mus musculus
tttgttaaagccaacggccattctc

SEQ ID NO: 990812 - DNA, 25 bp, Mus musculus
tttgttaaagccaagggccattctc

SEQ ID NO: 990813 - DNA, 25 bp, Mus musculus
tttgttatgccactcaggatttgca

SEQ ID NO: 990814 - DNA, 25 bp, Mus musculus
tttgttatgccagtcaggatttgca

SEQ ID NO: 990815 - DNA, 25 bp, Mus musculus
tttgttcaaaagagcatgggctcac

SEQ ID NO: 990816 - DNA, 25 bp, Mus musculus
tttgttcaaaagtgcatgggctcac

SEQ ID NO: 990817 - DNA, 25 bp, Mus musculus
tttgttccataacggtcctgtgatc

SEQ ID NO: 990818 - DNA, 25 bp, Mus musculus
tttgttccataagggtcctgtgatc

SEQ ID NO: 990819 - DNA, 25 bp, Mus musculus
tttgttcccaggcaaattccatcaa

SEQ ID NO: 990820 - DNA, 25 bp, Mus musculus
tttgttcccagggaaattccatcaa

SEQ ID NO: 990821 - DNA, 25 bp, Mus musculus
tttgttcgtggacgtggagcctact

SEQ ID NO: 990822 - DNA, 25 bp, Mus musculus
tttgttcgtggaggtggagcctact

SEQ ID NO: 990823 - DNA, 25 bp, Mus musculus
tttgttgcccagcttctcctgtgtg

SEQ ID NO: 990824 - DNA, 25 bp, Mus musculus
tttgttgcccaggttctcctgtgtg

SEQ ID NO: 990825 - DNA, 25 bp, Mus musculus
tttgttggagcctttctgtctcaac

SEQ ID NO: 990826 - DNA, 25 bp, Mus musculus
tttgttggaggctttctgtctcaac

SEQ ID NO: 990827 - DNA, 25 bp, Mus musculus
tttgttggcagactgaacctgatgg

SEQ ID NO: 990828 - DNA, 25 bp, Mus musculus
tttgttggcagagtgaacctgatgg

SEQ ID NO: 990829 - DNA, 25 bp, Mus musculus
tttgtttccccacatcctgtcttcc

SEQ ID NO: 990830 - DNA, 25 bp, Mus musculus
tttgtttccccagatcctgtcttcc

SEQ ID NO: 990831 - DNA, 25 bp, Mus musculus
tttgtttggaaacgcaagcaggcca

SEQ ID NO: 990832 - DNA, 25 bp, Mus musculus
tttgtttggaaaggcaagcaggcca

SEQ ID NO: 990833 - DNA, 25 bp, Mus musculus
tttgtttttaggctgcagccggaag

SEQ ID NO: 990834 - DNA, 25 bp, Mus musculus
tttgtttttagggtgcagccggaag

SEQ ID NO: 990835 - DNA, 25 bp, Mus musculus
ttttaaaatacaccgtatgcatgca

SEQ ID NO: 990836 - DNA, 25 bp, Mus musculus
ttttaaaatacagcgtatgcatgca

SEQ ID NO: 990837 - DNA, 25 bp, Mus musculus
ttttaaagagatgattccagaattc

SEQ ID NO: 990838 - DNA, 25 bp, Mus musculus
ttttaaagagttgattccagaattc

SEQ ID NO: 990839 - DNA, 25 bp, Mus musculus
ttttaaatcccactttggtgccttg

SEQ ID NO: 990840 - DNA, 25 bp, Mus musculus
ttttaaatcccagtttggtgccttg

SEQ ID NO: 990841 - DNA, 25 bp, Mus musculus
ttttaacaagctgaactgaagattt

SEQ ID NO: 990842 - DNA, 25 bp, Mus musculus
ttttaacaaggtgaactgaagattt

SEQ ID NO: 990843 - DNA, 25 bp, Mus musculus
ttttaactgagaaacatctccaaga

SEQ ID NO: 990844 - DNA, 25 bp, Mus musculus
ttttaactgagaaagatctccaaga

SEQ ID NO: 990845 - DNA, 25 bp, Mus musculus
ttttaatcagttcaagtctgttatc

SEQ ID NO: 990846 - DNA, 25 bp, Mus musculus
ttttaatcagttcatgtctgttatc

SEQ ID NO: 990847 - DNA, 25 bp, Mus musculus
ttttacacacagcatttaattgtga

SEQ ID NO: 990848 - DNA, 25 bp, Mus musculus
ttttacacacaggatttaattgtga

SEQ ID NO: 990849 - DNA, 25 bp, Mus musculus
ttttacacatcaaacgtttggtgta

SEQ ID NO: 990850 - DNA, 25 bp, Mus musculus
ttttacacatcaaaggtttggtgta

SEQ ID NO: 990851 - DNA, 25 bp, Mus musculus
ttttacagaagacacgaacccgctt

SEQ ID NO: 990852 - DNA, 25 bp, Mus musculus
ttttacagaagacaggaacccgctt

SEQ ID NO: 990853 - DNA, 25 bp, Mus musculus
ttttacagagatcctgggtgtttgg

SEQ ID NO: 990854 - DNA, 25 bp, Mus musculus
ttttacagagttcctgggtgtttgg

SEQ ID NO: 990855 - DNA, 25 bp, Mus musculus
ttttacataaaccccagatgcagat

SEQ ID NO: 990856 - DNA, 25 bp, Mus musculus
ttttacataatccccagatgcagat

SEQ ID NO: 990857 - DNA, 25 bp, Mus musculus
ttttacatcaaacgcaagaaattct

SEQ ID NO: 990858 - DNA, 25 bp, Mus musculus
ttttacatcaaaggcaagaaattct

SEQ ID NO: 990859 - DNA, 25 bp, Mus musculus
ttttacattgcaatcgatgagtttc

SEQ ID NO: 990860 - DNA, 25 bp, Mus musculus
ttttacattgcaatggatgagtttc

SEQ ID NO: 990861 - DNA, 25 bp, Mus musculus
ttttacatttctcataatccttcaa

SEQ ID NO: 990862 - DNA, 25 bp, Mus musculus
ttttacatttgtcataatccttcaa

SEQ ID NO: 990863 - DNA, 25 bp, Mus musculus
ttttactacaagcaagctgcccaag

SEQ ID NO: 990864 - DNA, 25 bp, Mus musculus
ttttactacaaggaagctgcccaag

SEQ ID NO: 990865 - DNA, 25 bp, Mus musculus
ttttagagatgacgctggaggggta

SEQ ID NO: 990866 - DNA, 25 bp, Mus musculus
ttttagagatgaggctggaggggta

SEQ ID NO: 990867 - DNA, 25 bp, Mus musculus
ttttagccaccacgacacagaatgt

SEQ ID NO: 990868 - DNA, 25 bp, Mus musculus
ttttagccaccaggacacagaatgt

SEQ ID NO: 990869 - DNA, 25 bp, Mus musculus
ttttaggtcgagaatccttagacga

SEQ ID NO: 990870 - DNA, 25 bp, Mus musculus
ttttaggtcgagtatccttagacga

SEQ ID NO: 990871 - DNA, 25 bp, Mus musculus
ttttataacaaactcgatgcagaga

SEQ ID NO: 990872 - DNA, 25 bp, Mus musculus
ttttataacaaactggatgcagaga

SEQ ID NO: 990873 - DNA, 25 bp, Mus musculus
ttttatacagcactgacagacgaag

SEQ ID NO: 990874 - DNA, 25 bp, Mus musculus
ttttatacaggactgacagacgaag

SEQ ID NO: 990875 - DNA, 25 bp, Mus musculus
ttttatcacacacgaactgaagagg

SEQ ID NO: 990876 - DNA, 25 bp, Mus musculus
ttttatcacacaggaactgaagagg

SEQ ID NO: 990877 - DNA, 25 bp, Mus musculus
ttttatccagcaatcatgttcgtgt

SEQ ID NO: 990878 - DNA, 25 bp, Mus musculus
ttttatccagcaatgatgttcgtgt

SEQ ID NO: 990879 - DNA, 25 bp, Mus musculus
ttttatcctgctctctaataaagaa

SEQ ID NO: 990880 - DNA, 25 bp, Mus musculus
ttttatcctggtctctaataaagaa

SEQ ID NO: 990881 - DNA, 25 bp, Mus musculus
ttttatcctgtgctgtgagtgttga

SEQ ID NO: 990882 - DNA, 25 bp, Mus musculus
ttttatcctgtggtgtgagtgttga

SEQ ID NO: 990883 - DNA, 25 bp, Mus musculus
ttttatctccacaggattaaaatat

SEQ ID NO: 990884 - DNA, 25 bp, Mus musculus
ttttatctccactggattaaaatat

SEQ ID NO: 990885 - DNA, 25 bp, Mus musculus
ttttatgagcagcctataactactc

SEQ ID NO: 990886 - DNA, 25 bp, Mus musculus
ttttatgagcaggctataactactc

SEQ ID NO: 990887 - DNA, 25 bp, Mus musculus
ttttatgctttacgtgaaggcgata

SEQ ID NO: 990888 - DNA, 25 bp, Mus musculus
ttttatgctttaggtgaaggcgata

SEQ ID NO: 990889 - DNA, 25 bp, Mus musculus
ttttattatacacgacacagtgatg

SEQ ID NO: 990890 - DNA, 25 bp, Mus musculus
ttttattatacaggacacagtgatg

SEQ ID NO: 990891 - DNA, 25 bp, Mus musculus
ttttattcatatttctggatatgcc

SEQ ID NO: 990892 - DNA, 25 bp, Mus musculus
ttttattcatccaacaactatttgg

SEQ ID NO: 990893 - DNA, 25 bp, Mus musculus
ttttattcatccttaggtggagaaa

SEQ ID NO: 990894 - DNA, 25 bp, Mus musculus
ttttattcatgcaacaactatttgg

SEQ ID NO: 990895 - DNA, 25 bp, Mus musculus
ttttattcatgcttaggtggagaaa

SEQ ID NO: 990896 - DNA, 25 bp, Mus musculus
ttttattcatttttctggatatgcc

SEQ ID NO: 990897 - DNA, 25 bp, Mus musculus
ttttattcggctcaacagagcattt

SEQ ID NO: 990898 - DNA, 25 bp, Mus musculus
ttttattcgggtcaacagagcattt

SEQ ID NO: 990899 - DNA, 25 bp, Mus musculus
ttttattttggacgttgtccagaca

SEQ ID NO: 990900 - DNA, 25 bp, Mus musculus
ttttattttggaggttgtccagaca

SEQ ID NO: 990901 - DNA, 25 bp, Mus musculus
ttttcaaaccaaagatagcagagat

SEQ ID NO: 990902 - DNA, 25 bp, Mus musculus
ttttcaaaccaatgatagcagagat

SEQ ID NO: 990903 - DNA, 25 bp, Mus musculus
ttttcaacagagacgaagagcgata

SEQ ID NO: 990904 - DNA, 25 bp, Mus musculus
ttttcaacagtgacgaagagcgata

SEQ ID NO: 990905 - DNA, 25 bp, Mus musculus
ttttcaaccataactatttcaagaa

SEQ ID NO: 990906 - DNA, 25 bp, Mus musculus
ttttcaaccatatctatttcaagaa

SEQ ID NO: 990907 - DNA, 25 bp, Mus musculus
ttttcaagtcaacacgcatcaacta

SEQ ID NO: 990908 - DNA, 25 bp, Mus musculus
ttttcaagtcaacaggcatcaacta

SEQ ID NO: 990909 - DNA, 25 bp, Mus musculus
ttttcaataaagctgatgagtacac

SEQ ID NO: 990910 - DNA, 25 bp, Mus musculus
ttttcaataaaggtgatgagtacac

SEQ ID NO: 990911 - DNA, 25 bp, Mus musculus
ttttcacaaactggctacaggatgt

SEQ ID NO: 990912 - DNA, 25 bp, Mus musculus
ttttcacaaagtggctacaggatgt

SEQ ID NO: 990913 - DNA, 25 bp, Mus musculus
ttttcacagtagcctattgcagacc

SEQ ID NO: 990914 - DNA, 25 bp, Mus musculus
ttttcacagtaggctattgcagacc

SEQ ID NO: 990915 - DNA, 25 bp, Mus musculus
ttttcacctctaagaagtaaatggt

SEQ ID NO: 990916 - DNA, 25 bp, Mus musculus
ttttcacctctatgaagtaaatggt

SEQ ID NO: 990917 - DNA, 25 bp, Mus musculus
ttttcacttctcctccactctgggc

SEQ ID NO: 990918 - DNA, 25 bp, Mus musculus
ttttcacttctcctgcactctgggc

SEQ ID NO: 990919 - DNA, 25 bp, Mus musculus
ttttcagcaactcgtcaatttttca

SEQ ID NO: 990920 - DNA, 25 bp, Mus musculus
ttttcagcaactggtcaatttttca

SEQ ID NO: 990921 - DNA, 25 bp, Mus musculus
ttttcagctgtaatcgtgcgtctaa

SEQ ID NO: 990922 - DNA, 25 bp, Mus musculus
ttttcagctgtaatggtgcgtctaa

SEQ ID NO: 990923 - DNA, 25 bp, Mus musculus
ttttcataggatggatgatacatgg

SEQ ID NO: 990924 - DNA, 25 bp, Mus musculus
ttttcataggttggatgatacatgg

SEQ ID NO: 990925 - DNA, 25 bp, Mus musculus
ttttcatccacgtggatcgcactcg

SEQ ID NO: 990926 - DNA, 25 bp, Mus musculus
ttttcatccaggtggatcgcactcg

SEQ ID NO: 990927 - DNA, 25 bp, Mus musculus
ttttcatcccagctctgtcgggttg

SEQ ID NO: 990928 - DNA, 25 bp, Mus musculus
ttttcatcccaggtctgtcgggttg

SEQ ID NO: 990929 - DNA, 25 bp, Mus musculus
ttttcattccatagtgagttcttag

SEQ ID NO: 990930 - DNA, 25 bp, Mus musculus
ttttcattccattgtgagttcttag

SEQ ID NO: 990931 - DNA, 25 bp, Mus musculus
ttttccaatatgcctttatcctctt

SEQ ID NO: 990932 - DNA, 25 bp, Mus musculus
ttttccaatatggctttatcctctt

SEQ ID NO: 990933 - DNA, 25 bp, Mus musculus
ttttccaatctgacttgtcaaaacg

SEQ ID NO: 990934 - DNA, 25 bp, Mus musculus
ttttccaatctgtcttgtcaaaacg

SEQ ID NO: 990935 - DNA, 25 bp, Mus musculus
ttttcccagcagcgttagcataaaa

SEQ ID NO: 990936 - DNA, 25 bp, Mus musculus
ttttcccagcagggttagcataaaa

SEQ ID NO: 990937 - DNA, 25 bp, Mus musculus
ttttcccatccctacatccagtccc

SEQ ID NO: 990938 - DNA, 25 bp, Mus musculus
ttttcccatccctagatccagtccc

SEQ ID NO: 990939 - DNA, 25 bp, Mus musculus
ttttccctctagatgtgagcggcca

SEQ ID NO: 990940 - DNA, 25 bp, Mus musculus
ttttccctctagttgtgagcggcca

SEQ ID NO: 990941 - DNA, 25 bp, Mus musculus
ttttccctgcaatacaaaggaccta

SEQ ID NO: 990942 - DNA, 25 bp, Mus musculus
ttttccctgcaatagaaaggaccta

SEQ ID NO: 990943 - DNA, 25 bp, Mus musculus
ttttcctacagacagaacctggagg

SEQ ID NO: 990944 - DNA, 25 bp, Mus musculus
ttttcctacagagagaacctggagg

SEQ ID NO: 990945 - DNA, 25 bp, Mus musculus
ttttcctgcaagagtgtggctggct

SEQ ID NO: 990946 - DNA, 25 bp, Mus musculus
ttttcctgcaagtgtgtggctggct

SEQ ID NO: 990947 - DNA, 25 bp, Mus musculus
ttttcctgggcacacaccgcgggac

SEQ ID NO: 990948 - DNA, 25 bp, Mus musculus
ttttcctgggcacagaccgcgggac

SEQ ID NO: 990949 - DNA, 25 bp, Mus musculus
ttttcctttgagaccatcagcagtg

SEQ ID NO: 990950 - DNA, 25 bp, Mus musculus
ttttcctttgagtccatcagcagtg

SEQ ID NO: 990951 - DNA, 25 bp, Mus musculus
ttttcctttggaaaagttgctgtgg

SEQ ID NO: 990952 - DNA, 25 bp, Mus musculus
ttttcctttggaaatgttgctgtgg

SEQ ID NO: 990953 - DNA, 25 bp, Mus musculus
ttttcggaagacagcgtggaagatg

SEQ ID NO: 990954 - DNA, 25 bp, Mus musculus
ttttcggaagtcagcgtggaagatg

SEQ ID NO: 990955 - DNA, 25 bp, Mus musculus
ttttcggcactgagacatctccagc

SEQ ID NO: 990956 - DNA, 25 bp, Mus musculus
ttttcggcactgtgacatctccagc

SEQ ID NO: 990957 - DNA, 25 bp, Mus musculus
ttttcggctgcacgtcgactgtgtc

SEQ ID NO: 990958 - DNA, 25 bp, Mus musculus
ttttcggctggacgtcgactgtgtc

SEQ ID NO: 990959 - DNA, 25 bp, Mus musculus
ttttcgtggcagcacatacgtgtga

SEQ ID NO: 990960 - DNA, 25 bp, Mus musculus
ttttcgtggcagcagatacgtgtga

SEQ ID NO: 990961 - DNA, 25 bp, Mus musculus
ttttctaacctggacaatgccctgg

SEQ ID NO: 990962 - DNA, 25 bp, Mus musculus
ttttctaacctggagaatgccctgg

SEQ ID NO: 990963 - DNA, 25 bp, Mus musculus
ttttctaagtcgcacgtagaatgga

SEQ ID NO: 990964 - DNA, 25 bp, Mus musculus
ttttctaagtcgcaggtagaatgga

SEQ ID NO: 990965 - DNA, 25 bp, Mus musculus
ttttctacagcaagagcagtgaaga

SEQ ID NO: 990966 - DNA, 25 bp, Mus musculus
ttttctacaggaagagcagtgaaga

SEQ ID NO: 990967 - DNA, 25 bp, Mus musculus
ttttctatgaagctattctacttcc

SEQ ID NO: 990968 - DNA, 25 bp, Mus musculus
ttttctatgaaggtattctacttcc

SEQ ID NO: 990969 - DNA, 25 bp, Mus musculus
ttttctccagaactggaggaggtgg

SEQ ID NO: 990970 - DNA, 25 bp, Mus musculus
ttttctccagaagtggaggaggtgg

SEQ ID NO: 990971 - DNA, 25 bp, Mus musculus
ttttctcccaaaaacactcctcatc

SEQ ID NO: 990972 - DNA, 25 bp, Mus musculus
ttttctcccaaaaagactcctcatc

SEQ ID NO: 990973 - DNA, 25 bp, Mus musculus
ttttctgaatcacggagtcaaagtg

SEQ ID NO: 990974 - DNA, 25 bp, Mus musculus
ttttctgaatcacgtgtcgagtgtc

SEQ ID NO: 990975 - DNA, 25 bp, Mus musculus
ttttctgaatcagggagtcaaagtg

SEQ ID NO: 990976 - DNA, 25 bp, Mus musculus
ttttctgaatcaggtgtcgagtgtc

SEQ ID NO: 990977 - DNA, 25 bp, Mus musculus
ttttctggaacaccctatatgctca

SEQ ID NO: 990978 - DNA, 25 bp, Mus musculus
ttttctggaacagcctatatgctca

SEQ ID NO: 990979 - DNA, 25 bp, Mus musculus
ttttctggagagacactagcagact

SEQ ID NO: 990980 - DNA, 25 bp, Mus musculus
ttttctggagtgacactagcagact

SEQ ID NO: 990981 - DNA, 25 bp, Mus musculus
ttttctggataacagtgcctcgggc

SEQ ID NO: 990982 - DNA, 25 bp, Mus musculus
ttttctggataaccccacctggaag

SEQ ID NO: 990983 - DNA, 25 bp, Mus musculus
ttttctggataacgtgcttctgtgt

SEQ ID NO: 990984 - DNA, 25 bp, Mus musculus
ttttctggataagagtgcctcgggc

SEQ ID NO: 990985 - DNA, 25 bp, Mus musculus
ttttctggataagcccacctggaag

SEQ ID NO: 990986 - DNA, 25 bp, Mus musculus
ttttctggataaggtgcttctgtgt

SEQ ID NO: 990987 - DNA, 25 bp, Mus musculus
ttttctggatggatcattgctcaag

SEQ ID NO: 990988 - DNA, 25 bp, Mus musculus
ttttctggatggttcattgctcaag

SEQ ID NO: 990989 - DNA, 25 bp, Mus musculus
ttttctgtcaagacaccatgattcc

SEQ ID NO: 990990 - DNA, 25 bp, Mus musculus
ttttctgtcatgacaccatgattcc

SEQ ID NO: 990991 - DNA, 25 bp, Mus musculus
ttttcttcacatattccatgccatt

SEQ ID NO: 990992 - DNA, 25 bp, Mus musculus
ttttcttcacattttccatgccatt

SEQ ID NO: 990993 - DNA, 25 bp, Mus musculus
ttttcttccacactgcctccggagc

SEQ ID NO: 990994 - DNA, 25 bp, Mus musculus
ttttcttccacagtgcctccggagc

SEQ ID NO: 990995 - DNA, 25 bp, Mus musculus
ttttcttctgatgacctgggaagtc

SEQ ID NO: 990996 - DNA, 25 bp, Mus musculus
ttttcttctgatgagctgggaagtc

SEQ ID NO: 990997 - DNA, 25 bp, Mus musculus
ttttcttcttctctcgacgtcaaat

SEQ ID NO: 990998 - DNA, 25 bp, Mus musculus
ttttcttcttctctggacgtcaaat

SEQ ID NO: 990999 - DNA, 25 bp, Mus musculus
ttttctttactacgctgattgagtc

SEQ ID NO: 991000 - DNA, 25 bp, Mus musculus
ttttctttactaggctgattgagtc

SEQ ID NO: 991001 - DNA, 25 bp, Mus musculus
ttttctttactgaaaataagtacca

SEQ ID NO: 991002 - DNA, 25 bp, Mus musculus
ttttctttactgaatataagtacca

SEQ ID NO: 991003 - DNA, 25 bp, Mus musculus
ttttgaaaagatccaatctgagtcc

SEQ ID NO: 991004 - DNA, 25 bp, Mus musculus
ttttgaaaagttccaatctgagtcc

SEQ ID NO: 991005 - DNA, 25 bp, Mus musculus
ttttgaaaataaatggcaaccagaa

SEQ ID NO: 991006 - DNA, 25 bp, Mus musculus
ttttgaaaataattggcaaccagaa

SEQ ID NO: 991007 - DNA, 25 bp, Mus musculus
ttttgaaacatgcacgtatgggttc

SEQ ID NO: 991008 - DNA, 25 bp, Mus musculus
ttttgaaacatgcaggtatgggttc

SEQ ID NO: 991009 - DNA, 25 bp, Mus musculus
ttttgaatcgcagacagttccctcc

SEQ ID NO: 991010 - DNA, 25 bp, Mus musculus
ttttgaatcggagacagttccctcc

SEQ ID NO: 991011 - DNA, 25 bp, Mus musculus
ttttgaatgaaacaagattttggta

SEQ ID NO: 991012 - DNA, 25 bp, Mus musculus
ttttgaatgaaacatgattttggta

SEQ ID NO: 991013 - DNA, 25 bp, Mus musculus
ttttgacaagaagcagacaggcagc

SEQ ID NO: 991014 - DNA, 25 bp, Mus musculus
ttttgacaagcaccatggcggggca

SEQ ID NO: 991015 - DNA, 25 bp, Mus musculus
ttttgacaagccacggcaagctgcc

SEQ ID NO: 991016 - DNA, 25 bp, Mus musculus
ttttgacaaggaccatggcggggca

SEQ ID NO: 991017 - DNA, 25 bp, Mus musculus
ttttgacaaggcacggcaagctgcc

SEQ ID NO: 991018 - DNA, 25 bp, Mus musculus
ttttgacaagtagcagacaggcagc

SEQ ID NO: 991019 - DNA, 25 bp, Mus musculus
ttttgacggcatttgctaatggtcg

SEQ ID NO: 991020 - DNA, 25 bp, Mus musculus
ttttgacggcttttgctaatggtcg

SEQ ID NO: 991021 - DNA, 25 bp, Mus musculus
ttttgactttcccagcgcagactta

SEQ ID NO: 991022 - DNA, 25 bp, Mus musculus
ttttgactttgccagcgcagactta

SEQ ID NO: 991023 - DNA, 25 bp, Mus musculus
ttttgagaagcatgatgacagcaat

SEQ ID NO: 991024 - DNA, 25 bp, Mus musculus
ttttgagaaggatgatgacagcaat

SEQ ID NO: 991025 - DNA, 25 bp, Mus musculus
ttttgagacgcgtgctcggcaccca

SEQ ID NO: 991026 - DNA, 25 bp, Mus musculus
ttttgagacgggtgctcggcaccca

SEQ ID NO: 991027 - DNA, 25 bp, Mus musculus
ttttgagaggggcacgtggcagctc

SEQ ID NO: 991028 - DNA, 25 bp, Mus musculus
ttttgagaggggcaggtggcagctc

SEQ ID NO: 991029 - DNA, 25 bp, Mus musculus
ttttgaggctatcagtgacgaggag

SEQ ID NO: 991030 - DNA, 25 bp, Mus musculus
ttttgaggctttcagtgacgaggag

SEQ ID NO: 991031 - DNA, 25 bp, Mus musculus
ttttgataggaacgcagtaatagtg

SEQ ID NO: 991032 - DNA, 25 bp, Mus musculus
ttttgataggtacgcagtaatagtg

SEQ ID NO: 991033 - DNA, 25 bp, Mus musculus
ttttgatgaaaaaggagtgctgaaa

SEQ ID NO: 991034 - DNA, 25 bp, Mus musculus
ttttgatgaaaatggagtgctgaaa

SEQ ID NO: 991035 - DNA, 25 bp, Mus musculus
ttttgatgcagaagtgctttgtcta

SEQ ID NO: 991036 - DNA, 25 bp, Mus musculus
ttttgatgcagatgtgctttgtcta

SEQ ID NO: 991037 - DNA, 25 bp, Mus musculus
ttttgcaaaatatgcacatcccaat

SEQ ID NO: 991038 - DNA, 25 bp, Mus musculus
ttttgcaaaatatggacatcccaat

SEQ ID NO: 991039 - DNA, 25 bp, Mus musculus
ttttgcacaaagctttgtggtgaac

SEQ ID NO: 991040 - DNA, 25 bp, Mus musculus
ttttgcacaaaggtttgtggtgaac

SEQ ID NO: 991041 - DNA, 25 bp, Mus musculus
ttttgcagagctttcctggcagaac

SEQ ID NO: 991042 - DNA, 25 bp, Mus musculus
ttttgcagaggtttcctggcagaac

SEQ ID NO: 991043 - DNA, 25 bp, Mus musculus
ttttgccaaagtcataccgatggca

SEQ ID NO: 991044 - DNA, 25 bp, Mus musculus
ttttgccaaagtgataccgatggca

SEQ ID NO: 991045 - DNA, 25 bp, Mus musculus
ttttgcggagggccaaccaactcca

SEQ ID NO: 991046 - DNA, 25 bp, Mus musculus
ttttgcggagggcctaccaactcca

SEQ ID NO: 991047 - DNA, 25 bp, Mus musculus
ttttgctaatctacctgtttcctag

SEQ ID NO: 991048 - DNA, 25 bp, Mus musculus
ttttgctaatgtacctgtttcctag

SEQ ID NO: 991049 - DNA, 25 bp, Mus musculus
ttttgctatgcccagacttcatagt

SEQ ID NO: 991050 - DNA, 25 bp, Mus musculus
ttttgctatgccgagacttcatagt

SEQ ID NO: 991051 - DNA, 25 bp, Mus musculus
ttttgctctagacaatggacagcaa

SEQ ID NO: 991052 - DNA, 25 bp, Mus musculus
ttttgctctagagaatggacagcaa

SEQ ID NO: 991053 - DNA, 25 bp, Mus musculus
ttttgctgaagcatcaacaggcaga

SEQ ID NO: 991054 - DNA, 25 bp, Mus musculus
ttttgctgaagcttcaacaggcaga

SEQ ID NO: 991055 - DNA, 25 bp, Mus musculus
ttttgctgagctaaatagcgataag

SEQ ID NO: 991056 - DNA, 25 bp, Mus musculus
ttttgctgaggtaaatagcgataag

SEQ ID NO: 991057 - DNA, 25 bp, Mus musculus
ttttggaagtcaagtttggtgagcg

SEQ ID NO: 991058 - DNA, 25 bp, Mus musculus
ttttggaagtgaagtttggtgagcg

SEQ ID NO: 991059 - DNA, 25 bp, Mus musculus
ttttggagattgcggcctgtgtttt

SEQ ID NO: 991060 - DNA, 25 bp, Mus musculus
ttttggagattggggcctgtgtttt

SEQ ID NO: 991061 - DNA, 25 bp, Mus musculus
ttttggatcttcagaaatactggga

SEQ ID NO: 991062 - DNA, 25 bp, Mus musculus
ttttggatcttcagtaatactggga

SEQ ID NO: 991063 - DNA, 25 bp, Mus musculus
ttttggcagcttcacattcccttca

SEQ ID NO: 991064 - DNA, 25 bp, Mus musculus
ttttggcagcttcagattcccttca

SEQ ID NO: 991065 - DNA, 25 bp, Mus musculus
ttttggccgcagcttctctccacta

SEQ ID NO: 991066 - DNA, 25 bp, Mus musculus
ttttggccgcaggttctctccacta

SEQ ID NO: 991067 - DNA, 25 bp, Mus musculus
ttttggctggagcacgttcatccct

SEQ ID NO: 991068 - DNA, 25 bp, Mus musculus
ttttggctggagcaggttcatccct

SEQ ID NO: 991069 - DNA, 25 bp, Mus musculus
ttttgggtccgccacatcttcattc

SEQ ID NO: 991070 - DNA, 25 bp, Mus musculus
ttttgggtccgccagatcttcattc

SEQ ID NO: 991071 - DNA, 25 bp, Mus musculus
ttttgggttacccagagcttttgct

SEQ ID NO: 991072 - DNA, 25 bp, Mus musculus
ttttgggttaccgagagcttttgct

SEQ ID NO: 991073 - DNA, 25 bp, Mus musculus
ttttgggttgagcttttgggcagct

SEQ ID NO: 991074 - DNA, 25 bp, Mus musculus
ttttgggttgaggttttgggcagct

SEQ ID NO: 991075 - DNA, 25 bp, Mus musculus
ttttggtatcaacgtcccgtcaggc

SEQ ID NO: 991076 - DNA, 25 bp, Mus musculus
ttttggtatcaaggtcccgtcaggc

SEQ ID NO: 991077 - DNA, 25 bp, Mus musculus
ttttggtcttaccgtaccagccaga

SEQ ID NO: 991078 - DNA, 25 bp, Mus musculus
ttttggtcttacggtaccagccaga

SEQ ID NO: 991079 - DNA, 25 bp, Mus musculus
ttttggtgaatacaccgacagtgat

SEQ ID NO: 991080 - DNA, 25 bp, Mus musculus
ttttggtgaatacagcgacagtgat

SEQ ID NO: 991081 - DNA, 25 bp, Mus musculus
ttttgtcatgaacagcccctttaac

SEQ ID NO: 991082 - DNA, 25 bp, Mus musculus
ttttgtcatgaagagcccctttaac

SEQ ID NO: 991083 - DNA, 25 bp, Mus musculus
ttttgtctgcaaccttcacttgagg

SEQ ID NO: 991084 - DNA, 25 bp, Mus musculus
ttttgtctgcaagcttcacttgagg

SEQ ID NO: 991085 - DNA, 25 bp, Mus musculus
ttttgtgaagagtacccagtattac

SEQ ID NO: 991086 - DNA, 25 bp, Mus musculus
ttttgtgaagcctggatggtggagt

SEQ ID NO: 991087 - DNA, 25 bp, Mus musculus
ttttgtgaaggctggatggtggagt

SEQ ID NO: 991088 - DNA, 25 bp, Mus musculus
ttttgtgaagtgtacccagtattac

SEQ ID NO: 991089 - DNA, 25 bp, Mus musculus
ttttgtgcagagattaagcacatga

SEQ ID NO: 991090 - DNA, 25 bp, Mus musculus
ttttgtgcagagtttaagcacatga

SEQ ID NO: 991091 - DNA, 25 bp, Mus musculus
ttttgtgcagcatctgctgatgatg

SEQ ID NO: 991092 - DNA, 25 bp, Mus musculus
ttttgtgcagcttacctgtggttct

SEQ ID NO: 991093 - DNA, 25 bp, Mus musculus
ttttgtgcaggatctgctgatgatg

SEQ ID NO: 991094 - DNA, 25 bp, Mus musculus
ttttgtgcaggttacctgtggttct

SEQ ID NO: 991095 - DNA, 25 bp, Mus musculus
ttttgtgccgcacgtcgagatttca

SEQ ID NO: 991096 - DNA, 25 bp, Mus musculus
ttttgtgccgcaggtcgagatttca

SEQ ID NO: 991097 - DNA, 25 bp, Mus musculus
ttttgtggacagaatttttgaacaa

SEQ ID NO: 991098 - DNA, 25 bp, Mus musculus
ttttgtggacagcttggtttaatga

SEQ ID NO: 991099 - DNA, 25 bp, Mus musculus
ttttgtggacaggttggtttaatga

SEQ ID NO: 991100 - DNA, 25 bp, Mus musculus
ttttgtggacagtatttttgaacaa

SEQ ID NO: 991101 - DNA, 25 bp, Mus musculus
ttttgtggccagaggggctgaagat

SEQ ID NO: 991102 - DNA, 25 bp, Mus musculus
ttttgtggccagtggggctgaagat

SEQ ID NO: 991103 - DNA, 25 bp, Mus musculus
ttttgtgtacagccctgaccaggtg

SEQ ID NO: 991104 - DNA, 25 bp, Mus musculus
ttttgtgtacaggcctgaccaggtg

SEQ ID NO: 991105 - DNA, 25 bp, Mus musculus
ttttgttgctttcccagcactatgg

SEQ ID NO: 991106 - DNA, 25 bp, Mus musculus
ttttgttgctttgccagcactatgg

SEQ ID NO: 991107 - DNA, 25 bp, Mus musculus
ttttgttttgatatgaatgcaggaa

SEQ ID NO: 991108 - DNA, 25 bp, Mus musculus
ttttgttttgttatgaatgcaggaa

SEQ ID NO: 991109 - DNA, 25 bp, Mus musculus
tttttaacagattagttcataaagg

SEQ ID NO: 991110 - DNA, 25 bp, Mus musculus
tttttaacagtttagttcataaagg

SEQ ID NO: 991111 - DNA, 25 bp, Mus musculus
tttttaagcatgaaaaagaagatgg

SEQ ID NO: 991112 - DNA, 25 bp, Mus musculus
tttttaagcatgtaaaagaagatgg

SEQ ID NO: 991113 - DNA, 25 bp, Mus musculus
tttttaatcactctgttatctccta

SEQ ID NO: 991114 - DNA, 25 bp, Mus musculus
tttttaatcagtctgttatctccta

SEQ ID NO: 991115 - DNA, 25 bp, Mus musculus
tttttaatgactctctttggtttgt

SEQ ID NO: 991116 - DNA, 25 bp, Mus musculus
tttttaatgactgtctttggtttgt

SEQ ID NO: 991117 - DNA, 25 bp, Mus musculus
tttttaatgatgaggtccttctgta

SEQ ID NO: 991118 - DNA, 25 bp, Mus musculus
tttttaatgatgtggtccttctgta

SEQ ID NO: 991119 - DNA, 25 bp, Mus musculus
tttttacaaactgattggagttgtg

SEQ ID NO: 991120 - DNA, 25 bp, Mus musculus
tttttacaaagtgattggagttgtg

SEQ ID NO: 991121 - DNA, 25 bp, Mus musculus
tttttacaagccgaggagaagacct

SEQ ID NO: 991122 - DNA, 25 bp, Mus musculus
tttttacaaggcgaggagaagacct

SEQ ID NO: 991123 - DNA, 25 bp, Mus musculus
tttttacacacacgatttaattgtg

SEQ ID NO: 991124 - DNA, 25 bp, Mus musculus
tttttacacacaggatttaattgtg

SEQ ID NO: 991125 - DNA, 25 bp, Mus musculus
tttttatgaaagcacggcttacata

SEQ ID NO: 991126 - DNA, 25 bp, Mus musculus
tttttatgaaagcagggcttacata

SEQ ID NO: 991127 - DNA, 25 bp, Mus musculus
tttttattcaggcatgtgaaatgat

SEQ ID NO: 991128 - DNA, 25 bp, Mus musculus
tttttattcaggccacgcaacggga

SEQ ID NO: 991129 - DNA, 25 bp, Mus musculus
tttttattcagggatgtgaaatgat

SEQ ID NO: 991130 - DNA, 25 bp, Mus musculus
tttttattcagggcacgcaacggga

SEQ ID NO: 991131 - DNA, 25 bp, Mus musculus
tttttcaacaaatgcgatgcagaaa

SEQ ID NO: 991132 - DNA, 25 bp, Mus musculus
tttttcaacaaatgggatgcagaaa

SEQ ID NO: 991133 - DNA, 25 bp, Mus musculus
tttttcaaggaagagaagtggtggc

SEQ ID NO: 991134 - DNA, 25 bp, Mus musculus
tttttcaaggtagagaagtggtggc

SEQ ID NO: 991135 - DNA, 25 bp, Mus musculus
tttttcatacagataaaaattattc

SEQ ID NO: 991136 - DNA, 25 bp, Mus musculus
tttttcatacagttaaaaattattc

SEQ ID NO: 991137 - DNA, 25 bp, Mus musculus
tttttcatcccacgtctgtcgggtt

SEQ ID NO: 991138 - DNA, 25 bp, Mus musculus
tttttcatcccaggtctgtcgggtt

SEQ ID NO: 991139 - DNA, 25 bp, Mus musculus
tttttcattccaatgtgagttctta

SEQ ID NO: 991140 - DNA, 25 bp, Mus musculus
tttttcattccattgtgagttctta

SEQ ID NO: 991141 - DNA, 25 bp, Mus musculus
tttttccagatcaacgaggtagata

SEQ ID NO: 991142 - DNA, 25 bp, Mus musculus
tttttccagatcaaggaggtagata

SEQ ID NO: 991143 - DNA, 25 bp, Mus musculus
tttttcgatgagatggcggatccag

SEQ ID NO: 991144 - DNA, 25 bp, Mus musculus
tttttcgatgagcctgaattgcatc

SEQ ID NO: 991145 - DNA, 25 bp, Mus musculus
tttttcgatgaggctgaattgcatc

SEQ ID NO: 991146 - DNA, 25 bp, Mus musculus
tttttcgatgagttggcggatccag

SEQ ID NO: 991147 - DNA, 25 bp, Mus musculus
tttttctgctgtatatcccacaggt

SEQ ID NO: 991148 - DNA, 25 bp, Mus musculus
tttttctgctgtatatctcacagat

SEQ ID NO: 991149 - DNA, 25 bp, Mus musculus
tttttctgctgtatttcccacaggt

SEQ ID NO: 991150 - DNA, 25 bp, Mus musculus
tttttctgctgtatttctcacagat

SEQ ID NO: 991151 - DNA, 25 bp, Mus musculus
tttttcttcctgctctactcactgg

SEQ ID NO: 991152 - DNA, 25 bp, Mus musculus
tttttcttcctggtctactcactgg

SEQ ID NO: 991153 - DNA, 25 bp, Mus musculus
tttttgaaaataattggcaaccaga

SEQ ID NO: 991154 - DNA, 25 bp, Mus musculus
tttttgaaaatatttggcaaccaga

SEQ ID NO: 991155 - DNA, 25 bp, Mus musculus
tttttgacatgaagccctttgaaga

SEQ ID NO: 991156 - DNA, 25 bp, Mus musculus
tttttgacatgatgccctttgaaga

SEQ ID NO: 991157 - DNA, 25 bp, Mus musculus
tttttgatactgcacggcaagagga

SEQ ID NO: 991158 - DNA, 25 bp, Mus musculus
tttttgatactgcagggcaagagga

SEQ ID NO: 991159 - DNA, 25 bp, Mus musculus
tttttgcttaggacttgtctgtatt

SEQ ID NO: 991160 - DNA, 25 bp, Mus musculus
tttttgcttaggtcttgtctgtatt

SEQ ID NO: 991161 - DNA, 25 bp, Mus musculus
tttttggacagtgacctggtgaccc

SEQ ID NO: 991162 - DNA, 25 bp, Mus musculus
tttttggacagtgagctggtgaccc

SEQ ID NO: 991163 - DNA, 25 bp, Mus musculus
tttttggccgcacgagcaatgggaa

SEQ ID NO: 991164 - DNA, 25 bp, Mus musculus
tttttggccgcacgttctctccact

SEQ ID NO: 991165 - DNA, 25 bp, Mus musculus
tttttggccgcaggttctctccact

SEQ ID NO: 991166 - DNA, 25 bp, Mus musculus
tttttggccggacgagcaatgggaa

SEQ ID NO: 991167 - DNA, 25 bp, Mus musculus
tttttgtgtacacgcctgaccaggt

SEQ ID NO: 991168 - DNA, 25 bp, Mus musculus
tttttgtgtacaggcctgaccaggt

SEQ ID NO: 991169 - DNA, 25 bp, Mus musculus
ttttttgaagattggacctgcctca

SEQ ID NO: 991170 - DNA, 25 bp, Mus musculus
ttttttgaagtttggacctgcctca

SEQ ID NO: 991171 - DNA, 25 bp, Mus musculus
ttttttgcttagctcttgtctgtat

SEQ ID NO: 991172 - DNA, 25 bp, Mus musculus
ttttttgcttaggtcttgtctgtat

SEQ ID NO: 991173 - DNA, 25 bp, Mus musculus
tttttttggccgcacgagcaatggg

SEQ ID NO: 991174 - DNA, 25 bp, Mus musculus
tttttttggccggacgagcaatggg
